United States Patent 11,001,841 (CCCTC-BINDING FACTOR (CTCF) RNA INTERACTOME) - sequence listing, part 32

SEQ ID NO: 77599 - DNA, 1050 bp, Homo sapiens
tcctgacctcaggtgatccacctgcctcagcctcccaaactgctgggattacaggtgtgagccaacatgcctggccctaagacaatttaaatacagcaaactttctggtttggtcaatgtggtaatgcatgaatctagagatactgaatcttatctttactgctgattttatgctatttcccatagaatagcagaaaacaagtatcccttagtcaaaaataagaaaatccacaggctgtatgagaatcttataacatgtttatccaggaatgcttatatgttggttccaaagagtcattgaacaatttctcataaaatctttggataagagggagagatgagggttgcgtagggatttaatgaagtgggtgtctaacccttccaaagctgttttcaaaggttgctcattgatggatctatgctggtgtgaaatcacagtttctgccctcattttaccttatgtgacattttaataaatttctgatttgaggatattggtggcaggttaagaaaatttgcaagtgacctgccactggaagaagtagctcttgtatgagaagacaaagttggtaccaaaagggatcctgacaaatttggacaatgggctaaacctaataaaatgaaatgtcacctgtctttctaaaccaatggtacaaaataatggagagataaagtctagaattttaggttttacaaaaaaggttttgttggactataagctgactataaagatagcagccgaaaaaggtaaaggacttagggccacattactaagaaacgaacagactctgtaattgctaatacactgtttaaaataaaggtcgtggtggtgctgcttcattctactgataagaaagaccctgaataaagcccttccttcaggaaacactcttcctttattttactttccactctaacgagtagtaaatgcacattatggaaaatttagaaggcatagaaaaacaaacaggaaagtgccactaaatgtagtacttttatcattttgttgtatctccatctttttttctgcgaaatgtttatataatatgt

SEQ ID NO: 77600 - DNA, 1057 bp, Homo sapiens
taacccaatatatccaaaatattgtcattttaagataccataaatatattaaaaattactaataggacatttcatatttttttcctattaagtgctcaaagtccagtgtgtatattacactcacagctcatctcaagatacttgagccacatctcaggtgctcactagccacatgtggcccctggctaccatactgggtggcacagccctagagccgtggttctcaaccaggagcaaactgatcccccagggggacatttggtgatatgtaaagatacttttgattgttacaactcagagggtgatgctactggcatctagtggacagagcccggggatactgctaacattctccaatgcccaagacagtccacacgacaaggaatgacccggctccaaatgccaacaatgccgtgtttcagacaccctgctcgagagagagaaccagtttgtgctccttgagtgaaccggcaggagcccaggagtgccatggacgccaacacctagtgtgctgcctggcacacagtgggtacccgaaatcagtgctcagaactgaattcaatggaagacggcccatgactcagtctcagaggaatcacgctccatcctcttcaccagcagtgcagagacaccaagagccaggaaatgagttgtgaaatcaagaacaagggatcagtctcagtgcaactgacagttcacttgcttcgagatgctactgattcatgcttgtaaatagccagcctgctggggtcagggtgcagctttcttcccaccccccttaggcatcctggggcagccccagctcttgggacggggaagcctgcagctccggggagcagagtcaaagagggtgcgtgttagggcactggattgtgccctaactgcatcccacaactacatccccttctaactgtgaggcttcctctcaatttccttattcattttcctttttatcatgtgcctgcactgcatccttcagctcagcccattgctaagaaagctgacactgatctgcatcttcctcatctttgtctatttcctcactggttctgagcgc

SEQ ID NO: 77601 - DNA, 1058 bp, Homo sapiens
gggcacggactgcagtgtcagaaccgcccaaggccacgtcctagcctcaccgcttcctagctctgtgaccttcagtgagctactgagcttctctgggtctcacagtggcggtcactttctccaagacctcagatcaaagttcccaagcttgcaggggaaatggtgaactttgtaagattctgatgttgaaggtggtattttctggacagtcttggagatccttctgtggcactcagggctgttgtcactaccaaggtgttacccacctcccttctccccgtcccctctgctcccagagagaacaaagtgttttttctcaatgggtccagtcaaagacatctccccggccctgcggcgtgagcaggaagcaggtgggattgctttccccaacatgcacctctttccagggtggcacctttacccagcatctcccctgactccttccacctccccttcccctaaaaatctccccagcctggtttctctttagccttccctgacacttggcaatttgcaaatctgtccaatgtctccccttctgttttggcatctgaacctataaatagctcccagacaaagtcctggctgcattgtgacagtttgtatgcttgcactgtattccttttctcagacttttagaaagcctcatctacgcacttgctcaatacgaagagcagcttccaagaaaaggaatcttttattacagcatgaacagtgtagtggggagtcacctcagggtaacatgctgcttgcagcaacgacgagccctgtgaagcatgcgagatggtccaggcaaggtcctggacccaggatggtgaaaagaaatgaggtctgggccctgctctctggaagcttcgtccagggccagagctgggcctgtaaataaatcatgatgtgctgtaatcagctgtaaagtcagctgtgtgcccagtgcccaggccagtgggaggggccagaagttctgcccaagaaggcctcaccaagggatcacctggggactgcccgatgacaggggagatggtggcccacaggaaaggcatcactgccgacagtgaggc

SEQ ID NO: 77602 - DNA, 1024 bp, Homo sapiens
gtctaatgaagaacatgccgtctcggtgtctcagggctattaggacttgccctcaggaagtggccttggacgagcgtcatgttattttcacaactgtcctgcgacgttggcctgggcacgtcatggaatggcccatgtccctctgctgcgtggacgtcgcggtcgggagtgcgcagccagaggcggggccagacgtgcgcctgggggtgaggggaggcgccccgggagggcctcacaggaagttgggctcccgcaccaccaggcagggcgggctcccgccgccgccgccgccaccaccgtccaggggccggtagacaaagtggaagtcgcgcttgggctcgctgcgcagcaggtagcccttgatgcagtgcggcagcgcgtcgtccgccagctggaagcagcgcccgtccaccagcacgaacagccggtgcgcctgcggccgctccaccgcgaacttctccgcgcactgcgcgcacagcgcctgggcctgggtgtccgcccgcgacgccagcgtccgcgcctgctgctcgggctccaggtacgacacgcagatgaagtcctgcggagacgcgaggggcctgtggtcacggcggggccctgtctcctcaggcgccctctcccggcccaggcccctccctggatggatagcgggtggcgggcgccaagctgtctgcgagtccggcacctgcgcctttcccgtctctgccgcgagcctgcggggggcccgtccccctccctgcctggcttcccagctgggccgacagttctgggagatgaattaaggcgcgtctcggagtccctgcaaagaggagccggcgcgtcccctggctgctggtccacaggctccccatcattcattcattcattcattccctccctccctccctccaggtgagttccctgcaccccaggcgcaatgctgggcacggagggcagcacagataagaagggaggtgcgagcccgcccgggcatcccatagtgcgggcgggcaacacagtccagccccttagggctgcaagagcc

SEQ ID NO: 77603 - DNA, 1404 bp, Homo sapiens
atcgtccataaatatcaccagattatctaaaggttgggaaaggatccatgaaccaaaatagggcaagagccactggtcaagatgcttcccctctgcaattgcaaaagtggagtggattgtgtggtgagatgaggaagtttcattcttctcgtttgttttctcccagtacgagtatgcgttgagacatttgtacgtgctggtcaacctttgtgagaagccgtatccgcttcacaggtaactaatgcagcggtgacgcttgaaaggtcgatgtcattctgaaagcagaaggggctgccatcctcttctgcaagtgggcattttcacttctgccaggagctccctccagctttcctctacagccatttgtcagcagggtccagaagccacgttctcagtgacagctgctgggcgggcctgtcataactgcctgcctgccgcatgtgggtttgcgtttgtctgcctttcttcagagttgacacggttcaccaagttctccttcctgtctctcgcaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattcacgtccgacactgactttgtggttgatgctcctgcacctcctagcgggggcctcctccgtcatcgtcttttccagcgttatcgtcccgagtctcccctcccgctgctctgctgttttctgctcctctgcactccttgggctctgcagcctcctgtgcctttgctacttgctgttcctcctgccctggaacgcctttcccatctcctccacacaccctccaggtgcagtttaaagtagcttctttcctccagccttcctcaccttctccccactcatcaaaagttgtttttggctgggtgcggtggctcatgcctgtaatcccagcactttggga

SEQ ID NO: 77604 - DNA, 1581 bp, Homo sapiens
ttggttgaggagttgtggtggatcttctccaaactctgtgtttttatatagattggtgtgtgtggtattgctgattttagaactgttgttagattattgttgcttgctttaggaagagaacgcttgcagcattttcccttctgattgggagccagtctgtagtgaccgctacagccaaatcgagcctggccgctgtgcccatttggtagctcttgatgccaagcatcagcctggcctctctgtggccttagctctgcccttcccagtggacccagacttcagctctaacctgggcagatgctttgtaccttcccactactggtccttagggacttgcaggtgagtgcgggggagtgagcacatacaggtcacccgcctggataggcggcatcctttgcaggtgacattctttgcctggcatcctttgcagcagaactgctattcttttacatatgaagggcactgctgatgcagtcaggcagagcttggaccagagctgtctggtgaaagaatagcagttctgcaaaggatgccaggcattttgagtcactcactggtagatttcaggggctcccgtgcattgcctgcgtactgctggggtgaccatgcctttcagactgtgactgtggccctgtggtcctgaaagcatgaggagtaaatgtgagcctctgagggagaggctggacttggggtatgttgggcacctctgctcctcccactcaaaccagctctctctctccctctctctctggccttctctcactctctctcgctttctctctcgctctctcttgctgtctgtctccccagacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgtgagtagtggtgaaaggagctgtgcccaggtgctgtccccagcccaggtgggcagcatgcatgagcacggccctgcctcctatgctccctgccacacaggagtatggggggacagaagccagcctttgtcctccatgtaacggaagcgggtgggcggagccgtggttgcctcccatcttcatgagtaaactaaccttgacctcttcggtagtagggagcagtggaatgggggcctatctcccctgtatcgtaccaagaagccatgtacatgggtgtttccctcttttataccttgttgcttagaggatatttttattttgttgcttattaagttattagctaatcatattcattttaaaaatccagagacaggtacggtggcgtgcgcctctagtcccagctacttagggggctgaggcaggaggattccttgagtctgggactttgaggtcagcttgggcaacctagcaaaaccccttctcttaaaaaaaaaaaaaatccaatccacaaaaatttctgctgttctcagaaaaacatagtcatgcctaaaattctttctaaaatgctta

SEQ ID NO: 77605 - DNA, 1055 bp, Homo sapiens
ggtggtggtggtggcggtggtggcggtggcggtggtggtgttggtggcggtggtggtgttggtggcggtggtggtgatggtggtggtggtggtggtggtggcagtggcggtggtggtggcggtggcggtggttgtggtggtggggtgtgtatgtgcacgtgtgctcacatgtgcaatgtgtacgtagcccacgtgtgcactagtttcctgctgaataatactttggatggatgggagatctttttaaattgagataaaaaatatcaatgtatgtgttttaaaataataatttaaatgcctgaccgacgggatgattcacagtaagtcttccaggagacagaacacatcactccttagaactccaaaattggcctcccaggcaagatctaaaacttcaccaaatcatttctcccaggcagacgcgtgccatgcctaccagatcattcaccgcaatgggattcctgacgaacagatcgttgtgatgatgtacgatgacattgcttactctgaagagtaagtggggaacacttggaacttggtggggaaggacttcagggtatttaaaaaaaggtcacatagactcacaggaatcctagtggcctaatgttaaaatatataagagactcccagacagaagatcacagggatacctcatgttgagcttttttttttttattattatttatttgagacagtcttgctctgttgcccaggctggagtgcagtggtgcgatctcggctcactgcaacctccacttcctgggttcaagtgatcctcccacctcagcctcccaagaagctgggactgcaggtgtgcactgccatgcccagctaatttttgtatttttagtagagacaggatttcaccatgttggccaggctggtcttgaactcctgacctcaagtgatccggctgccttggcctcccaaaatgctgggattacagatgtgagccaccatgtctggccctcatgttgagcttcgaccataacttgggtgtgccctgggaatggcaaagacataggaagtgggtgctggtcgctgctttgaaaggg

SEQ ID NO: 77606 - DNA, 1396 bp, Homo sapiens
ttcatttgattattgatatttgtttatataaccttataaagtatcaagtcttttacccatatactgattgttttagtcagttttattatttagatatatagttcattttcatcacataatttttagagtaatttaaaagtatacttgcattatatttagtaacaaaaacaagattaatctgaattcatgtgtctctatctctttgggtaagacatgttagattccagtttgattaaaaaaaaaaaacaaaaaaccttgtagtgacctgttattactcttcttgccttgaaacctgcagctactctattgtgccttcccaatttttcagtatttgagacttctcctggttttttttcccaaaagcattttggagacaaaaggaaatccaaacccattttacctgaacccaaccactcacatgatctctgatgttctccccagaatggtgttgtactgtctgttgtcattcattcagtgtatccagacttgagtatccttagaggtccatatgccccatttatgagaatgaaatttaatcagagggaagactattgaaaatttgtttatttatgtattttttttgagatggagtctcgctctgttgcccaggctggagtgcagtggtgcaatcttggctcactgcaacacctttggcctcccaggctcaagtgattctcctgcctcagcctcctgagtagctggcactacaggtgtgtgccaccacacctggctaatttttgtatttttggtagagatggggtttcaccgtgttggtcaggctggtctcaaactcctgacctcaagtgatctccctgcctcggcctcccaaaatgctgggattacaggcatgagccaccgcgcctagctgagaatttactttttatggtgttttagctgtagcagtcaacttgagcatcctaccaaagcaagttgttaatgcatatgtgatgaacacgccaatgtaacaaaaacgtattcttttttttacagaagctgccagtaactcagattctagccatgaaggtcaagaggaatcttcaaaggaaaatgtgtcatcaaatgctgcctgccctgaccacaccccaacacctaatgatgatggcaaatcacatgaactgtctaaccttcgactggagaatcagctgctgaggaatgaagttcagtctttaaatcaagaaatggcctcgttactccaaagatccaaagagactcaagaaggtagaggcttaaattgttcaggattaggaatttaacttttaaaaataaacttaaggctggacgcagtggctcgtgcctgtaatcccagcactttgggaggccgaggcgggcggattgcctgaggtcaggagttcaagaccagtctggccaacatggtgaaaccctgtgtctactaaaa

SEQ ID NO: 77607 - DNA, 1050 bp, Homo sapiens
gcactactttgctctttttgcattgatttcctaggtcaaaagaataacatctttttgcaacagtaattgaaagcaatagattcttttctgtgtttaggttttgttttgttcttactaggatgtacctttgatttggatttgcattcctttccctgtcactagcagaactttacaaaatatactctgctatctattaatactagtttcggctcccagatgctttatcatatagaaacagcattgtagaagagcagctagcttcacgcccctttctaatcaattaactataatctagctgtgaatattgcccttgaaaagtggatgaccctttggggcaaagaaaattgaagacgtgtaagttcccaattttgtcaataaggaaagtactaaaggcactcaaagtagaaactgtacgtgctctgagaaaaatgtgtttggttttgcttgtatagagaaatttaaattttttaatagaattaaacaaagcaagagcaagagttgaaaagtggaatgctgaccattcaaagagtgatcgaatgactcgaggactccgagcccaagtagatgacctgactgaagctgtggctgcaaaggattcccagctggctgtactgaaagtgagactccaggaagctgaccagctactgagtactcgcacagaagcattagaagccttacagagtgaaaaatcacggtaggtgattctatgaataatgaaaaaaatgagcaagtaatggtaaacattgtagtgtatccacttatgaaacttagctttcttggaaatttacaagagggaatatttcttttggtagtgttagaaatgtgtatgattaaaatggattcattggctgggcgtggtggctcaagcctgtaatcctagcactttgggaagccgaggcaggtggatcacctgaggttgggagttcgagaccagcctgaccaacatggagaaaccccgtctctactaaaaatacagaaaaaaaattagccgggggtggtggcacatgcctgtaatcccagctactcaggaggcgaggcagcagaatcact

SEQ ID NO: 77608 - DNA, 1917 bp, Homo sapiens
catctcatgtgtaagccctttctccatagatctatgcccttccttcctgtgtgtgcctctctgctgctgctgccttctggctcagcttactcaagagcacatggttatttagtggaaaaatgaagactagatctcggactcctgcctaagagaaaaacagtctcttttagctttgtgaccactttgcactatttccctatcttcctttctttcagtgtcatgcttaccagaattgtgtacgtgctgtcttcatttctgtagaacttgttaactcttatctccttcttttcctactacatgtctgaaatttcttctcaaaaatatttgatgacctaaataaatattctctgtccttttcttagtctccataccttgtattttggtagaacatttggctctgttaaccctcccacttccttggaactcctgccttctatgctattcacatctccttggctctctttttgtcctcttctactgctgtttctgtctctcttgggcgctcttcccaatctccaaagagtcagagtcctcctaagctctgtcctgaaccctctttcattgtcctttcttaccttgcactgctgtatgctgcctctgcttctaatagccgcctgcatatgacttcaagcatgtttccaagcctgacctcctgacctcagtgcccagctgcctactgtgcaggcatggagtgttcagctcccagaccaacttctccctcattcttctgttctggtcaacgttactgccatgtggcagtaaagcttgaaacctcagggtcatttttgactttaccttttttctttagtctcaaacttctaatggctatgaatacctttttttaatgctacttccatgaagtatcatattgatctcctcctcaaactcttctttctaagtacttttttgtatcaccctaatttgttaattcattgaaaagttacttattgagcacctaactactcactaggcacagaggatacaaagctcaaaagatgtgtcctcttcctttaagaaaacattcatcttagtggaaagaaacagataattgacgtaataaggttattaatgcagtacaatgggagcttgagagaagaatcccttaaaacttgcctgaggctgtcaaagatcactggactgaggagatgtggtataaagagaaacttgaaagatgaataggaagactcatgatagggaagagatttccgagagaacaacctgtgccagagcaagggggccagagagaacatggcatatttaagggactgcagctagttccatactgctggaacataacgtcttcagagatgggaggcaaaagactcataaagttcaacggcaggcagaagccatggtcaggtttgagtgtgagaactgtggcagcctgatgaaaaggttaggggagatttgggcctctgtcttgttcatcgttgtatccccagcacagtgcctggtattcggtacattgttgaaaacatggaagtgataaggggtggcatcaatggcatgtagatggtgaagaggtgatcataagaaataatgaggacctgatcaaagtttttggcagtgaggatggcaggcaggggacagctaagagatatgtgggagatagaatatatgacatgtggagatttaactggaaggatgggggaaaaaggcaaatggaatccaggatgactccaggtttttggtttaagtgtatgaatgatgtttccttgtgttaataaaaggggaaacaggaaagagaacaggttagggttaaaggagagtatgacgaattatggtaagtatgcaaaattgatgcaacattgaggtgacaatgttagaaaggtaattagaagtaagttgggagagtaggtaagtttaggcaagagcgatgtgtaacctaacggggagaaaggctgaggtctaaaaaca

SEQ ID NO: 77609 - DNA, 1050 bp, Homo sapiens
agtgcggtggcgcgatctcggctcactgcaagctccgcctcccgggttcacgccattcttctgcctcagcctccctagtagctgggactacaggcacctgccaccatgcctggctaattttttttgtatttttagtagagacggggtttcaccatattagccaggatggtctcgacctcctgacctcgtgatccgcccgcctcagcctcccaaagtgctgggattacaggcgtgagccaccgcacccagctggaaaaaaaaaatcttattcataacaagctttcaactttaccatgattgtggggctaaagtccaaggacattatacagcaaggctctgttgtgttttttatccttagggatttaagaaaatctgtggactttctttgatggagataatggaattttttttagtgggttattttctgtatagtagatgatattcaatatacaaactaatctctgctttgcttaaacatatttcttcttttataatagtctaaggaaaaattgattaacagcttgaaagaaggctctggttttgaaggcctagatagcagcactgccagtagcatggagctggaagaacttcggcatgagaaagagatgcagagggaggaaatacagaagctgatgggccagatacatcagctcagatccgaattacaggtaagattcatggtggttcagcttagtagacaccatttaccctcaggtgttaacagtttgagaggtggggaaacagcattactaaagcgataggtttctcgcttctcttcgcttcgcttcgcttctcttctcttcctcctcctcttcctcttctcttcttttggagtcaggatcttgctctgtctcccagcctggagtggtgtgatcatagctcactgcagcctcgaactcctgggctcaagcagtcttcccgcctcaggctcccaagtaggtggaactacaggcacatgccatcacgcccagctaatttttatattttgtagagacagggtatccctgtgttgtccaagctggtcccaaactcctggcctcaagtgattgt

SEQ ID NO: 77610 - DNA, 1133 bp, Homo sapiens
ttaatatatcagcatcattaatgacattgacccattttcttacccttctcaaaatttatgcaatgtataataagtgttaggtctaacaaaatgaaagaattgtaaataattacaatagctattgtttactgagcacgtatgttccagatactgcacagagcacttaacatatatccttacatttattccttaccataactctgtgagggagatgatgatattctcattttatagttgaagaaatttaggcatggagaaggaaagtaacttgctgcaagactagtaaagtggcagagccaggattagaacctagtctaactccaggacatgtttttgaccactgtgcatactgcctgcctctcaagaatttgcccgatgtagtcaaattgatgacaaagattaatctaccttctgctaacctgaaaactcaaaggtagggaaaaatagttgtcattattgctttttcctctaaatctacaaagttgtgtgagttcagaggattgcactgtgattatctgggcatcttgttagtcttagttctttcaaacagcatgtgaagttccaaggtttgtggtgatgagtatgaaacagaatgtaccaacagataaaaaagcaaaaataagatgctgattttaatcttctgttgtgccatatgaatggactcatgcttaatccatttggggaaaatatagaaacctagagccatgtttttgctactaggagatttgacaggaaatccagaaggtgagttcaaagaaatgagagtaagaaacataagaacatgtaaaaaccaataatagtaataaagtaataaagctaaaagaagaaaattatatgccaacttctggtgatatgcaagacaagttatattcttatcatatgttgattactggggaacagatgcacaccaaaactaattataacctgcaatttcaggggactaatgcagtgaagtcctttgtgctattatgtttctgattttttttgaaactgttagcttttgagtaaagatataagtctcccagtgagcctctgccgatactcgtgaaaccacatggcttatgtgctgcagcagctgtagcgccccattcattctgctgttagccatagtagacaatgaaggtgtcaggtta

SEQ ID NO: 77611 - DNA, 1059 bp, Homo sapiens
gctccctataggctgaaaccatgtctcattcacctttattcctcagtgcctcctgagcccagcacatagtaattgcatggtagacaggttgtgtggctcaacacctgtaatcccagtgctgtgggaggattgtttgaggccaggactttgcaaccagcctgtgcaataaagccatatcccatctcttaaaaaaaaaaaaaaaaacttaagccaggcctcgtggcatgtgcctgtagtcccgctactcgggaggctgatgtgggaggatccccttgagcccaggagtttgaggctgccatgaactgtgattgtgccactgcactccagcctgggtgacgtgagactctgattcttaaaaaagaaaaattgctcaataaatgttgaactgaatgttaattattgcttttacatgtaagctttttctctttaggatatggaggcacagcaagttaatgaagcagaatcagcaagagaacagttacaggatctgcatgaccaaatagctgggcagaaagcatccaaacaagaactagagacagaactggagcgactgaagcaggtcaggatttgagattgatgacttctgagactctgtcctctagcggtcatatgagcagacctcccaggaaagcagcttactgaaatttttagagtatgggcttagggttaccccacaagttcctcctgccttcccatctcatctgaaggggtggcctgcccctccacacctgtgggtatatctcatcaggtgggatgagagactgagaaaagaaataagacacagagacaaagtatagagaaagaacagtgggcccaggagaccggcgctcagcatacggaggaccttcaccggcaccggtctctgcgttccctcagtatttattgatcactgttttcattatctcagcaagaggaatgcagtaggagagcagggcgatagtggggagaaggtcagcaagaaaacatgtgagcaaaggaatctgtgtcacaaataagttcaagggaaggtactatgcctggatgtgcacgtaggccagatttatgcttctctccacccaa

SEQ ID NO: 77612 - DNA, 1080 bp, Homo sapiens
tatatattgttttatattctgccaccttactgaattattgtttttctttgtctcatgtactttgcctatttttaaaatgttcctggtttgtgtttttaatctattttatgaacattatattgatctttatcatatattttatgaatattttttccagttgtcatattaatgctatataactgagattcttgaagagattatccattcttcctcattacaagataaacattttttgtttctgattatttacactgttaataattatttattatggatctttgtttacaatacatactgaagtgccagcttttcatcagacccatctgttattcacttaattatatactcattatataatacactctgttataaactcagttatatacggagttacatgttcagcacatactgattgtctaccatgtgccaggcactgatttaggtactgaggatggaataggggacacttatttcgcttctgttttgtttgtgcctcactttgcaggagttccactatatagaagaagatctttatcgaacaaagaacacattgcaaagcagaattaaagatcgagacgaagaaattcaaaaactcaggaatcaggtatgaatcactattcacaacttgtgaaaagatgccactgataaagctacatttttttaaaaaggacacagtaagaactttccccgtgttttcacctgagttcttttgtaacagtggtgacaaaagttcttttcaacctggtatagaaaattcatctaatgccatttgagtctacatttgctctgttctatgatttgcttcttatagaagtatcttgtagccaaagtcacgaagtagatgagaattaccccgaaatttcagacctttgacatcagtgtggttgtgctgattgccaggttcataattgtgatttcattttcctaagaaaaatctaatgatacatcttcctattaatgattgatcagtcttccataaagtcaccaagatatttttttaaccgtgaaaatgtaaaatgtacagaaaataatgacactcatgtgcctaccacccagacttaccaaagcctttatcattag

SEQ ID NO: 77613 - DNA, 1037 bp, Homo sapiens
gggattgtgaaggtggactgagaatttattttaaaggtaagctgacagaatatgttggcagatgagatacggagtttgagagaaagaagtcaagagttttggcctgagcagatggaaggattggaattgtgatgtcctgagacagggaaatggcagctgaggcaggttgacagcgaggacaagaactctgaattgtagtgttaggcaggctttggggtgcccgttagatatctggatggaagcgaataggcagttggatgagtctggcaggggatgaagcctctgggctggagtacacatttgggagtcctctgcttcatagaaagaccacccggcctcactcctcctcacataggaacaaagggcccattaatattgactcttgtcaacgcttagtatttgtaaatttcttaatttttgctaaaatcattttcttatttaaaacttttttcttgttgtggatatggatgtttaaatatttatgtcatcaaatttacctgtcctttctttatagtttcatctactttggggtgatgcttagaaagttgcccttgaaaattccttccacatgtaatacagtgtatttccaattataattgtcttagttaatttttatgtcagtacactaatttattttcttatttaaacaggcactcgtctgcgaaatgttcctgttctttttaatgacacagaaactaatctggcaggaatgtacggaaaagttcgcaaagctgctagttcaattgatcagtttaggtaagcaatgccagtagggatgagtgatggaccatcagctgtttttacgtttttcagggtttcaatcacagtgactcccatcaggcagagtctatatttaaagtgacttactcctttcaagatattttatacttatatacacttttatttatttcacagttatattacactttcatgaagtgacttctttcatgatatttgaaatatcatgtcagaaattatgtcaagaggtctgccaatgcctacattttattgaagatgattaaccctgactgtatctc

SEQ ID NO: 77614 - DNA, 1020 bp, Homo sapiens
ctctgactgtccccacacctgtgccttattcctgatgttggcccctcagttagcccagctcatttcttccccaacaatgggctttcctgggcagctgtgggccagggagcatgcccagccctggtctcaggcaacgtgggttccagtccccttctggctatttcctagctccatgggcaacttgggctctccaagagttgggtgcttgtctagaaaatagggttgctgtgtggtaaatgctaagacagaggcacacagaagatgttatgggagcccaagagggagtggacggatagacggatggacagaaatacatccaggaatctgttaatggaaaatagtcatatatacatatattggatactgcttatacgggatacacacgtgcatgtgaatagagatgtttcaggacacattctcctataatagtctctgttgacagtctatttaattatttaaatgtaatcagttagtcattcaatatttaattttaaagttatcaattgtaataaaatatttaatgcttagttaaaaacaaaacaaaacactagtccaaggtcactgatgatgacataactatccaggtaataatagtcccagctgtgcccagcactccctgccccctccaacaacagtaggaggtgggtgcttgctgcccaggctggctcatgagtgggaggaagaacagtgtgttagcttggaaagggccacaggaatcctactgacgtggctgtgtttacgtgcctcctccccaaagccctctctgttctcacacatggcctggtctgtcccaaaggcctcagagtggggcccatcctgaagccagagcagccttcgtacccccaccccaccccagacacaagcccagccctgaaaaacactctcgcttcgttgggaagcagatgctggattcatgctgtaatgccctgttctcatggagagacacaccaccaccagtggtcctgccctggtggaaacggccgcttcccacaggaagtcagccggggcaggtgcagggcc

SEQ ID NO: 77615 - DNA, 1052 bp, Homo sapiens
agagcccgtgtccccacctggcgctgcctctgcatggcccagctcaggtgtggctggggacggggagaggaaggaacctggaggccctcagcaagtgtgctttaatccctgcacacactctttgaggcaggtcagcattcccgttttacagatgaggaaactgaggctcagagctaacaaagtcacttgctcaagatcccacagccaggaagtggcccagaaaggaggtccccaggaggactgaacctccctttgtcccttcgcccaaatccagtgcatctcactccactcttaagttgagaggcgaaaaaattcagaggaaagagcccagaacagatttatttttctttagataaagttcatacagaatatgttacagtcaggagttctcagctttcaccaaaaggtcagaagttattgcagttgtgcccagtggataggatggaggaagggaaacttctagaaagctgcctgtgttcagagaaggaatcgtcaatgtttaaagttgtggggctgccctgcaaaggatgttccagggcaggtaggagtcaggagtaggagacaaggcgcgtagggggcgatagggtggcctgggcttgggcaggctggaggctgcctccctaccggaagcagcatccgggccatctggccaggacctgccaaggggacagcagagccagggccacagggtgccctggggccagccctgccagccggtgtctcagccccgccgtagtgcctgcagctggtgggccactttctccagctctgcttcaatggccgacaggctctccagctcctggtcctaggagagacattggggttcactcgggccagcctggccagtggcatggaaggcacagtaagccagaaaggcgctgggttagctgtgtggcctcggacaggtggctttgtctctctgtaccctcatccatcatggagacagtgataatgagcttactgtactgctctcgggatcattatgcacaagaaggtggctgatgccgggggccctgtccccacactgctcttggtggcctcttatccaggcc

SEQ ID NO: 77616 - DNA, 1024 bp, Homo sapiens
aagagatcgacaccatcctggccaacatggtgaaaccccatctctactaaaaatacaaaaattagctggacatggtggtgggcgcctgtagtcccagctacttgggaggctgaggcaggagaattgcttgaactcgggaggcgtaggttgcagtgagccaagatcgcaccactgcactccagcctggcaacagagcaagactcctcaaaaaacaaacaaacaaacaaacaaactctgatcattcacccggtgggatccccggcagctccttctccttcccgagctgtggctcatgggccattggattcagagaccttgagctgggtgctggctgccctaaaggagcacgacccctccagcctggtgaccgggaggcagagaagtgcagctgtccttgacaaaggcccagcctctgctgcctcaggccagcctggccacaccccgatgccacagtcatctgccccgcccaggcataagcctgactcaggtgatacaggcgaggcttctcccatgggtcctccccttgtgagaaagggtctgtgctgtgtaccttctctctgcacagccattgtcagtgtggtttggagtgagtgagcctcccgcactgctcaggggagagctggtgagcatgactccatggcctcctgctggttggggtcttcttctgattctcacccgcaggagcacccagacccccccttttcagaaatgattacattttcccttcaagagtcatctgtgacctggtggtgtggagggactgtcccctcctgcagcctggccgacccccttcctccagggctgtgtggaatcacctctcagaagctcactctgaaaagccactcacagggatttcaccaggatgttgctgttcctgccgacacctgggctttgtgacaaatgctgtttgcttcaagctgttcacaagcaacttcaccagaatcccaagctggttcgtacttaatttgtgtacatacatatgcataatatacatgaccatgtatgagatacagacaccatggct

SEQ ID NO: 77617 - DNA, 1049 bp, Homo sapiens
caggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctctgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgcatttcacacgtgtttacacatgttgctcaagtttgttatgtcatactcccagtccttaaaagacgtttaataaaacagctttaccttttaaaaataaaatttcaatcccagtctgcctcaggtacgggtgggggtgtgcagcgtgactcctggctgtgttcctgtaccgtttgtggcctccggggtcttgcgcgtccagggcccagataccgagtaactgccatgtggtgtcgtggtggcgtccataggcctccgtggtggggcgggggcggggctgtgggtgtgcagggcagctgcattttccaagagtggagatggaggatggagatttgcttcgtaaaggcctgggagctacatgggaggtagggaggggccagccacacccagggctgg

SEQ ID NO: 77618 - DNA, 2871 bp, Homo sapiens
gagaagaaaaccctgggcccaccggcactcactccccatttcccccacctcatgttattggcagccgctgagctcgttgctgtctctgtggcgttacctgtcctagatattccgtagaaatggaatcacacaatatatgagcttttgtgtctgggttcctgcactcagcatgatgtattcagggttcctccgctttgtggcatatgtcagaagttcattcctttttatggctgtacaatattccgtcgtatggatagaccagtttttgtagctgttcatctgtggatgcacgctggggtatgaataacaccacggtgagcgtgggtggacagcatccgtttgagtacacgttctcagctctggggtgtgtaccccggagcagaactgccaggtcagatggttattccatctccagcttttgaacccagcttcacttttgtctttcatggatcagccactcccttcccctttggcccctaagcccacaacccccaaaacttcactatttattgagcacctagtgtgagccctcccttggctgatttagaggagacgggatgcagttcctgccctagaattcagatgaatctcctcccagccgggcacatgctgtccacaccttatcaacataagtctgagatggaggcctgttgcttccttttacagaagagcaaacctgagacagagaggccaagtactgtttccgaagtccacagagctaggagttcactgtcaggtttggaacccacgtctctctgactccagaatccttcccagtgcagtgccccacttccttggaggccttggctgggggcaggctgagcccatgacagtgtgtgcctgtcccaggccagctgcgacaggcacaggacttgagtggcagaggggagtgccgggctgggagggagaacagagcagggtggcctgaccagcacatggaaaccttgaggaaagctgagcttggaccccaggaggcaggcaggagcagcagagcagcctctctggggagcccgcattgtttagggtgtgagttcatttggaaacagcattttttgggaaggaagactggcctgctgggccacagggccctcaccctcacctccttgggggtctctgtgatggcaggcaagtgggggtctgatcagaactcctcacttgtgcccggctctgcgccccagctgctcctagccatgtcccgcagctgctggcctcagcacctttgcctcccctgtgtcctccctggggccgctctccttctcccacccctcccaggggcccacatcctcctgcctccaagttccggcttcggtgctctgcaccatgtcttcccgggtccctgacacactctccatctccttcctccctgttaaaaggctttggttttagaggctaaaaaatatgggtccaaattctgccctgtgcttttgagctgtgtgactttagaccagccccaaccctctctgagctccggtttccctgtgtgtaatgtgcagtgctggcactggccttccaggctgtgatgagcccacaggaggtaatgagcctcacacacctcgtgcctggcggccctcagagggcaggacctggccagtggccgccccgtgctcaccacagtaggtctgtctggcttcctggcctgaagcatgccagggcctcgtggcagctggtgtggggggtctgtctgtgtggtgtggcttcgcagctcctcggcccatggcctgacttccttgtgtatgttggcagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggtgagtggcggccaggccacctccactgaccggcctccagagactgtcctcaggtgaccaggcaggtgaggcggggtgactgaggccagaaagccagctttctccctcaccacgaggtccggggaggtgcagccccgagaagcctcagcctcacctgcgcgatgggcttacggggtgtgcgaggagggagggagagctgcacgtccacctggggagcgccaggcacagtggccacagcacgcatgtccctcacctcctctctccacctgcgtcattggtggatcagcccctcccccaggccctcctcgatttaaggagcaggaaggaccttgaagggattacagccccctgcagtttacatgttgggaaactgaggccctagagaggaggaagctgttcaggccccacagcacattggtggcaggccagagactcccaggctcacgttgcctccaccaccctgaactgcagcgccgggcagaggcctggggaggagccctgggctatggagtctgttccctgctgccagctgggccctaggaacccactggcattgagccaggctctgccatgtgcccctcagctctcagtgaggggccctatggggaccgcaggagcagagccccagcacagggcatgaggaacgatggtgtgacatcacagctcgcggtcaccaggctgcgtgcctcgccctggggacaccaaggctcagtggcttgtttacctcccgcagcagctcagagacagagccgcgcttgatgccttggtgcctgccattccccagatgggggtcccccgttcctttctccatcctgacccttgtaaagcatctgctgtggaggtgaagccagccttgctagctgctgaggtgcaaaaacgttcaggaaatgcctcctgccttcagagactgtgcctggcaggtggggactcggggttgtttatcgtggaggtgaggcaggaccttg

SEQ ID NO: 77619 - DNA, 1181 bp, Homo sapiens
ttaagagcacagactctgacgggactgcctggggtccggcccaagctaaggcgagtcgcgtcgcctctctgagccttggtttcttcttcctgccccagaaggattccggagtccagggagttcctgggtgagaagcacccaccgcagttgccaggtgtgcagtatgggcacggtctcggcagccgggtgccgaggcccactggggacccatgaacgccttcccagttcctctgtcacctccttgctttccagaacgtcatcagatcacttgctttgagggccccaggcatcttgtcctaggatggctatttggttttggataaccagacaacttcggaaggatttctgagattctgcaaccaggccgagagcacttttgtaaatggcgtgccatggggcgtgtggcagtgcagcagccaagctcccttgctgctgggcctgtgctgtcagcctgaggcagcagctcctcccgtcgtcggcaccacaatctcacagcgagatgtttttattaccccatttactggggcaagaaaacaaggcccagaagggttctgttatggcttagggtacacagtggagagtgggcagctccaaggtatccaccagggtctctctgactcagtgagggccttgggctgcaggatgagtggctgagctgccccactaggcttagcctctggcccccactggcaagagtgacccaggaggctcagaaaagctaagtggctgggcgcggtggctcatacctttaatcccaacactttgggaggccaaggcgggcagatcgcttgagcccaggagtttgagaccagcctgggaaacgtagtgagatctttaatccctaccaaaacaaaatacaaaaattagcagggcgtagtgttgcttgcctgtagttgcggctactcaggaggctgaggtggtaggttcatttgagcccggaaggtcgaggctgcggtgagttgtgatctcgccattgcactgtagcctgggcaacagagcaaggccctgtctcaaaagaaaaaaaaaaaaagaaagaaaagtgctaagggatgagtgtctcttacagccaggccactcctgccccctagaaagtatttcttccagatacgacaccaaggccttgaggctgtgagcaggggggccctgtgtgtcctgcaaagccggggtgggagatgcgctgg

SEQ ID NO: 77620 - DNA, 1051 bp, Homo sapiens
tgcagtgcgggtcgcaatcaggtctcatggcatcagagaggctcagtgatctttgcacgttcacaaggctgttcacacggtgcaaggctggggtttgaccccagatctgtctgactccaaagttggatcttccaggaatttaggacttctgacctcaccagtgattcctgagcacctgaccccaaagaatttaggaaaggctaccctctgctgtttgcccgaagtccagagagccagcggctacttccctaaactcaagagccctctgccagggagcctgctgttctgaggatgcatgtgtgctgctcttctggggggctttgctggtctcttcctccctgtcctgggctggcctctccaacgaaccagcctccactccagtggcagtgctcgtgtccctcggggggctgccccagaacccagatggcctgtctgtctgtctgtcttttgtgtcagggtcctctgaggagccagcagtgtgctgaggattagacagagcacaggcgtgggcaggacctggagggaacatcgccatccctcaggatgttgacacatgtcccctgggaacatatcaggctttgggaacagatttcaacagagcctcagtgcctggctgagaatattatgagatgttctgtgcaagagacggctttcttctaagcttcagaatcctggggcttcttccgtgcatggctttgctctgggggcctcggcagcccatgcaatggaggggatttggcatttgcagactgagtgtcctctcaggggcaaggccagcagccgtgatggcagaaggacccatccagaagtcactgtcttggattatcacttgttgacctcagccttaatctcctcatctgtaaaacgggaaggggtcagcctagagacactgcagggcccttcccttcacctctgaggtctgcagtcacctcctccttccctcagcacatggctgctagtcaggaatctgccaggactgacgatttccaaaaatagaaaagagaaatgcggtcagcaccaccttttccactgggacatcagcccctcctgg

SEQ ID NO: 77621 - DNA, 1754 bp, Homo sapiens
tggcatccatgcagaggctttggctggagctgaagtcaggttgtggcttgtgccatccaccaggaacattttgtgttctctgcctgtggttcgcattcacagagagactgtttccctccctccaccctgtgccagggtagagattagcgggttcctttgctctccctttctatagagtgggtttatttcttgctcgtctttaccctgaggacgcagcgcaggctcccagctttatgcaggttccctccattattctctccagcttgagccttgtttctcttaggcatgcatgagtggtacctctcaccatgtagagcgggaggcagcaaacttttttttgcaaaaggccaaattataaacatttccagctccatcccaattatttaatgctgccgttgtagtgcaaaagcagctgtagatatgtaaatgagtggcacggctgtgttcaaatgaaactttatttacaagtgcaggtggccgggcttacagcctatagtctgctgagctcctctccagagcctcttaatagtcagtgatacagcatttatcaaacctaccatgtgcccagccctgcgtgagctgctggggatccagtcagggactaggcaggcacccagcttcctgccctcatgagcttgtattctggtgggagaaactgcacacaaggagagaaataagaaaagggtcaactgtggcctgagataaggggttctgaggggaagagaatatgtcctgggataccactgggtgaggggagccacttggaaagggcagctcaggatttccctctgcagagatgatactcatggcaactggaagatgacttgggtcaccatctgtagcattaggacacattctccccatccccttcgcctcccaagagagagagaggagatgaaggaaataaggctaaaagcagtgtggcccagctcgtggctgtacggctgagttgctgggatgtttgggggctaatcttatcatttattcttcttttaaacctattttttaaatccataagttgagaagaaaacacacacattcttcctttcattgccctccctccctgtagaacgttggtggtagttctccactggtgctattgggctagtccaggaacagactgcatggggcacccaaaatccagggtgctgtcgtgagtgagggcttgctgatacatgctgggagcaacgccctggtctggtgtgttagaggaaccgactctcttggagctggccaccaggtttctttccctgatgccttctcacttgcctcagctttccatcatctcttgggtgactggcagccacaggaggctgctcctactccctccgacccctgttcagaccgcacatagagaggaactgagcccagaccatctctcactgccctgccaaaagggtcttctggccagagctcccaggtcagaattagccagaagggccaggtgcggtggctcatgcctatatccccagcactttgggaggctgaggcgggcagatcacctgaggtcaggagttcaagaccagcctgaccaacatggcaaaaccccgtctctactgaaaatacaaaaaattagccaggcgtggtggcaggtgcctgtaatcccacctactcaggaggctgaggcaggagaatcacttgaacataggaggcggaggttgcagtgagccgagatcgggccacagcactccagcctgggcaacagagtgagactccatctcaaaaaaataaaaagaaaaacagaattagccagg

SEQ ID NO: 77622 - DNA, 1005 bp, Homo sapiens
tggtgtgccgcccggcatggaggggctgcagtgctgcggttgccctctcagcccttcttcccctagatgcctcttctctttccatggacacatgcagagcgtggatactttggaaacgtgcaggtgttcattttcctccgagggcaggtggccttcctagctgggcgtgtggctcccagactcaaggctgtattttcagggtttgggacatcatggtcccagcccctgcccactgggtgggagccaaatgctggaagcatatttttatatgtggctatataccaccaagagatattcctccaagttatgggctggaagaggctgacattttttaaaatgctgtttattccctgatttaagaaaataataatgctttaagtctatggaaaatatattaaattaagaggagttatattttatatcaactcctttctgtttttacccaggtcactccatctctaaaagaaatttactgtcagatctcctttcttatccactgtggttgggtttttctgttttctcctttttccttctggttgcaaaatgctgggccagtttccgtctcgacgctgggaaccattaacagcagagtgtgggctcctatcctgtatctgtgaggacgaggactccttgcctgtgtgtcttcttgtgtggctatttctaggttgccagtttgccataaaatgcataccaggagaccagacgtggtggctcatgcctgtagtcccagttctttgaagagaccaaggtgggaagattgcttgaggccaggaatttgagaccagcctgggcaacatagtgaaactccatccctaccaaaaaaaaaaaaaaattaaaaaattacctgggcatggtggtgtgcacctgcagtcccagctactaaggaggctgaggcaggaggatcgcttgggcccaggagtttaaggttgcagtgagctgtggtcatgccactgcattccagcctgggtgacagtaagaccttgcctcttaaaaaaaaaaaaaaaa

SEQ ID NO: 77623 - DNA, 2079 bp, Homo sapiens
gttttaggaagttggactcactcttagaatccactgggtgggcctggagaggggcccaggaatgccaagctgtgaagggcgaggaggaattggcagggggaccaggcgcggcctgggctggagcatgcagcagagatgcagtgagcgtggtggggaggccacctctggagctccacacaatgccctcaattatgttaagtagtctgcaggtgaggggtcaggcagtgtccatgtggaaacagttgtgtcaccaccagctagttctttaatctctctgaccccagtttcctcctcatgggattattttgcaaactgtggaggtgatgccggcaaagccctcggtacagcgccagacgcatgctaagagctatattgtcactgcgattattattaagccagtgtatcacatggtgggaaagtctttattgaaccagaaaaaatggtcatggcttatgaagttaggattcaggttacaaaatttgtacagctctctgcgtgtaaatgtacgcgtgggtaaaagtccacagtggtggggtagtagttgtaatgtcttgtcaatatgtacattttttacttttctgtactcttcggattttacacagtgatcatacacgagttttgtaattacagaaatgttattagacaatgtaacggcagggctgtggttattgttcacacacacgagcacatgggactgcagaggttggggacggtcagatccaggagcgtgggggcactgaaggcccctggggtggggcgggctgtcacaggacgtgcacctggggcggctgcccaggagctgtgctgaccaggcctcccttctgccctagacgacaggatctgctcgccacccttcatggagctcacgagcctgtgcggggatgacaccatgcggctgctggagaagaacggcttgactttcccattcagtgcgtaccatcccagctccacctgagggcaggcgctgtagaccgcaggccagcataggggaggggctgggtttatagtgccctctggatttaagctcacccgaggatggatgagcacatggccctgggtcccacctccacccacaccatagaaacgggtcctggtaggggacacaggtcaacgtgctctcctgcctggcctgggggtgtctacccacacgtcaccctcagtgcagataccaggtgtccagagtctgtgtctcagctagagttcctttctagacgtgccaagtacctgccttgtgggtgaacggcctcactaatttctctctgcttttctctccccaacccatagtttgcaaaaccagagtggctcatggcaccaactctcacgaggtgagtggaagaagatctgactgttgtccctgacccccatcctttcagctcatcgtgtctcactgctaccctgccggattcctcactgccactgctcctgccctgctgttagtcctggctccttggtagatagcctccttcccttccctggactccagaggaatcgagcgggagtgctgtggcttcatgcactgtctgcaacctcacctcaatgcctgtcctgtccctaaggcaggaggatgtgctggggacccacctgtcctctgtggagcctgtcgtagctgtggcagccataacaaaccccaggcactgggtggcttcgccacatttattttctcacagccccggaggctaaaagtcccaggtcaaggtgccagcagggtcagtttctggtgagggctctcttcctaccttgcaaatggccaccttctcactgtgtcctcacacggcctcttgtgtgtgtgaatggggaggggcagaaagcaagagcaagctctctgatttcttctgataggggcactaatcccatcttgagggccctgccctcaagacctcccaaaggccccacctccagataccaccacagtggggcatgggcttcagcgtaggaattctggggcacacgttcagtccataggggagcttgtgcgagtcatgcctcagtccggcccgccctgcagggctggctatcctttgggccatcagtgtcatctcttcgagggcctgttttgtggcaggcaccgggctgggccca

SEQ ID NO: 77624 - DNA, 1102 bp, Homo sapiens
tatcttgttcctggtcttaggggaagtgtctagtctttcactggggagtctgggtttttctagaaggttgaagaagctcccttattttcctagtttgtggagtgttcttgccatgaaagggttttagattttttcaaatgctttttctgcatccattgagatgatcatgtggtttttgtcctctattgatatggtgtattgccttggttgattctgtgtgttgacactgctattgttatgaggtttgccacagagcagagtagcatgctgtcaggaaccccctgagccagggagctccatgggcactttttctgcgagggaggctgtagtcaacagcaggggcctgggagtcagatggtctgggtatgacctcctggctgtaccactggctcaccatggaactctatgcagggaaatgccacctctgtgccctagtttcctcatctgtaaaattctcaggggacaggagtgcttccttgtggggttcttatgagggtaaatgagttactgtgtaactacgttgaacagtttctggcatggaacacatgcagtgttttgagacattggctactggccactagtgacattatgtaaaagcttggatgggccagggtggggagggacagttgaggagggcattgaaatctgaaagccaagctgattcacctgctctaaaaactccggggggccacagggagtctggaagctcttccaggaggtggcctgtttgaccccagcagcctccaaatcttcctgtgggaggaggggccaagggtggagcccaggctggtgagcgcccgtccgaagcctgcctatggcagaaccctccagtttaaattcaggcctgagcaccatatcctttgggactgggttgcaggggcggtgtgtttgcagcgaggaggcttttgctcagactgcttcctcccttgacagccatggagggcctgccagccctcacagcattcccgccctgcctggggccttgtttggaaaatggctttcagctgagcaccagctcccctccctccccaccctgactttcctgacttcccctctcctgtgctgccaggtgagcctggctccttgtcctggctctgccgtt

SEQ ID NO: 77625 - DNA, 1059 bp, Homo sapiens
gtttattttgtggagtgtctctcaattcaggtttatctggtgttttcgtgactgggtcaaggtcatacattttcagcaggaacaccacccagcagtgccagtccctccctagtgcgtcatatcaggaggtgcatgaggacaacgatgtcttctgtctgctcagcagcagttatttggttaaagtccaccaggcttttccactctaaatttctattttttcctttgtagttggcaagaaccttctaagaggattctttgcagactgtctctcatatgtttgcccttctcttgtagcatccgtggatgggtgttgccattgttactgtggtatttaccgaacagtcatcatacagaattataagaactgtgtcccaaccaccccagttgccctagaagtgacaggatccccttgcagctttgcagacatccacagggcaccaggtggcaccttgtggagtgtcagcataatctcacgtgtgaacaaagggaaaggcaaaataaggaaaagagaaaagtgtcagatatgttggagaatcaggattacatgtttctttgctgcaggacttctcagagccttagtaatgtgttaatatgaatctttagtctgggggcagtgttgaatttcattaccgattgtaagatgcactgatacttcatattctataaaaaagaaaaaaatcctaagtaagttgtgaaatatcaattatgagacacatctcaatttcagagatggaaaatatgaaaaacatgccatagaatcagtgaagttctgcagaatttagccttttccatccagttaactatagagtcccctcctctctttgaggcttctcttgagagactgttgcactcaacacactcaggaattccctgactgggtgccttctggccgccctcacttccggccctgcacaggtctgttcttgagttccctgtattagtgtgtggggccctcattgctggtgcttctcgaatctgtttaactccagcctcacttccctgaggcagccactgttcatagtttggaacttatctttctagacccttcctattcataca

SEQ ID NO: 77626 - DNA, 1035 bp, Homo sapiens
gcaggctctttctcccatcagcagcccactctgccacccagggccagggtccagagatggaagccccaaagccaaggcatggctgtgctaccctagggtgagcgattctgggcacggctctagctggctcccaaactggctgagaaggcaccatgtatgagaaggcacctgggccgtaattgcatggcgtgggtttgtgtccctgtcttcagggacagcaggtctcagaccattgggcaacaggctggagagatccttgaaagccctgactgctttggggtgatgggtggctctcctgttcttcttctcttagaagttcccatgtgtctgctctgggggtgacagatggcctgtttgggatcccaggcctccctggggatggggggtgcataccgcagattgaatgcttctgcctgtggttttacgggaatttaattagggctcatcttagaggccatttgaaacctgggttgaaattgagtagtctggatacaaagcaaagagaaagtaacattccttagagcctggagaaataattccccaaaaagcttttgccttgggggtgggtgtttgtgattggtggggagctgctcccagaggcaggaactggctctcaaccctcggggagctgcagaggggtggggacttggagtcaaggcctcagaccctgcccattgccaccgccacccctccaaccctccgccaattgtgtggcctctctgagctgtgcgtctgtcagcgcttaggcaggtgcttagtgtgccaggcactgggttaaatactttacagacagtacctaatttaatccacttaatgaccctatgaggaaggttctgatttcatctccgatttagaggtgaggatactgaggggctttgatcttaagttacttgaggtcacagagctagtggggcagatttgggatcagaatccacacagtgtgggtctgctcttagccagtggttcccaagccctgtccctcacccctgtgtgtaccccttccacacccccagttcccctgtggctgatggagag

SEQ ID NO: 77627 - DNA, 1177 bp, Homo sapiens
tgggtgggccataaatgttgcacgctgggttttccttatcgtgcacgccgagcctgggcttgtattcttccaggagggcggtcagaggctgggacttcctggagccctttcctgacccccagtggctgtccattcaccagcatcgctgggtgggtccctgctgcatgcccccaccagctgcagaggcagagagccttcctgggaagcacaccctgggcccccctcctcaactgcctgctgttcctggaggcactcagccctttcaggcgtactgtaaatggccataattacccttgaagttccctcagataatcacagcaatccagtgacacgcttttgtgctgggagaaggagcttggtgagacttcctccggttgtcaccccccctgccccggttgtcaccccccctgccccggcagtaagactgctctgttttcagagactctggacagctgcagggaaaacagagctggtgggggacgggtgggtgcttcgggactgctaggatcctcattgatgagcagtgggagggagacgaccagagcccctgctttgcggtgggggtgggcagttgggacatggcacaaggggaggctctcccaggaatagcaggcagagcccttggataagggtctgtgctcaggtgggccgtctgtctccctgcagagcatcagccgtggagggcctctcccaccccagctctgcatccaggagacagatgaggcctgctgctgggagctcccagcatcgctgtctccgggcagcctgtgtgaggtcactgccttctcagttccacattcccagagctcattcttgtctcattcagagcctggaggggaagcagggtcatttctctgcctcggctctggcagcttcaaacccacccacttcgtatcaattagcattcaagttgctttaacagcagacctaaaatcatggtggcttaaatgcgacagaacttcctttctctctgatgtaaaagcccagaggaaggccatccagcacgggcacaggggctgggaccctggctccttctagctccttattcttctgtggtctgcccatctggtcctgggtgatggctgtatttccagccctcacatccaagatctagacattaggatggagaggaagatcaagaaaaaggaagcaaatgagaagaaggcctagttctctt

SEQ ID NO: 77628 - DNA, 4192 bp, Homo sapiens
gcgaggcctcccctaggttacgccggccaccactgaggccagaggaagtctttaaacattcagacagaaaggagcccagggccagatactctgccgcgaaatccaaggagaggctgatttcagagcagaagtgggaatatgagtctctggtttttgtgttaaaagtggcttttggcttaacaagtggtcactaggaccaaaataagttcacttaagaaaaataattccaaatggctctttctctctgtccataaggctcactaggaaggcagcactggggtgtgtttccccagcctgtgcaggcctcactgacgggctgtggagtgggtgagcagagggcaggggggctggctgggcggaggaatcacgctggcatgtctgctgcccccggctctcacaaccaagtatcacaaacagggaggcttttaacgctgcaggaatctcccagcccagggggccaacagctccagtcagggcgtcagcagtggctccctccggaggccctgagggcgaagcttccctgcccctctcccggctcccagtggtggtggtggtgggcaccttccaccctccttggcttgtaggtgtgtcactgcagttgtctgtctccacacggcctcctccctgcgtctgtgttcagatttctctcctaagaaatccagccaggggattcaggcccacccatatggtgtggtccacccatatggagtcctaactctgttccatccacaaagaccctgtttccttataaataaggccacgttcacaaatgctgaagggttaagacttgagaggacacaattcaacccgcagcagctggttgaggccttcttcaggccagctttttccctgagacccccacatcacaccagcattccagttttgtccttagaatcatggaggttgggagcaagggtgggctccttcgctatgtcagctcgggttggtctggcccacctgggtggcgtggggttctgcccattattttattgagttctgttctggacagcagtgtcttccccccatgtaagttagggttattcccctaagaagatagtaagttccttagagactggtttttgtcacggtttctcttgcatttccttcgtgcctaccccaaagctagtaggtacagaagtggagtacttgaggagtgttgggtggctggtgcccaccctgtggcgtgtttctctccaccacaccttcccgcagaccctctgatgactcctggcctcatcccactctcccgcccctgcctcagagtccttatcagtgcggggcatggggccgccactcccagaggagccagtgcctggagtggatctgcttccgggtgaggttttatctggagtcaggcggcctgccctgagcctggttgcagtttcctctctgtcttctgtgtggtgctctatttctgagtttggcctagtcaagcctctctctcagatctccaggtgactgctcgaaatgtcccagtgctggaatgcaccaccctccaccaaagctagggctggaggataggacaggaacggatggacgtgcagagggcgcgaggggtgagttgctacctggccctacccctgctctaaccagagcagcatgcttccctttcaggagtacatcgatgcccaccctgagaccatcgtcctggacccgctccctgccatcagaaccctgcttgaccgctccaagtcctatgagctcatccggaagattgaggcctacatggaaggtagggacacgtgtggcaccacatccgtggcaggcagccacctttgtggtcacaaagtggccacggcctgaggtgtggagacagaggggtcttgtctttttaagcactttggggcaggaagcatttgaattccatggtgcagtcattctggggaggtcctttcattctcctgtgaccagcagtgaggaaacaaaagcctcagggtgctcttgcggaagggggctctgagggttttgttttgctgtgttgaacccatgggtgacattgaagtgtcccggtaacacagtggctggagagcaggagtgtgtgtagacagctcagtggcaggcaagcaagtggagttacgtaactgcgcggaggacacaaacagaaactgaaggcctttaatcaaacacgtggagatgtaatgtggctgctggacctcatgggtccactctgttctggagggcaggggcctccctcttcactgcggcgcctcccctgccagctgcaggctcctgtccctgagggctcaccctgacgcctccccaccccttgggcaggcagagccagagaactcaaggccacattctcaaggtgtttatgtgagaaagactttgtggagagattcatgttaacagtaacctcctagttcactgcttagtccaagtgtgccctgctgagagctcttgtttaattttaaggaaaagtgcttggcctgggccctccggctttgtgaggatttatcctggggtcaaggaggcagcccctgctccctgccctacagaccatgattgaggcctaacctggctgccttgaaccctgacctggatggtgacttggccttgggcataatttcctgtgatggtgaccggtgggaccagtgggtaccatttggctcacagctccagaggcagaccatctgcatgggagtctgagaccaccatttattggctatgtgttgtgttcctgcctttgggttaggccttctccttgtattctcccttttggtactcttagaagtgggcatgataagccttcccattttacagatgaatcccagaggctctgagaggttagcagacatgccacgtcacgcagcattcaggtggctgggccagcatccagccaggtctgtctgactcaggctccccggcccctattcctgagcttgactttcatgtccatggccagagggccctggatctagaagaacctgaaatgggtaccactgaggaccctggcctggagagtaggtgagtcctcggttccctctctgaggaatgtgccctgcagaagagctggctgctggatttggctgtcctggaagggctcccgaggcctctttccctgaatgcctgacacaccgctgggtgcagagaatgggggtgtcatgctggtgccccatgtaggcaggctttcttagcacatgccagcagcctttatttgctaggcctggagtgattggcctctgctgtgcacttcatctccctttgcactgtcttcctggatccatccagaatcccagatgggaagaaagagctgtatgttccctcctggggtcaccttcatctcagtctgccatgggtgaaggtttggtaaaatttgggaaagggaatcagcctctttccagaaggtgtgcttgttggacactgcctgtgtgaagagcaggaggctgtattagaacatgagaaggcccagctagcagaagaaggtggcagaccagcagccacatctcatgtcccggacaagtccattcgaagagtgatgggtttgggtgggattcgaggaggtgccgctgaagggccttttggagccaaaagcacaggctctggcatgtgggttcctgtctgggctcttgttagccacgtggtctcggacaaatcagtcatttgagttctgctggtgttctggaagatatgggtgatacctggttcagccacggggtcaggggtcaggatacctgggatgatgtctgcagagcacttagcatgggaccggcccactgggtcacccgggaacagcagctgctccagctgttcccaccacgatggcaggaccccagcatcctaattgagtcttcacatccatcttagatttttaggagtagaagcccagggctggggatcaagggtgagcctgggctcagggtgggtgtgtgcacggtgtgttcaaggagcaggaacccggtgatgaggtggaccgtaggaagtcacatggtgagaggaaggcccaggaggtacctctgttgcccgctcgcctggcttggaattgggcctctcctggaggcagttaggaatcaggtcaggaattttaagcagggtgtgtcctagttcactgggagattagaaagtttaggagctacccataaggggagagctgtgggtgttccaggagagggccccgtcctcaacaggtccagggagagctgttgaccaaaccctaacgcatgcttggttctagatcagcaggaagtgtagg

SEQ ID NO: 77629 - DNA, 1051 bp, Homo sapiens
ctctgacagcattttccattagaaggagcaaatccctgtgtctcactccctgctcatttcctgcctgtgaggatcgaggaggaaagagtatctctgacgttcatctcattctgctcagattctcagtggcagcttagcaaagggccagttgtctctgttggcatcattccatgggcttggggcctctgaaaaccctgagagagcttgcgctgtaggtgggcaccgtgacgctctgccccaggtgtgttccagccctcatcctggcaggggctgaatgtttctgcctagagccaggctgcccttgttagctccaggatcccactcttggtgtcctttagctggcaggccctgcgagggaacatgtgcttacaatttgccatggagacggcgctgcccttcttcctctgagtggtgataaaatggtacggaagctcacccacccagcagattggtaattctaagagacttgtgaaaaatacacgaggccctcagtataataggtaagctggaaagcttggcacaaagtccgcttgtggatagtgaggtgactggaaaaattctttgccctctctgttcccatcccagaagagatcgtgtttaggaagaattcttctgttaatgctgatgctttcatccccagtcaaaagctagttgacgcctgcttgtcagatgttttcccctttggtttcatgtagccgctttccctcatgagtttggcttaacttcatgtcttaatgaatctgagttctctctttaaaggtcactgtcctaacgcataaacatggaatcagaatcgccctcatttattcagagctgagcggagacttttcttgggacttcgaggggaggaaggagcacatctgtgttctaagtggcctcggttgctgagggagaattgggtcatcccatccacgtgctcggctgttggcccccttttggaaggaaggcagcgaatgcgtgggtggccctcccgttacctggaatgcctctagctggtggtccatcccgttctagaatggctcccctgtgcagccttcaagtttacctttac

SEQ ID NO: 77630 - DNA, 1631 bp, Homo sapiens
ccctggctcctgcgtttgaatgtctctgggcctgggaggcatctggctccgttcaggggcctaacagctctgtttttggtttgttcgtcacatcacagaatcaaataatctagaacttaagaggcagaaaggatgttataaatgaattattctagcccacacatcttacagatgggaaactgagatacagataacttaagtgactttcagaaacacacataaagtgaatggcagttctaggacttgtaacccaagtttcttgactctgcatttgtttcaacttgcacagtgccccaggacccacgcgctcgggttaagttagccaggtgtagctgggctgcaaaagattatctgacagtgatgggcaggcagaagccttggctgactgtcaggactgttacataggttgcacgctgcccagcccagtggtaggctttgtgaatggcaccctgggtagctaggcttggtggtcctgtcccagcgtacagtggatgctgctgcaacctccttttggctcttgagagcccacctccaaggtttacctgcatgcatctccaactccaaccctatgccagcctggccacctggcacattctgttgcacctaggcctagtgtggatttcccaggactatctgtggcatgtggttttctgtaagctgtaatcaacaggcaggtgttctgggaggtgccaggaagacttcttctgggggatgttcggctggccttggttgatgacaagttaatcaacaggggttggtttcacggttgcagtggtctgccaagagggttcattacttgtccttcccagaaagcattgcttggcctggccccaccccctccccatgtgacctgacctcccagggagaggctttgctttctgcagaaccacactttctgccttcgaaagtacaactgctcttgacactgttatgtctgttagtcctccccctgcaggggccactccattcagcagctgccttgggagccctcctgtgcataagtgcagtgctggccctgacacgctcttccccctgcgccacgcggaccctcctcacagaggccctgtggactgtggccttcagttatgtcatgtatttactgtcctaaggggtgtgtgtcttcatttgctttcatctgtcttgctccagggctgggaagagatgcagagcctctggtccagctgtggctttgagagaacaaacaaccagtgaggaccatgggttgggaggaacagtggaaagggagctgcagtctcagctctgccactctcccttgcgaccttggcctcgctaccactgcctttcccctttccaaaaagatgggggctggatgaagggtccatctgggttttgctagttctgaccatctttgcctttccctctgggaaaggaaatcgcaaactggatctactattttttttcttggatgctctacctcatgcagaccccaaatggaacacacccggcctccctggactgtcaggctggtggcctcgccttggggtagtgaacatgagaaaggcttccctttttcctgaaatgccccagagcaaccctggccctagttagagttgagatgcttttcatttcgccaggccttccatgccttgggtctttgactggagggctct

SEQ ID NO: 77631 - DNA, 1514 bp, Homo sapiens
ggttgttgttggcgtctgctccagggaagcttccccagcccttcccagggctccagcgtttcccctaccccttgttgggcctgggacaccgagtttgaccagcttgcacatggactgtgagtctgatggatcctaagtgtggcttgccctgcgcaccactgctcggctctcagcagtcctgaacgagctggcacatgcatttggaacaagtttgtgaacagagtccctctgctgctcagccagccgcttcccatcttggggggcagccatcagttccagtggcctggagcctttccagggggttctgtgggactgaacagagacagtcttcctcgctgcacagcccctgtacaatggggctgtacggtatgccctggaagtgatctcatcttagtcttttgcaggcagcctcattctaactgctgcatgttaaacggcctccctgtcctttttaccaagccagctctctactggtgtatacctagggcatttctgatcatgttttagaaacatgctgtagtgaatagcctagtacatgtatttttgggtgcacaggtgaggaattctgtaggataaacacctaggaatcgggatgctgagtttgcgcattctgcattttggctgttgtccggtttctctctgcagaagcagtaccagttacactgccaccaaccaaggactggtccctttccaccaccttaggaagcgtctctaatcagtttaccttggcatggagtcacagagtgttggagggtgccaggatcctggcagtctcctcctcttgcctgttggttttgctgctgggagctccaggccctgggaagggtggtgtcatgctgcctcacttggcttgcccggaccctgaatctgggccatcttgcccctgtctggtgctgtgttctcaaacttcacttttctcttccgcactccatgtctgaccaccccagcctgagctcatgggtttaaatattggctcacaggagctgatagacctagaggcagattgcatcagagttttctttttgccagctctaccaaatcacagagatcactgtataaaagatgaaggcagcccatcagttcttcctgaacagtgaggtccagcacacatacccctaaggccagcaccacatctgacacaccaccaagaccgcatccatccccagctccatcctgtggccttgcaggctgctggactggtcactccataacccatagctgtccttgtcacttcccagctcaggaccctgttgctttagggtcaagtccaaactcctcagctggtccgtctcctgctctctaccttgtcctcacttttcatgttgagactgccgtccgccccagccctgccaggcccccagcaggcccgtgaatgtgctggactccctcaccccagacctctgcttttgctgtcccctctgcttggagtaccctttctcccctggcccatgcctgtggccctttgtggttgacatcaccaacctcagcaggctcctccccagcccccaaccctg

SEQ ID NO: 77632 - DNA, 1407 bp, Homo sapiens
gctgcagcccctctgcttgtgtgtggacggtcagggtttttcagctcaaggtctgggggcatgttgagttttagaaatatcaatgtttatcaataatacattttccccaaagttttagaaataacttttatgcacattatttctgggtttcttaacctcaacatgattgacatcttgggctggataattctgcactgctaggggctatcccaggcaatacagggtgcttagttgccttcccggctgctcattaccagatgccaacagcactccccaccctgcccctcatgacaaccaaaaatgtctccagatgttccctggtggagggagcccatgccacccctggtcgagcgtcactgcattttgtaagagatgggtccagcagctctgagagctcaggtgggccagtcaagttgtttctgatttttgtgtggacactgaggccccactgggtgcagtttctgggttttagtgtttggaatcacacaccaagaggactaacatcttgtcacttcttttcttcagtaatattagtacctgcggcagaaaggacaccctgttttctgtttcctcctggtttgtgtgagtggcatgacttcccaacgtgtttctgtgctgcctgtgcaggctgtgtgcccgtgataaagcccactgtgtctgcctttgtcttcatgtaataaatcccattgccacctcaccagccaagagcacagccggccgggtaaaccacgcgctgggcctctgctgacctcggccctctgggatggacagagtgaggcatgaggatatcctctgagcccctccctataggtccctgccccaggcctcccacgcctcctggcagccagccctggatctggccctggcccctacccgtttgtctctccactgatctgtgagatcattcatcagtaactattatgttcattcagcaagtcttagtgagaacttactgtctgccagagttctcctaaaagacattacagatgcaacaatgaataagacctggtggacgcagcccctgccctgctggagctgtatctgagtgtgagtgcatcggatgatgggaacaaaacataggtaaatagaggacaaggtaacacagccccagtgatggcgagtactaggaagaaacacaccgaggcctgggagaacagggaggtccttgttactgatcctctgaagagctgacattgagttgaggcctaaagggcaggacactcaggaggggagcaggcaagggagcagcacctgaccaggcccttcagtgaaacaggatggaggcataaggacccgcagtagctgggtgcagctggagcacggtggatagggctgtctgcagtgggctggcaggagccaggctgagcctgggcctggtggcctcctgggagcgctgggtagctcttt

SEQ ID NO: 77633 - DNA, 1051 bp, Homo sapiens
ctgattaatgacacatctctcgtcccaggccctgccaactttgcacttttccttcatgcccttcggaagttcgtaattctttatcagtggctattgtctgtcccttcactgcggcagggattgtgtctgctcccagcagctggtgttcccattgccgcctgcagtgcctaagtgtttgggtggcggcgcatgcccagtgctggtcatgcgctggggcggcctttcatggggtgccctgatggccttgcggagggaggacgtggctctgctgggctgcttggagcggggagggaggaggccaggagcgttaatgaggcagatggcgctgcctgatgggcatgtgcggcgatgtctccaggtgtcagcgaggttggagagggagcagcaaggccggagcttgagggctttttcatgccaggctgtgcagcttggactctatcctgcagggagggtggggcggggatggcggtgatatgatcagatataattggcaagagagaggccctgcttggaaggggagattgccagtgcaagatgaactctgagcagctgaggacactgtttactctttggagcccaggtgcgtccaagttgaagaaggagctcatggccccaggctcagtgttgtgcccatcctcagccccaggtgcccctgcatgtggtcctgagcatcccctccctccgctgccatgaaggctggcctctgagcagcttgagccttgcccagcctacacaggacaaagttgcactcacctcctggctcctctcagtgtgtaatcatctaaagtggatctgggaaggaagctcctgccccgaaggatgccggaagagaatgcacacttggccacactggttcttctcatgttgtccctggaaggaaaccatgtgtagccttcagtagtgcctccccgaccccaccatcctcctgaggggacaggaagtgagtagggctgggagctggtgggagggggtgatgtttggggccctccctgctagtccgccaagcgaggccaggcttcgccacagggatagacagctcccctcacccagc

SEQ ID NO: 77634 - DNA, 1216 bp, Homo sapiens
cctttggagaaaagggtgcggggctgcactttccagaggccccaggagagaggaggcaggcagggttggcacagagaatgactgagaggcactgggatgggggctggggaagaggcttccttctaccaccggtcactgggctgtcagcattgatcgtccccttccctctgccataagatgcaagttcagagccagaccacatagacccagggaggcggacacttgacctcagtcgtgccctttgttttcagatttttgttttaaattttattctctagacattaacaaggaggcatgagtgtggtttgaggactgggagggatagggatgctataggcagaggcaggggaagcagcacccagagctggggtcctcccattttgttgtgagcagggaaaccgaggcaagatgctttgccccagcagggactcagcttgaagggccttctccacagtccatactcaggtcctgggagggaggaggaagtggtttggggctgtgtgggtggagaaaaatgaatttctgagatgttcctcagggccccagagcactgcactgggctgcctctgtgaaagttccggtccccagggagggaagaaattcccagagccaggaggccgtgcctgcttctggctgccctggtgggcaggtggaggctgtgggccagaggcttactgcagaacattaaagctgcttgtcacagaaccttcatcactgccccagagttttggattttttttgtttttgtttgtttgttttttgtgtgtttttgattggcttctaaatggcttggcttggagactcaattgggatgattcagttgtttttctgctccaaggttcatgtggagccagcagcctgttgcccctgaggctctgcctgaggtttggttctcagtgtgcagaaccaggcaggggcccccagggcctgcccacgtgggcaagtggggccggcatgccgagagggtccctgcctcaggctcggggacactaggggcctcctggcctggtgagtggctttcccaggggggcaacacgagccttctcctcgctgtggcgcccagagccacctgacaggtgtgggtgcagggtgggaagggaggggcccaccgtcctcttctgctgccccttctagccctggaattgcccctgaaggggtgctgtgattgtgatccatgggccatgtggggctgcctcgggggaccttcctggggttc

SEQ ID NO: 77635 - DNA, 1655 bp, Homo sapiens
tgtgcaaccctttcccctggctcaggtaggcacaagggatggaacccttctgctgcacttggtaaaggggacccccgagggcctttgaactgagtcctgccttggtggagaaccctgcctctgcccattactttgacctgggtactcacctttgagcatggcctgaggtatcttgctgagtcccttggctgcttccctctccccacaccacttccccagcggcctcccaggtcctgatcgcacagtgacctgcccactgccctggggttctcatgctggctactgacttgtcctgtgttctctctgttgtggacaagaacgtgattctgtcctctagaaagcggctcagaggtcatgaaaaacaaagttgtattgtcagtgaaagtgcagtcaagatggtagctgttttcaggtgtgcctagtgggatggggatgcctgagatggggtttctagcgtgtgacaggcgcagatttggtgccctgcttttcttcaccaggacaaagggaatcttacccgcctcctagtcacccggtgctgccgtcctgccgacactgttctctccccgtgtgttcggggtcagccgccttggccccccttgcttccttggggctctcaccccgttccttggccaactccctgctgcacattcctgcttcccaccaggaagtggccccggacacagaggcagcctgctcctggcatcccctgcttgggggcagggcatgtcccacgttgtgccctccagggcgtctgccctgccagtggccccaagtccattccacttgctgaacactgtctccttgatcggactggagactgtgggaaaaacatggtcgggctcctctgtgacctcgtggagcctcagtttccttatttgtaaaatgggtgctaggaataagaaaagctcagaccatgttgggaggagtgtgctggggttcgaggggaacaagacagaggagatgtgtgccctggtgatgtgctgcttcctgagtccctgccctgtgccagggctgggctgatcagcactcacccatgtgctacatttgatccccacagccctcagtgcagactcaccagccttgttgataagcaggaagtggaggcgtggaagcatgtgcagcttgtccacagggacccagcagagccgggggtcagtcttgactttctcaggtgagccgctgctcatcctgagggcttgctcttctgttcctctctgcctccaacctacacaactgtcctggggtgtggtcccagctgatcccaagtcatacagcgactttcctctcccctgagccatttgctcctgcctcacccccgtctccttcggaaggcccctgagtgcccagttcatgtgcctgtggtgcccttggggcttattctctggaggagcacagccatgcctgggctgccacgcagacctttggggcagggatggtgcatctcttgctgagtccatctgggggacgatggccttccagatgcctgattaccgttacctcagaaagcactgcagagcagttaccgcttaccaagccctgctcgaaagcgcttcatggcggttgacccacttgctcccatgagctgtaaggttcaatgattcccgtcctgtggaggaagaagcagctgcaggacaactagaaagtggtccaggtgg

SEQ ID NO: 77636 - DNA, 1998 bp, Homo sapiens
atggccttgcttggtcattttccttcctgggccgttggtgtcctggtctttgcagcagggagcgtcttccccggcccctgggcttgccgtgaggatgagccggcgccaagtctcaggagatattgggaagtgtctttcccttccccttcctcacccaagagccccagagatgggcagcttctcagctagcctggttttggttttattttatgttgttttgtacacaggcctgtcaccatggggagggaacagcattccttagtagtttcttattgtgaggtctaaaggatattttttttttctatataggggaaatcccttaacatctttcctggcaaacagtaagaaagaggagttaaagacaccagcagacaagagctgctgcgttccgggggtgcaacggagaggagtttagtaagggaccatcacagggtgtgggcaggcccgagagccagcacaggacaaagttccccggtgctaacaagccctgagagctgtcaccacccctaggcctgaggggactaggggaccaaaaatgtacctggagccataggggaggcggtagtgttgagagaggggctgccctgctccatgggggctgtgactgctgccagaaatatggcagggggtgggggcgtgaggatgctgcaaatacattccctccctctctccttcttgcccatcttctgctgtgcctccagttggcccgacttggccagaggacaaggcagccaggtgattgtggcctgagaggacagctgcctagggcacagagcaggcgtggggagcggggttgcaggggcaggcagcggggaatggagtgagaagcgcagccttagatctgagtttgtgtccccacttcaccgccttcctgctgtgagaccctaggcaggttttaaaagtctccgtcctccacttttctcattcgtaaaatcacttctcatagtggttgttaaatacaatgaaagaaatgcacgcaagctttgagcgtggtgcccactgccagtgaccatttgtagttgtcattatgatgtctttcgtaacatttttaaaacagtcagccttgaatcctggagggaaacccacttgggggtggggatgagagcaggggtggggcttgtggccttctctggcctctgctaaggccagattgggggtcagccaggtgccgggctggcgccgctgcctccgaggcactggccttgcaggtggtggtggccgcgtgccgggagggagacatgtggcgggtcaggaagcgggggtcaggctgccctggcttttggcaggtgctcctgtcttggggtcaggtgacgctgactgttggccagaggctctggctctcttggggcctgatcttcccaacctcaggcacttgcaaaaataaacaccttccctggcatagcaggagagcagtatggaacagattgcaggcagccctacgcgccttcgcttctcccgatgagcccagatttcagtgtgaagtgcaagtggctggtcgctcaaagcggcaatttctagattcctgaggaccacagctttgctaaggctttttatagattagcagaagcagtatccacttagatctaagttctgatctggctgtgcgatgttagtcatttacataaccccttggaaccctagttttcctagggcagatggggtgtgttgagaaaagcctttctctgtaaagccatttctcagcatcacttgcctggcctgttgacactattgccctgattcctcttatgtgtcttctgcatcctgggtagcatggggcttggggaacagaagttacaaacgtggggtgtgcccttgaggagttagcaggagagaagagttgtggggtcttggagggtttgtcctgcttgtcctgtctgtattttccatgtcagccctcctcctgccccatctccagagtgctacagggaggctcgagggtcctctggtgatatgccccagggtggacaagaggatgggggcagtggactcaggtgctga

SEQ ID NO: 77637 - DNA, 1083 bp, Homo sapiens
ttgaacttttgctctgggactcataacaatcctgtgaggtgcagggaagggtgagtagcatcctcattttatgactggggaaactgaggtaccacacagctcagtgacctgctcttgttcagaagcagtggattggagatgggtttctaggcctgtctgcctggcccacccctccccagttccagatcctgggagagacagggatagtgtcagggcctagctcagcttggttaccaggctgggtacgattgggttaatcattttggaagtcaaagaggactctggggccactggggtttgcaggcctttgtgccgtctcccagccctgcccccacctctagtaagtctctgccttcgtccctgagggaaacagtggccccttgttttctctgagttctgaactccaagcgccacacagagcaggatccagcatgggccctgcgagatggcatgacttggaaacggagtgcccacagacctcaggccccggcgggcagcctttcattgagacacccttgctcctgctgggagggacaaaccagaccccgtcctctgaggagaacaagaagtccctgggaatgttcttttttctgggggcagagtgtggtcagaaaagcagaatgacaaccttgaaatgagttcctgtccccatcgcatctgggagacctgcctctgtggtgtccttccccccgggcatccccctgcacagtgtccttttctccgtggcctccccagtctcaggagctgggccctttctcctgtgggggccgcacccaagggcccatctcttttctagctagtggagggagaccgcagcctgtttgcagtgtgttcaggggacagaccccttcagggcagttgtggcatgtcaggcacctgaggaagagccactagagctgccagcagccctgctggtacccagcacagacgccacagcgagaggcggccgcacccgagagcagcccaggcctgatgtgtgtcccaagctgctgttctcacagaagggttttactggcatgaaaatgcttggaaaatacacaaaggagggtggcccgtttccagagctcagctgtttaccttcag

SEQ ID NO: 77638 - DNA, 1692 bp, Homo sapiens
gctgtgcttgtgggtgcttccctgcctctggccccctcagattgtatctcggaccacatgatagctccccccagcctcaatccctgcacatcaggaaaggacgtctagccagctgtgttgtcggcccactccccttcctgatgaaggcagaaggctcaggagcctgtgtcccggagccacagggacctgggggtgttgggggagatttgctggttatacagcctcagttcggttgttttgcctcttgacttccttgcttcatgtgtaaaatggtgacagtggcctctgcctcctaaggacatggagattatgtgctaaggagattaggtctgtcatttgctcactgcagcacctggaatataagggtcccggtagttctggtggaggtgattatcagaatcatgctggtggaaagccaaagaaggccagaaaggcctccgctgaggccagagaacatccagcctcatgtgaggaagaaagtcctatttgctgacacctgtacagcatggtcagctctagtcacagagggaggtaatcgatggctggccctggctgtgtgctcatcgcgactataggaaggatatttctttaccctcactccacaggcgaggaagcaggcttggggaggggagggatgtgcccttccccaggctgcacagctggaggctcagcccctgccctctaacccctgggcatccttctgcctggggagggagcacctctgtgcttgaggtggcttgggaagaagagcactggccagccatggaggagtgctgtgggcaagaggattccgcgagttccttcctccaggcctggcaacaggaggttcatgtgtgggatcctctccgctctccccgcaacacacacagggcggtcaggctttgttacgtggcttctgactccccaccttgtggatccagacctgccagcccttttatgctccctttttttctttttctgctagcctgtgattcgtactttccccccaggacaggactagattggtgcctggcaacagaggggaggggttagctcctatcagctctgactctggcctctcaggtgccactgtgaacaataacacagatgaagcagccccttggccaagatgcacgggatcgagggactcatctggcaggttgaggggactgctaggggtgagctttcctaggatgctggggaatagccacgtcgtgatgtggctctatcaaggctcctgccttttgctcctaagggctctgacaagttatcttccccttacaggataaatccccattcctctctcatccaaatactaataaactacaatgtgaaaaaaatcatagctaaatcctgttctcaaccttgcagttacctgtcggggcctgtttgccttaatctgcttttctccccttccctttcccttcccttccatccttcctttgtttcaacaaatgaaaaagaaaagcttggggtagggggaccagctattttatgaggacagatttggttgtgctgtattaaccaacagcctcagaatcttagctgaaaaccgtgggttattccgcactcatgccacatgtccacagggccagctgggggctctgtccatcttattcactcagagatctaaaactgagcagccccatctggaaggttgctggtcctgcaccagaggggagagagggctctggagaccttactcctgcagtt

SEQ ID NO: 77639 - DNA, 2812 bp, Homo sapiens
ctctgaggacactgactccaatcgtgcccccacctctttgtcccccgtcccctgcacccacgctggcctcctctgctcgggacccctgcacttgccttcttcttagttcagaacattcttccccaggtctctcctgggccttcttcttgcccaggccttccttagagaggccttggattcatttgccagtgctgctgtcacaaagggccacaaactgggcagcttaaatagcagaaatgcacccctcccagttccggaggtgagaagtctgagatcccaagtggggctccttccgaggcagcggggcctgttccagccatctctccctgctgggggtggattgccagccatctttggcgttcccgggaatgtagaagtaccgccctcatctctgccttcatctcctcacgatgttcctcctttgtgcgggtctgtgtctaaatttcccctttttataggagcaccagtcatcgtggactagggacctacctgctctggaatgacctcatcttaacaaaggtcatctgcaaagaccccatttcctaaccaggtcacgttctgaggtactaggggttaggacttcaacataccgttttttggggacacagtttagcctgtaccaggccttctctgacgagtgcccccctttcctatcatgccctctgcacttcattgatgttgcagccctcggtggtgcctccagtcgcttcctttgcttgtttgttgtctgtctcccacactaggctgtgagtatgagcactgaggacagggacctggcggtcatcttcacgttgcatcttcagagcttgagcaatgctaggcacaaacttactctgttcacttaattactcaatgaatgagtgcatgaatgaatgaatgaatgaatgaaagaaagaaaagaaaacaagtcctgttgtctttcccatgcatcactcacacaaactgaggctttgagaaaaccagaggagagtaaagaacaggcttttgtgtgtgattcatgaagcagtaacggtttctcttttatttacattttggataaagggcagaagcaagaagggtggctgtgactgcattcttgatgttttcagcatttgtcaagtgggacgtgtcacctcattttatttttgcacattccccagtcagctctactgagtgtaaatgcggggtgccgctctcacaccctcagttcccatgttggcagttggaagggagtgcagcctgcattgcgcgctaacttcgtgcttgccatctgggagggaagttgggatccaggtggtgcagtcctggatctgaaatcctctgtgggaagtgcagagagacagggtagctgggtttctggaagggggtagcagcctttgaattcatctggctgagagctcagatagaaatccatccctcgccacagctttgggacagtcagatgtggtgcaccgaagacaatctgctggggactgtcagtggcttcctttgttacccttgccttgtccactctcttgggcctgggagggtcagtgtctgtgactgtttgatccttactatgcttggctgtagaggaaggggcctgcaagatgctcatggcctgcttgggaggacaagagtcatgcccaggaagccgtgccagtgaccaagggtggtggctcatctcctgccttgtgtgcttgttgtcagagctgtggcatcttcagccctcaaagattgtggcctgccggcttggctaaaagcacagctgcctggagcctctgtgccttttgggcttcctggggcccatgtctcctctctgcaaggtgcaccctggggctgaagctcgggtggctcgggtgtccttgcctgctctgttgcccagagacggctttatttttcttaccctgctaggcccagggcatgtgtggcttattcctggggctgcttgggacatcgtggaattctttaacctgaagattctcacctctcccaccataccctccagagtccaacacagacacaactaagctcagggtccccaagggtccagaccccaggtggaggtgaggggcgggcagtgtgaggtgttggctctagggaagggagtggtaagaaaacatgggcctgccgcttactctcagtgaccttccacgagttccctcatctcatcatgtccttttttcggagcaaagcagggataacatgtccttggagggtggttatggaaatgcccaatgcccaatatatactgtatggataggtgaatggcatgaatccctccagctttggggaatcaattcagtccatgttggctggtttctagaacaactgggcatgatgccaggccacacaggggccacggggaggaataggacatagtccctgtcctcagggagggggcacaggctaaggagaactctctgcaactcatcagccacgtaagctcagtcagcttgagcgtctctgttctccctgagtaggcaccactgcgaggaggcagtgaagtgttctcaatgggagggaggagccacagccccatcatcgtgcctgggacgctgaggcttagaaatgccgaagctgaacctgaaggcggttactgtttggcgttagaggtgggagatccaatgggaactgtgattgctgaggttccggagggtctgagagctgacatccgcttggggaggtgcctgcagggggcctgctctgggccaggcttggtgctaaggcttcaccaacactgtctcgtggaatgctgatggcagctgtcatcggctgtattgtaccagtgaggaaacagtgtctcaagggggttgaagatcactgactgaaggcccaggtctgcccacagctg

SEQ ID NO: 77640 - DNA, 1021 bp, Homo sapiens
agcccagtgggggccagctgtggtggagcccgcctccccattctattcttggagaggaaaagcacagaaatacaggagtgaaggcacagactgggcagaggggccggagtcgccctctgaggaggcctgtagggcccccagaagagttttctgggtcagaatcaagagactcaggagcctttttgcattttgtgagcccagtcactttgcctctggtcagggtaggttttccagagcatcttcctgctccgacagggggtgggggagtgttgggggtgggtggtttgccatgggaacccccggctgctgcaggtgctgtgtggctgaagccacctcccagttcagtgtgctgggggcaggatgtgggggagggcacctgggaggaaggtgtcggggcagggcttaccagggacccatggggaagtattagacggcttttggggctacactttggatagggagctgggggctcccagcatcagagcccactctttctcccccattcctgagtttggaaaaaggctgccagctggtgcctcacccctgcccctcaccagaagaggtcctgtgcttgccccctgccccatcctcagtccccagtcccacagctgctgtgcagtcctgcttctctttctgtctcctcccctgcatcattcctgccctagctctagacctctccacctagctacccctgtgctgcccgagagccctcctgtgccccaccacacacccacatgcacaggcacgcacattcacacactccgttctcttccaggagaaaccctccctggttcctgaggccctggggaccagtgggtgtgtgtctgtctctctctagcgcctctttctcctctctgcctttccttagacacgtacctcttacctcctgtctggcctggcttcctccatgaagtgctgtttggttttctcagcaggagcctcccagccccaaggctcccactgttcctctaccagtcctgtcctggggccctcactcctgggtggtcactgttgactgatt

SEQ ID NO: 77641 - DNA, 1041 bp, Homo sapiens
catgtccaggaaatgccattttccactggatgcattttttagatagttgcttggcacttatgtctttgtcttcagaagaatggttttccggttttaaacacatatctggctgggtgcggtggctcacgcctgtaatcccagcactttgggaggccgaaacgggtggatcacttgaggtcaggagttccagaccagcctggccaacatggtgaaacccatctctactaaaaatacaaaaattagccgggtgtggtggcacatgcctgtaatcccagctacatgggaggctgaggcaggagaatcgcttgaacccaggaggtggaggttgcagtgagccgagattgcaccattgcactccagcctgggcgacaaagtgagactctgtctcaaaaaacaaacaaacaaacaaaaacccacatatatcccacttttctttcccttccaaaagagagtatatggatataatttaatcatttttcctgtgttatgtataattgtacaattagaaacaaccaaacattaaaaggtagggaattgattaaataaattatgcttgatttaccttttaatgataatgctttagaagaatatgcaatgttggctggacgtggtggctcacacctataatcccagtactttgggaggctgaggtgggcagatcacgtgaggtcaggagtttgagaccagcctggctgacacggcaaaaccacgtctctacaaaaaatacaaaagttagctgggtgtgattgctcacacctgtagtcccagctacttgggaggctgaacctgggaggcagaggttgcagtgagctgagactgtgccattgcactctagcctgggcaacagagcaaggctccatctcaaaaaaaaaaaaagaatatgtcatgtcacaggaatatattccttatagtttgttaattaaaaagtaggatccagatgtttgtgtagtataatttcagttttagcaaagataaatattaaaaacttggaggagtacgttatgtaatacaaatgttacaggctatctctgagattaagtt

SEQ ID NO: 77642 - DNA, 2709 bp, Homo sapiens
tgtccgaggcccttctccctttctttgcccaccagtttctccctctgagcgctgcagccaccccacaagccccagtgccctgtcaggcccatcaggacatgcaggtggggcactggcctgagttttggatctttgcttcaaagccgtgttaagtccagctctgccttgtcccagttcccagccctgtcgctgttaggggtatccgatcagcaccctcaaaactagagagatcgcagcctcaaacaaatccttttggcaaatggctgcatgttaggagggttttggtgacccaaacatgtgccaggcatgttccaaaacccccagcatcaaggcccactcagggattagggtcgaagctgcttggctggggagagagggactgtttttgttcttagccactttctgttcacatatggctatcattcactgaatgaacgtttactagaacagcagggtggcggagtagagaaaacgtgtttccagtttgctgtacctgtgtcagaatcttggatttgttactgtgagattcagggcacttgagtcatttgttctctagaaggttaatttcctcaacttataaaataacttgatttgtacctcctgcagtgggtgttgtgaggactgggtgagaggaagtctgtgaggacccagcatgacacctgcacatggcagctgtgtggtaggcggtcactgctgttgtcatttagtaggtggcccttaggattagacaccgcgggggacacaggctgggtgagatagggtccttgctaccaggaacatatggttaacagggggctgcaggatagatttgctgtgttttgggagttcctagcatctgaaccccctctgagtttacatctgaggattctcttccatatgtatcttggaggccagacaggaaaggccaggaactcttgtcacctgtagtgctgggtgcgagcacaggactggggcctgccagccagacccaccccctggtgctgggattcaggaagcaggacagggagcattcgtcatggtggctcagtggcagaggcaggtgccagatgggatgctgagccctgtgtgcccgggtgtgggctgggcaggggccttgcctgcctgcctgcctgccacagggcctactttcactgtgcttctctgggtgaacagcctccctggcagaggcccggtttctgagcgtggctctcccagcttcctgtgttttctgacctgcacagtggccttttagtgaggtcccttgctgctcaggtcagccccaggaaggttctggtgctcacatcccagaacctgctggtctctgggcctcagagtaactcatactgagaggagggaaggatgcccaggcaatactgtgcagagacagggttgccacttctggccgcagggaggagtcagagaagacttcttggaggagggggcatttgaaaggtactttgtaggacagagggcctggagggaggttcagatcctggccgggcagtggaagcctggcccttgccttatagcctctttgaaatgtaaatgatgctagtgcctgtgggatagggcctttgtgaggagtaaatggttgaggacagcgcctggctaatcactgatcaaaatagccccctcctgacaggggattaggttcatggctgtcgtatatacgagaccaaccatctccccccacactctgtattgatggggagtggtagagttacacttctgctctgagctcagtgcatagacatcctatcttgttgaatgtgcacgacacctcgagatgtaggcaggatccttccttttttacaggggagaagacggggccttggtgaggtgaagtagttcccagggccttccatccaggtgatggagccaggaccttgcttctagttctcctgcctcccaagcttggctgtttcctacagctgcatacggccccacccagagggaggcagtcaccagagaaagagaatggcagtgacccagagggggcacagagctacttcctgctcagggagtgctgggcagcctcctgcgggggggagaggggggcattgaatgggcccttcagagaaggctgggagctcaccaggtcctgaggaagaggagggactgcgtgcaggaagcctcaaggcacgagccagcttagcatttgggggaactccaagtatttggtgtatacagtgtctgcagggtgcctgggcaggggtgttgggccaagcggtgtggcaggggaccatgtgtgctctggccaggggccttgacctcattctgttggtggtgagggcctctgcaggtggggagtggcaaagtggaccaagaccgcctctcctccactatctcccctccctacccctgctctgtccttataccccaggccacagtgaaggacattgggccgaggccctgctttcataggaggaagcaaagctctgcttcatgtagctgaagcccaggctccccattgtccaccctgacacagaccctctgagtcctcagttttctggtctgtaagtggctatgaagtctgtcttgcttctcctcccagagaaatcatgagcataaagagcctgccagacgtgtggatatgcggttttaaagattaaggcagtttaaccaaaaagaacaaaacattggctgaattaatagaagtggcactgggcgttcttcccgtcagcctgagttggaggtggggtgcctcccagcaggggctggcaggagcac

SEQ ID NO: 77643 - DNA, 4863 bp, Homo sapiens
taagcaatccacccaccttggcctcccaaagtgctgggattacaggcgtgagccaccgcgcccagctgggaaagagtgtttcttctctttcaaagggttggctatttcgccctggccccttcttccccgcttccagatattttgtgggagtatcaggagctttggcagctgtcttgtgagcgtgaggcgacaggcacgtggacaaaggtctaccatggcgagcatggcagaatagaaacttgaaaggagtatgggttcttgctgatgtcaacctgttgaaacaccctggagactccactccctcctaacgttccgtccttatgattaaagccatttttagtcaccacttaaaaccagacacatcttcactcatgattctgagcttgttggaattgttttttgttatacgaaaaccaaatgcacccttgacgtaaagactggccatcattgaaacaaagctttgaaggccgaaggcgcttgccaaagagaaggatgccagtgctttgagtgttactaccatcgatgtcagaaatgtaggtgcccaaaaggatgaccgttgggcaccctgttcatttggacatgttatgtcagaaaacaaatcataccatgttcaccatgttatgagaaaatgtaaagcctcttcaggttgtaagtagcagctgtcaatatgaaagaaaaatcttaaggaaatgtcaataaatagaatttattggcctgaatgtctcagaaggtccagagataggtctggcaggtttcaggccattaagaactcacatgtattgtcatcagaaatatttcttcacttttcatgctccttgtgaaagtcattttgggtgggcttgtgccaagtcatgtgaaactggttgcctgcagcttcatccccttggcttaacagccctgcaggaagcagatgtcgggctggctggtgctggctggctctggttggcctggcttgggtcacatacatatcatatttgcctgctaggaatgccataacaggtcactgcaaactgcgtggcttaggagaacagaaattcactctcagttctggaggctaggagttggactcaggatgtcagcagggcactgctccgtctgaagccccgaagggaggagccttccttgcctctgccagcttctcatagtcccaggcacgccttggcttgtgggagcatcgctgtagtctctgcctccatccccacttggccgtcctgcctgggtgtctgtgtcttcacctggctttctccttttcctataaggacactagtcatattgaatcagggccaaccctgatgacctcatcttaatttgattatatctgcaaagaccctgttttcaagtaagatcatgttcataggtaccagaggttaggacttcagcttatcttgttgggggacaaagttcaacccatgacacctgtccttgggctggatgacatgatactctagctggccaggactgtatcacttgcccaccccaaagtgagtgtgggtcaaccccctggagttacgtggcttaaacgtcggggaggaaggttcttcaagggaactaagttgagggcagtccacagatggaaacttggcaaaggcagtggtggtaatggttcaccagcagcccggcttggcctgagggccccagctttccagtccggagtggtccattggtctgattcttctctcccagttcggtcccctctttcctgacttccattctttaactctgcaggagggggcgcttagtttagttggaggtgaatggagagggaagggagacccaaagcagggaggcccttgtgatttccctaccagccgcctgctctgggctggagcatgggcctcagatagcctaggtgctgggctgcatgtgcggccttgtgggagttccaccgagcagagcttctgatgggggttcgcagcctgggtgggctagctagtgactgagctttgatggtaatgaaccatcgtttgctgcttttattcattcactagtttttcatctgctgtgggagaaggctgtgggagtgtgcagtccgaaagaaatggaaaaacaccagtctcctgtttctgccctgtgctttccagttgaccactcatttggagatgtttctgtttgcttgtgttccccccgccgcccccccccgcccccggctgctgggccatccctgcttacctagcctttttctgaaggtcttgaagcccagagcacttaggaaagtctgagcactaaattgcgtcctgcccaatcaccatatcctgtgtgtatgtcttatctcctttatgacaggaacatggttcatagttgcctttatctggagcacatggggccatgtgggaaaggaagcttgagccaggccaaccctgtgcagaccctgctgtccccaccgtggggccccgggctagcgctgtttctctgagcctcagtttctacctcctcagaatagaaaatgggagtagcactaatggttgagatttctctcagccaagtgtctgtgagtgggtttgtgcatgcctgggacctgagcaatggccacaagaaagtcctgtttggaacttgtggtcagcctgggcgatgaggtcaagatgccctgagagtcaggagggaggggtgcggcttgactgccccagaccacactgggaggtttgcagaagaaaagagcgtggggtggggatggggtcaaaaaggactctgtgtgtgcctggtgagggcttgaggcccggctcacagaccactggtggacccgtcccgccagagcagtgaccgcttgggaggcagtgagctgtgagtgtggaaaggaagtcggaggcaacgtgggtcctcatttgggggcactggggagcgattgaaggtttttaggtagttgcagaggacagtttcagggaaggtattctggcagttctggcccagggtggattgggttgtgtccaggctagaaactggatcctgaaattagttctgaaagaataaaaaaaaaagtctgaattagagagtatagcttaattttaattactggtccttgttaattagttctctgattgcatgtaagccaaggtctctaattggattttcttagatagggtttcgctgtgttgcccaggctggagtacagtggctatttcacagatgcaatcatagcgcacttcagccttgaactcctgggctccagtgatcctcctctcacctcctcctcctgagtagctgggactacaggcacgtgccatctaattggtttttaagtgctgtcagtacgtttcagggagactctccacccactttgcgctaatcttcccccatcctggtgatttgctgtagagtctttgttatggggcaggggcagcatagcctacttccagcctctcagtctgcggcagtgctcttcagggtcaccaggggagttgaattaaaaggccactctgacctggcctctgtggtttcctggccggctgcatggaccagccctcaagcgctgcgggaggcagagctgctgactggcagggacaggggcctgaggtcttgcccagaggggtaactggcctctgcttatttgtgagaggtgaggcttggaggtttggtttgatcttgatgccctgtgcctgcaagggcaaggaaccagtgcctggtgacttggaactaaggcacagacttccatttcaggctcaaaagcagcatggcactgggctgcaaagtcagggatctggttctttaaggtagatcttacaggagggagaccttaaatgcccctttcttcctgatctgacagatcctagagccctggggcctgccctggccaggagtcctggtgctaaaccctgtcaggttggtggggaaagggcatttaaggcccttaccctgttaagatatatcctaaagaaccacaaccctgacttgcggcccacgctagtccgtcacggtgtcgggtttttcttgcttcttcctcttcctcctttgctagccttggtgcttgcggtggcccttctggccaggccatagacagaggccacacccttcttccctctctgccgtgttgctgtccgctgggccactgtcccacctcctctgagatctacagccccacagggttgggtgatggttgtcgccacattggtcagttctgcatctgggtcagtcccaggggcttgcatggctggctgtcagtcctttacctggggggccctgtggctcatccgtggccctcgagttccagagtttccatctgctgccaggccgagtgcagcatcctcaccagcttcacagccaagcagagggatgccagtgttcggcctaggcttcggtttaatttttatgctagactttctcagtaatcgccagcacaaacttattcatggtcccttccttgtgtctggatttcagctttcctatctctgcggagggggttggaccagattacacgtgggtgactcagatatacctgggcctgcatgcaatctgtttggcccacacaggaattttacattctttcctttgaatttgttgccagtgtttaagctggttgccccttaggccccaccattctctgttgtcccacaccaccagcctcatggtttacatttgccccatgggcgcttcagtttgtgaccctccatttgctcctaggaccccctcctcacctcccccccaacccctcccacctgaattcctcagtaccctctggctctgtcttcccagggtgatgggacagaagaggagggaggctagagcctagccatccacaagccgggttccagaatggttggatttgagaaatctggtgaaggggaaaagatttttcatttgcccagaactcagggtagtggacttggggcagtaaaggtctcaggaacagagttgaagccagaactgtaggaa

SEQ ID NO: 77644 - DNA, 2314 bp, Homo sapiens
atggaagggcttccgcccaatctgctgtcttccattccccatgctgagacatttggaggcacagggtggtttccggtctcattgaattggctttcacgcttggctatgaggcacccctaggggttccttgaaggggtacctgcttttcaagggggatgagttgctcaccactcccttcacctgagcagctctttcttttttttttttttcttttgagacagagtttcatccatcacccaggctggagtgcagtggcatgatctggactcactgcaatctccgcctcccaggctcaagcgattcccctgcctcagccacctgaatagctgggattacaggcatgcgccaccaagcctgcctggtttttgtatttttaggagagacagggtttcactatgttgcccaggctggtctcaaactcctgagttcaagcgatccgcccgccttggccttccaaagtgcagggattacaggtgtgagccacctttcccagccactctctcttgatctgtgtttgatctggggtctgcatgttagatttcatttcaggaaagacatttgaggtcagagagagtttgaaaaccatggtgtctggggcagaatcctgggatattcagctcccccatgcctgggaaattgaggcatgtgtatgtgcagagagctgtgggcctgccaggtgcgtgatgactgttggctgtcaggtcctgggggtggagtgtggccatcaccgtttgattggttccttgtccgtcaggtgtccttctgagtgcccaggcaggccgggccctgtgctgagcactgggcacatagctgagagcaaaactgccacatcccggtccttaaggagcttccagtttagtgggaagacagaatctgtcttggatggactttgagtctcttccagcaccgcaaggcgtgtttattaaagagctgggcattggactcgcctgcacaggtacctctgccagctctgcttgctgatgggccagtgacactcacttcctcccccacacgtgtgggcctacccgatgctggcgactggaggtctcggtaggtcagccatggggtcactgaggtcccgtgacttggctccctgggtctctaaccattcctcacctgaccccatctctccagaattactcttgtggacccccctcacatccagggcttggatttgtcacctttctgggtggagagaataaagggaggaaacacgaactgaggtggggtgcaggagccaaggcaggccctcaaagtgtgcatcgatgccttcaaaagccagctgcagtattcggccacctgcgatccctgggtgcccgccatcagcccttgctcctctctcttgccttggataggacagaagttgacacttgggggctcttggagaaccatttggagcacgtggaactcaagagtgaatcacttattttttgctgtgtggcagcagggcctccctagacaggacatattcgggggcttgcagccaggtaggggagtggaagtacctcctctcaccccacacacgggaattggagatgaggcagccgatcctgcctgcttgagtctcagctgtcattttccaggctggcagcaccagcaggagaacccgtgtgtccgccgggctttctttaaaatgcaccgagtgcaacccagtcctccttgtgtaaactttctccaactggccagatggtttgcttctatttaaggcagtgagagtatttcctacggcctgctgccccctggcctttgttttgccccgggaaggccattcctcgaaagggaagctgagcaggagttgcacttcccagcagcagggattgtcggcgcccacccccatggcaggcctagaacctttgccaagtgcctctgcctggagggaccgtgtttgtaacttgactccctctgtcccttccaaatctgcttgtgctgtgttttcttagatggtcatgaaggtctccccccatctcccaccccagctgccagcccggtgcctctgtccctccacatccacatcttttctgtttccaggttctgttgatttttccctctggatatttccttacccaccccccacccccgtccttctgttctgtgaccccggtcagtctcccagtcccccttacccattattgccaagcctctggctggcatccccagctctgggctctcccaccctcagtccagcccccacctggcagaatgatctttcatcgagaatatctgagtcactccactgatctaacctttcctggcctttcattgtctttaggttaaagtctaagccctggagaatggtttatgaggcccttcccag

SEQ ID NO: 77645 - DNA, 1387 bp, Homo sapiens
cgggagaggggcgggtggggaaccactggattgaagtaatggttctcaaactggagtgtgcactggaacccccagggagcacatcttcaaacaggtggctggccccattcccagggtctctgaaccagtaggtctgagggggctgagaatccacatctgtaacaggtatccaggtgatgttgaccctgcttgtgagcccctctgtctgagaaccactggtttttttttattattattttttattttatttttattttttattatactttaagttttagggtacatgtgcacaacatgcaggtttgttacatatgtatacatgtgccatgttggtgtgctgcacccattaactcgtcatttaacattaggtatatctcctaatgctatccctcccccttcccccctccccccaccccacaataggtcctggtgtgtgatgttccccttcctgtgtccatgtggagaaccactggttttaaacagtggtgacgaaaggtgtggttgggccagatgtgcctgctcagaaagccaccagagcgctttccaagtctttggggcatctgggagattgtgcccggcccctttcccagttctgagtgagggactgaaccctgggatgggagatgtagggctgtttcctgtaccaccagccccttggggacctgggtttggagggagggtggtggtgcgggcaggtattatattgaatatagagtgagccagaaggccggtgaggcttgggggcgaacttccagcccactgagtcactctcaggccgtctctggccccactgaaggatctcccgtccccctaccccactgggggttcctttggccctcacagaaggacagataaggcccccagggtaagaacaacccagaccaggcctccctgggtcagagagtcagccagggcctggtatcgagacttagaccttggagagcttgggattatgggagaatcaggctgttcttcagacaacaggccgccctagatgcctggcgtctgttgtaataaaagacctttagtggaaactaagtctgttgcctttggcctcctaggagcccagcaataaaatcagtgtaaatagagctaacatttgggagtggtttataaagcacttgaaaaaaatccctcatataaacccaaagacagtcctacaagctgcagggacaattaattatcctaccttttggatatggaaattgaagttgagaaaggttaaataacttgcccatggtcacagatcttttaaatggcagagctgggatttggcctggggactctgccacccaaatctctgtgctttctgctgtcttattccccttccaccacgtggcccctccaggcagagatgaaggcgctcccctggtgcaagctccagcta

SEQ ID NO: 77646 - DNA, 4305 bp, Homo sapiens
acccgcaccgcttccaccccgcctcgtgactcacaccccctccaccccgcctcgtgacccgcaccccctccaccctgcctcgtgacccgcaccccctccaccccgcctcgtgacccgcaccccctcaacccctgcctcgtgacccgcaccccctccacccctgtgttgcgacctacaccccctccacccctgccttatgaccctgtggacctcaaggcagagcagcaatgtgtcccgtggcctctgtgagagcggacccagttcttctgtccctacccagagtcccgcatggccactctggcttcgaccttccagactggccctcccagatgcccctgtggccatcaccccatggctcatttctgtcatcaatttatgattgatcctttaagggagctgatgggcttgcaggcccagggccctaacaggggctcagcccttcattccttctgttgctgggtgctcacccaggccccagtggcaggtcccctgctgccctctagggactctaagatgaccaagtctttgacctcttctgcgtcagtagctcagggagacagacaaccatggggccgcctgggaagatcgggccagggagctggggagggctctcgccgagctgatgggtttctcccacctgtcagtaggtagccccttgagagacagcatgtggtgatgccagaatcgtgggtcatgatcctttttctctccatcaaggtgcctagcgccaccaagcatggtgagaatgaccaggagggtgcctggtgggtgagccctgagtcgtgtggcccccatgggagagcatgaagccacggctgcctgtgctgcaggctggggccgcaggagactggggtccctgctggttctgcctctcctccctgcatggcctcggccgggctctgcttctttctctgtctgacagctgataggatctcatgggtcccgtttcactctcaccttctgtaaatccctgattcttcagaaaacggggctagaaaatctcccaggtgtactcgcacgtctgtttcctttcttagcctttcatcttgaagtcagcttggtgaggttgccctgttcatactgcagaatccagggatctgaggcctctcgccccctgggcagcaagtgagtaggagtgagcaagtgtgtgtgagtgagtgaatgtgtgagtgagtgtgcatgtgggagaatttgtcgatctgcttgaagcaggctctttgggtgctgtttcagcaggacagatttcgagagaacacagctagctctccacgttggacctcgcctgggtgcagtgtttctgtgtatagcaaatgcacacatggctgcctgtgtatgcgtggtggatttggagtctgggtgatgggtttgcacgctgcctctgaccttgaccagccttgtgaccctggggagtcactgtgctctgggcaagtcgcctgtgaggctcataatcctgacagcattactcatcctcggcctatggtctcccgggtggcatttgggagcacccagagggtgagccaggcgctttctaagctgtaaaagtgccctgtgatgtgagcagttatgtgatgtgctctcccagcagcacccagttttggaggctcaggaagcattcccagcagggcctgtttttagccttgaaacatcatgcttgaaaaatgcttgcatggggtttatttaactttaagtggggcaaattctgaaatgggttgtttattgtccaagttgaatttttaatttctcataaattccccacaaattgctatagtacatctttatttgttgaatctgtcagagttgtttatggcactgaagcctgggctccccctgtttgtggactgttgccatggcaacaccaggctctggaggaggggcactgctctgaggtggtatagaaggttctggaatgggctggtggtgtgaagtagagctgtggctgctgcactgagacccagccgtgggtggactgagctgcttaagaccctggttcctcttcaacatcactgcacccctcttggtccctcttcccttgggggtgcactgctgaggtctcctaattctgcttccctaagcccttgctgctcccagtgtggtctgggaaccagtggcagctgcactgatggggcgcccatgaaaaatgcagactcccttgcccccagacctgctgagtcagtctgcagttcaccaagctttcaggcaccttctcagcatgggtaagctgcagaagccctcacatgccacactgcccttgggtgaccccagaggccttggcctggcggttcttggtgtttgccaccgtcctccctgtgatctttctgactccttccccgacagttccctctgcttggccaggagtgggctttgcctctcaaccctgctgcacccaggccactctcctgctttgcacacaccagtctctactcacacagtcaccccagccttctctatctggggaactctggacatcttggaagaggcaactcttgagacacctcctctgtgaagccctccctcctttccccagaccgggtgatgttcagtttcactggagctctcctgtggcctaaacacctcacctgccccagcctcatcaggctgcctgattcacctccctagccgtgacctcactgggtgccccggctgctcctcccgtctgctgggtgctcagaccccagccagcgctcaggaaggtctgtggagtcattgccactccagtcagctggcttcacaaggctgagacttgagtctggacttcttccaagagcctgtactctctgcccggggagtggtagggaccgctgggcaccttcagtttctacctgaggcctgactggcagttggggctaggaccggataaggatgggtccttggactttggaaaggcgctgtgggagggaggcatgggaggggacagctgagaggagtcccgagctcatgcgcaggtgagtgcagaagttcaggtggcatttgtatgtcccttgagtatctgttctgggccaggcagcaccgaggctcgggagagtcccagtaaacaaaccccaaatccctctgccttcgtggagcacttgtgtctaggttgagagactgaaaacagaaagaagtgtgggtggcgagtgaggtgggggagggggactgggagaaaaatgaaggagagtaaggggctgagggctggtgtgggatttgggaacatggcttggttaaagctgaggagatgctgaccctttggccctgcaaatcctccatggcatgtacccaagagaaaggagggctgtgtccaccaaaagacacgtgtagaatgaatgttcccagcagcagcattcctgatggcctcaaagaggagacagcacgcatgcccattggctgtagaatgggtacgtacatgacctgtgttatcatctggccatggagttgtatcgaatacagcagtgagaatgaaccatggatgagtcccataggcatgaaacgtggccaaagatgccaggtgcagaggcgtattcagtgtctgattccatttacatgaagatcttgaccaggccaagctactctctggggacaggaggcaggctggcggtcacctttggggacaaggtgccgggtgggaatgtgaggagcctgctggtgtcttgcaactgtcctctcctcagtcttcctcttgggtgccagtttgtgaaatattcaagctgttcacttatggcatgtccttcctttcttatgttatacttcagtgaaaggcttataaaagaaagaaacagaaggggaaaaaagccatgagaggcagagagagtgctgttttctgtaatatatgcccttagattctctagaacattggttctcaagccaccgtacatatcaggacatggccaccgcccctcctgaagctctccttgccaggagtgatgcaggctccgaggatgaaccacctggtgagaagccagtagccccagcggcatctttcttgctcttcactggactggagcctctctgtaatcaagggagtacatgttctgtaccccctggcccagtgtctagttagaatagacagtgagcatttacagattgaatggttttttgtttttttcccaatggttttagcttgtctttgggaatatagggtctgtttctgggcatggagaaacagggttccctcctgtgctttaagtctaacctccaagccagagaggtggtactggcaggagataagaccacccgttgtctggatgctgttttccatgcagcagacatgggctccagtttctgtcaatcagtttattaaaacctgcgtttattacttgtttgccctgtgcc

SEQ ID NO: 77647 - DNA, 1911 bp, Homo sapiens
tttttttttttaaaggtcaccagccctgttgtctgggcagtaagcacctagtaggattgcttcagagttctagaatgcgcatgtaaaaattccaaagtgcgtttggcgtctgggctgggcttctatgagcagcccaggcagcagcagtgagaactcctgtgtgtgcctcgtctactgagtgccagggttagtgccccacttgccaggtgagaggactgaggctcacacaggtgggcttgtcacagcctagcatgtgagctgtggagctgggattggattctagaggtgtgatggcatagccagtgcctcttctgctccgaagactgcctgcctggtgagagtccagtgactcctccctagttccagctccatccctccaaggctgtgcagtcctgggtagtggcacaacctctctgaggcccatctaccagatggtgatgagatggatgattgagacgaggggagggcaagtgagaaggccttctaaaactcaggccctcgtaggagaagcgtgggtagcctgaggtcagggacagggcttagtgtgctgtgtggggctgtggggagtgggaagctcactggttttctggctcctgagatgactcgaggggtcttgtgaagctcacacccctgtctcactgggcaggagtttggcctccactgtgggtctctgccatctcaggtgggtgggggaccaggggtccctgggcaggagggtgtgggtcctggcttggaggcagaccttggctcactcccttccttgcccaggcagtatttttgccgcaggccctgccaagtagaaataagttatttacagtgttttgacaggatcatcggcagccgggatgggcaaggatgcctttgggactgagctaatggccaaggagtggggcttggagaagggtctggcgtgggagagagatgggagatgggggtggggtgggggcgcacatttactgaacttgttaaatcttgacaaatgccaggcctggccctcccttaagccagggctttggggcctggtgagggcaggacttgatgagttttcctgtcgaccaaatattccgccggatcgctcaggaccctcggttatttttgctgtctgagccctcagtgccttcctttgtccatcagggacaaggacccctgcccacccagtatatcttcttggggagaagatgaaacgccttggtgtatggtaggccaggccctggccttgactgtgagcctggcagcccctgcagcccctcacactgggccaccattgacctgctttacgacttcaaatagcacagacctgccgtgggaccagggcctcctgctagtgcctgacctctgtcctgcatgatgttctgaccctccagaagcaggtttgaaagtgcctttcaggaaggtctggagagcctcctgtgtagcttgtgggaacaaaatgtgttactccctagccgaaggataaccagcacactaaaatgtgaataaagtgtgactttattcatgtcctttgagcataaaaatggcacacacactgatgcattaaaaaaacttttttttttaattaaactttttttagagatggggttttgctctgtcactcaggctggagtgtagtggtgcgatcatagcttgctgcagctttgaactcctgggctcaagcaatcctcccacctcagccttcttagtagctgggaccatggtgtgcaccaacatctttgatgcagttttttttttgagatggaatctcgctctgtcgcccaggctggagtgcaatggctcgatcttggctcgctgcaacctccgcctcccaggttcaagcgattttcctgtctcagaccccagagtaactgagattacaggcacgcgccaccatgcctggctaatttttgtatttttagtagtgatggggtttcaccg

SEQ ID NO: 77648 - DNA, 1714 bp, Homo sapiens
cgtggtctggccctgatgtgcgctgtgtctactgggtgagtgaattaaggactgaggtattgtgctacacaggatgtggccaggcctcgagggtctgtgcttgctaaaaataactctagattattcttttgctcattaagtaatatgtacttgtggaaatcttgggaagtcaagataggctcacaaatgaaaacccagagataattattgaagcaatttttacataaaatatgctcctttttctatatgatgtgcattcaggttaggcttttctgtgtccctagttttgccacttgcatttgggggaacagttgagcatttgcctgtgccatttaaacaccttggaaattgctgttagagtggctgcaccagcttcccaccatccctatgtcccagcatctagaaccatttctctgctccagagtctcaagttctaggttatttctggtttgctgttactaacagtcctgccctgggtgtctctggacctaaatctttggggacctaagtcacatctcaggctgtttcattgggttatggtctagaagtgacttcaggattttgttgctaaagaagaaggggagaatgggggacaggttgggctgcagctagtcagctgtgtccagcacacttgggccctggacttagaactggacaggttacttgccccctctaagcctcagtttattcttctgtaaaatggaaataataatggacccagtctcatagagttccaggagtgaggtcatgcagataaggaacagcacagaacctgtttacctagtttgtcctcagaaggagctgtttgtgattatttactggtgccacctccaccaccatcattgtcatcctcagtggcccagggaagcgtgagtctgaatgaggtgtgttgtgtagttaaatgatgcgatgggtagatgagccaaaatgaaaggatctcttctgtttgatttattttcatgagtaaaaaagccagaaatgtctgtagcataagttatgtctgtttggtttggctaaagcagggctgaccagggatgagtctcctgctgtgagtgagtgaggtcccagcttgtcctctggggttagagcagattttgctctggctggggtgcatttgggggcatgggctgatttatgttttccttctttctggatctccccaggtctagccatgatggggtgaaggcatcacccccagggagtgctgacccctgaccctagccccatgaccccctcccgtgctagttcattatgggcaggggaggtcccagggattccccgcacactcatcgtgacttttccaaaagctgtgtaaatccagagttgtaacttggctctgtctttctccttccccttgatccaccctcagctcaagaactcccctgggaagcacagtggctcccgtctttgcctcaagttctctgatgttctgcacaaatggtaggcagagacagccctttcagggacctgattgccctggtgtctagttctcctttcacaggcctgttttccagctcgactgtcaatctgagtctttctctttttgagctttatgcaatggccttagagtataccctataaggagatcccggcttgctggtgcccggccctgcagctgtgtcccagaaacttggcggtggtgcatggggctcactcagcacttctacagaagccgcctggggtggctcccagggttccggtgggaatggggtac

SEQ ID NO: 77649 - DNA, 1995 bp, Homo sapiens
tctgtcgattttctctgccgtgtgctgtggagccaagcgtaaagggctttgggaataacaatcgctgtggggttctgacgtctttggagctgggacagcccatggtagacttgcggtccacccatatcctgggcagtggctttctgaagttcacgtgagcctgactctgacctctccccagaccccatcatctccaaggaggaccgccacgggcttggggggctggctctgcacacagtgtttccatgtggtcatttgaggccagtaatggacacagattgctcttggctgtgcctcacttccctgtggggtccagagacctgggtttgagtttctgagtctgtttcctggctgtggatcttttccttcctctttaaagggatgacagcgcacaggattgaagacacctaagagatgctgaaggaatattaattgatttttactcatctgttgttatgattaatggtggcatttcagtggggaaaatacagctacagatgaaactgggctgttgagaaagatacattgtttcagtgtggagaatatagtattttttttttttttttgcctcccctctgtatcacttttgggtttctaacaattgtggattccagcttactccttccttttttaaaagatagattttatggtttttttaaaaaatttgaaatgcaggtatttttttccccctaaacattgacaattattttcattctccatcatttactatttgcttaggctatgtagataacaaataagacaaagttatgtgaaagcatgatccccatagtgttttttaataatgatgatacatgaggtgctgggaagggttatataaatgaggtctgctcatagcagttctccaatgtggccattaaaaaaaaatcacatttttcacattttggaagacagcgtggggaaatgctcgtgagttgctttgagtactgtcgtcatactctgagtggtttcatttctatccgttttattttggttcctgagctttttaggtttgctgttagaaatagaagctgtcaccgtgttgcagtcttgtgcagcttccgaagcctgtggcactcagttctagggtgattctttctccagcctttgatgcactgagtcaatttgagcaaatcctttaaaaaaaaaaaaaagttcccacatcccatgtcaagacaacagagctctgccagggcaggtggggctccctgtgctccagggtgcctgggtgccttcttgcaggcaggcttccagaaccccaggccctcctcaccacaccacgcagggttgggactggatctccctggtacctgccacccttgcttggctgtcaaatgtcaagaattccgtggcctcagtggagcgtgccaggtaagcattttacgtaaaagcaaagaaaagagatggaatgaagtacacaggggaaataggaagggatggaacgggggttttagaaagggccagaagcaagattctgctcttaaagtagctgactgtcctggcattctggggtgaaggtatccatagcattgctactcagagtgtgatcctagggaatctgggtgcagatggagaaactcggatgcaaacactggattcctcagcagtcggttcccgtttggcctggtgcagggctgagactctgaggaggaggcatcttgacctgagggccctggactgtgctccttgtccagctgggcgcagaaccatcgtagtcaaagccaggaatggagatgcattgcctcaggtcagttccaaagaccaggaagcgtccctgagtatttcagttgagtaaggacctggcatctccctcttcagccccttccctgctctcatatttttattcatgcttttagaactgctaaatgtcaggtgggtgcagtggctcacacctgtaatcccagcactttgggaggccgaggcgggtggatcatgaggtcaggagatcgagaccatcctggctaacacggtgaaaccctgtctctactaaaaatacaa

SEQ ID NO: 77650 - DNA, 5775 bp, Homo sapiens
cacttgggagggtccatgggggaactgctgtgggagccattttcagaggaagtgagttcaggcgctccccagcaaacacactgcctgagagggcaagacagccttcccccatgcctgatcctgtccatacgcgacctcaaactgtcacacagtgggtgtcacccccaccgctcgaggagaggatgagagatggacaggggtcggcgggtttcatttatgtggcattctgggaagatttagactaaaatctttaatccgctcggtctgtgggaggaacaggagactggagccattgtgtcagaatgtccggggcagaagaagcattgcgaaatctttctagacatgtatgctgttcatttaggtggtggcttgggggaggaagtggtggctggggaccagaacgaagccaaactggacactttacacttcagcatctaaaaataaaacctaccacgatacctctctgttcacctcctcctggcatccctgcatttggagaacttttagattttaagacattgagaaagactctgcaaaaacaggaagccaagccacttggctggcttttcaaaatcagctgggcttctgtgcgcaggatctccaggctgctgggccctgggagctgggggtgtttgcagtcctctgggttcaggtgctggtgactgaagaggacacacgtccccttgctgccagccgtcttcctgtgtttcctgtgtctggtccctgaggggcgtctcccgttctgtgcagccacccagggatgatgtggtgttaagtacccttttgaggtggggaaactgaggctcagaatgctgtgctttctcttggggatttcagctggccgtggtggagttgggatttgagtgcaggtctgtctgtctcaaaagcctgtggcccatggttttctgctgaacggtctcctctgcatgttcataggttctccatttactaaatgcttctgttcctcttattacctggactttggctgctatctaaaaaaaaggatgttggggccaagggtcaggactcaagactgcaaaacgctggtgaccggaggtcggttggtcatgggagttgtttctcttcctgttatttaatggcaacagtaacagtccttttattgaggactccagtgtaccaggcatcatgggtttactttaaggaagcatttgtgtgtaaccttcccgaggtgggtgtgggagcatatttaagaaagtggattttgcagatctcagtgtcctcaggtgcctgtgctggaggctgaggagctcgggagcccttcttccctgccacccctgtgcctcttcacctcgttcctcctcccacctctgcagaggattgtgcactctgtgaggcgcagggccgcctggggtcaggttcctgtctgtgtgaccttgggccagttgcttaacgacgctgtgtctttctgctcatctgtaaaatggggataatcatggtgctggtcccctggcaccattgtgaggactgagttactttgggtgaagtaattggcactgggcctggcacactggaagctggctgtctgcaggagaactgtacactatccacaggcagacctgaccgagtgtgagacctcagggcataaaaccctcctggtggtcaagtacagtggccagtcattgtcatcctggggccagggaggtatttccagttccctgcttgcagcaaaattcaaagagtacctgatggtgtcgtcagctgatagcacattaagaatgacctttgttttgggtggctgaggtgggtggattgcttgagctcatgagtttgagatctgcctgggcaacatggcaaaacctcgtctgagggttcccccccaaccacaaatacaaaaaattagttgggtgtggtggtgtatgaccgcttggggctgaggtgggaggatcacttgaacccaggaggtcgaggctgcagtgaactgagatcgtgccactgcacttcagcctgggtgacaaagtaagacactgtctcaaaaaaaaaaaaaaaaagaataatatttgataagagatgactagattactgtaattcttggcaaataattataaaggaatccaaagaatttgctgtggtaaatctctttccattctattttttaaatttgaataagtggtttctgttctcacatctgtaaaaattaaaaaatggagatgaaattgataaaccctgtcttattctagcaacaggcaatattcatctgagaattcatgaaataatttttcaaaaaattcccattcattgtatagatgtatttttaataagatttatttattaaattttacttatttaattttttttttttttgagatggagtctcgctcttgtcgcccaggctggagtgcagaggcatgatcttggcccactgcaacctccgcctcccaggttcaagcgattttcctgcctcagcctcccaagtagctgaggttacaggtgcctgccaccatgcccagctaatttttttttttttttttttttaagtagagatggggtttcaccagttgaccaggctggtcttgaactgctgacctcaggtgatctgcccacctcggcctcccaaagtgctgggattacaggcgtgaaccactgcgcctggcctaattaagtttatttttaaaggttatttcttatacaattttgcaatatatttctgtcttattgatcaattgtatacttatagtaattgttataataattcagtccaggagaaaacttctgacagagctttatgatcacaggaaatcacaggaaattaaaaaaaattaaaacattgatttttgtattttttggccctatagtatataataggataatcagtataaggctttcaagcataaaatacactgtgatagtataaacatctctgagggagatcagagtttgtggaggaaaaaaggaacactgttaaatttccaatggttaaagaagagcttgattatgtaatttaaaaatggatgatggcgaatctctaatcgccgtggtatttagataccattggatccatttaaaagagaaacattaacagttttatttttaaatgttaatatttacagtatgttggaaattacatcctctacaagtatttagacttatgatgagaaatttttcatatcaacttaaaaatgtgcaaatagatatgtagttttaaacatttattttgtgggggtttggtttgaagtccactgcttcagaacattaccctgtttacttctcagaaccaggcctgaggcaaatccttcctcggagagggacagcacgaggccttgctctcaggctgtccagaggccctgatggggctgggctggactgggctgactctggggcccagaactgtgctccgagacttgcttggcagtggacttgtctgcagacctggtctgttgggccacgtgatgatgatcatgaaagacacagcactgtctgctcagggctgctcaggcaggaaaggaagttgcaggggagccaggacccaggtagctcagaagaagaggatgtcctactttgtgtttagagcagggagttgggctgcaggacaagggaagagtgtagtaagggtcgtgggaccagatgctctctacctcctgtcttgagaggctacttgtcatgatggtgatggtggcaagtgcctgtttcctcagccccgtgctctgtagtatggtaatgggaatgctggacgcacgggccaccctgactccaccatttcagtgttgagttggtctcactgagtgctgagctgagggcccctcatagccaggccgtgcagatgggacgcagtaacatgcagcagtttccccgacacttgctatggataggccccaggtgctgggggctcacacaggcccaagccaggccccttcaactctctgtgatgtctgcagacagtggccaaggtaggcagggacaccagacaggcacagaggagggccctcacgcagcctggtaaatcaggaaggctccctggaagacgagtctggttagtggcaatgagcccatctacccaacagatcctaactgagaggcaaggcctgacagagctcaacccagttcctaggtccttgtgcttccttctaaaacacctagttgctaaaatgaccaagtgccaagcacggcactatgattacttcccccgtacacaggagccttggtcgtctgtgatctggggagtggggctggggctctcctgtgggccaggcagaaggcctgcatcagccttgctaggtgctgtcacctgggggcaccttccactccgatccaatctgtggggaaggctcaggaggagcggtttccccatccagggactcactgcctctttctggaatagtcctgaatttggtggaggaagaccctgaaagaaagacccacctgctgccgggccccctccagcctggacgtccttagggaagcatgttttgcagcctgacctctgccctggcctgttctctgggctgcctttccccagttactgtaaaagatcggggagaaggtgactgctggcatgaggggactcgaggtttgactttaaagtgcgaatgagcaagctgtaagtgtgagaagtgcagcagccagttagagattcactgtcctccatccacattccttgagaattcagacactatgaaacccagtctctggtgcggcggctgtttctcaagcaggcaaggaagtaagtaagttctcccggcttgcgaatgagtgaatggtgggcatacgtctttctgtccgtgttttctccagagctggtgctggctggcttgctggtgacctttgtatatgtgtttttaccccttcctgcaccagactttcagggaaggaggttgggtgggtgaccatcaaaccaccaagaaaaggcaagtctgagaaagagacactaagacccaagggaaggtccatgtgcctggggccgaggcagaactgggtgctgggcctctggaggcgaaggaactgtggggatgcccactggcagggaaaccgtggggatgcccaagcccaggggcagggcaggcctgtctgagctgtgggggagtggtgaggacgcaaggctgggcatgtaaggaggagtgggccatcaggggatggaggccatacctcctgacatggaataaactgggcgtaggggctggcaggaggcgaggtgttagaatggccttacagacaaggagcatggccagggccacacacagcagctggggaagggggtcctttggctgccaatggcttggaaaggctacagccccaggcttgagggggctagtgagagaccaggctggagagagtagcggtgccaggtgagttgttcatggggtgctgtgtcgggggcatggaggggcttctgcaggcgaaagctgggtgctccaacctgaggctatgggggaagagccatggggaggatacatggagggtgattagacagggctgcactggaaagcagacagcagggttttctgagaggggctgtggctgcagcctagtgaggggtgatgtgctctccaggggctcctgcagtgacagagggcagcaggagacagatggcagggtgtggtacctgggtagatgtgggaggtgagagggggaggatcagtccccagactcctcccttgtttctggccggagtgcctgggcatgggggtgcaggaggagcagccgccagggagggaaagcccatgccagcactggcgctttccgataggtgtgctgagtgcaggcagcggaggcctgtgttggtagctgctctcggaattcagagccagaggggactcacgt

SEQ ID NO: 77651 - DNA, 1034 bp, Homo sapiens
ggtgtgggaagggtgagggggcagtaggcacccagctagatgtccagttgtcttgtgctctgtgtagcctcaccctgggtggacttggttcaggtgctcattaactagaaaaagaaggatggatggaagaagaaggaagaatggatggagggggaaggaaggatcttggagggaggggaaaggtggacagatggagggagaaggaaggatggagggagaaggaaggatggatggaggggaggaaggatagaaggatggatggagagaagagggaaggatggatggagggggaagaaggaaacatcaaaatactctcagactctatgtgaggggcaggctgtgttatttgcactaaaggctgtacctggcacctaatgggtacttggtaaacctgatggtggcctggccatgtcctctgttccccacgctgtccccgtggagggtgactgtggtctgtgcagctgggctggcatcccatctccttgtcttacgggcctcatctgcctgtagctgcagagaggggaactcaagctggggactagatcagggcagtggaggtgctggcccctgctagaatatctaaggggctttcaaaaagcccactggggagctcttccagcccacccctgttaacttcagctccaggccttccctcagcggtcataggagagcagcgtccccattcctgcaggttcagcattgcaggccccaggtttcccctgctcctgggaccagactggggctggttgacgggtggggctggtaaaggatcctcctgacctccctcctggtagtttgtgggttgaacttgtcactggaagactgagatttgttttggggtaaggaggtagtttctggaagcctctcagcagctctaggtttttgtccaggctcttcttggctctggagaattgcatgttctgcactagatttttcttttttctcttcctttttttttttttttttttttttttttttttttttgagaaggagtctcgctctggagtggaggctggaatgcagtggagctatct

SEQ ID NO: 77652 - DNA, 1435 bp, Homo sapiens
ttttcccgagaggctgtggtggtgcatgtgggattccaccaccagaggggatgcagttttccgctgccacctcctggtccttccattgcactgaggccctggaggctggagaccaggccttccagcttggtgccacccttgcccacggtggtgcacctggtggtgaacacgtgggtgtggggagagccctgttccgggccagctcctgcacttcctgagtctcccaggcctcggcctgctctgcaggtaatggggtaaccactgtcccaccctcatgaggctgcagaaggtattggtgagtggtgagcttcaaggggtgtgtagcatacgtgggtggccccctcttttctgccactgttgcaacttatcctttttttggagctctgagcgacagaggaactgctgtggctcctgggagatcaaccccacttaagattgcagccgatcttttctctagattacttttttgttgctttcttattttatgtgttccatctgttttcagtgagagactgtttttttaggactaagggagggagagctgcctgggatgatgtaaaatgtggactgattggaattgacctcagtaaagagaggagagtcacacgctgggataacccagatgccagcagggttgactcagagggaaaccgaggccctggcccagagcccagtggaagtctgcgctcctctgtcaccggcctttcccattgtgcggttcacagtctcggtgatttgggacttgagttttctgtcctggagcagggccgctggagtttgggctggctcctcaaggtcctctgctgtgtgtcctgggtcaggttcccgtcagtgacgcttccttcagttttctcgtccctgcggggggaggggcaggatgattgggaatgaggcaggggctgaggtgtccacaggtgctcagaaacggtgcaggttgtgagcgggtggttgggtgtagcacaggttcctcatgatgctatctgtcactgtgctgtgggctgtggtggcccagggctatgctgttgtgtatctcccctgtccctcatgaaaccgtggaagcagatggatattggccaccattcctacaggaactgcagacaagctaagagacactgagggtccctgaatgcctcaaccagggtggttctcaaactggattcctcggggcccaggtttctgttgaggtgtcgggggtttgagggaaggtgggctgggtgcttcccacagtgggacctggtcagctctccttggcctctgtcttcctgtctcatggagtggctcctttgtgaggttccgctcagtgccttgctatcagaaggtgttgaggaagccctcactgaatgagctgacaaacagatgtaggaattggtgggcggcgcctcagctgtgccatgaaacaagggagcaagggtgcccaaaggttcctgtggggctt

SEQ ID NO: 77653 - DNA, 1449 bp, Homo sapiens
atgctgagcatggagcaggcttcagtggaagccattattcctgcctcttgatgaggaaggcacttgagctgctcttggtgggtgggcaggagtttgccagctgaggaagggtgcctggcagggggatcagtttgtgcaaaggcagacttaggtcaagccttggcatttggagattggggtccctcctgggagggtttgagaggctgctgctgcctccccctcgtgtcttctgagctgcacctccaaatgcccatgtggcaggtgttttgctaagaatttggggctgtggacacagggcacaagctgtgtccctgaaagagtgcttgttagtcaggataggccaggttaggctgcagtgacaagtagtgtcgaaaggctggcggaaataggtttactcacaactcattcagcatgcactctggatccagagactctcgggggctgtggtctgccctgcagtggctcagtgtgtatcccacttcttaagttcagcactgtggaccttttgtgctggataattctttgttttagggggctgtcctctgcattacaggggccctttcctcactggattctagtagcactttcctcggtgtgacaatcaaaaagctcttcaggtgttgctaaatctccttgtgggggacacacagttgcccatagttgggaaccagcgctagctggaggtcctcttcatcagttgtttctttctggttcccagcctggcttcgtcgccactcagcccgcgttgtttccaggtggcgggtctggctggctctgctggtgggtggcagcctcatgtgcttccttgtttctgaggtcagggaggcctcggtgctggcagtggaatgctttttccaggaggggacatggtcacctctgttcacatctcattgcccaaggcaagtcctgtggccatgcctgactgggggcagggacaacacagtggcactgagtgtccaggagggaaattgccggctttgatggccaccattgatgttcaccaccgagcattagcctggtggggtcagtgcaatggagtccagcagcctttctctctgcccagtgctgggtgtgggcagcttggggcagtggggcctgaggagggtgggagccaaggcaggtttctccagaggagctgacctggggggtcaggtggtgatgtggggatggcatttgaggaagggaacagtgtggccatcaacacacatgggtgacggggcttagtcatctgtttaggagccccaagtcctggggagacatcctgggcttctgtggggtacggtgtgggccctgccctctgcaggcagggaaaggggaccataacttggggctttttccccagtgcctggtacctggaggtgccaaagggtcttgttatttggggtgcctgaaatcagtagttactgaactgtgccacacgttgcttggatgaggatgtgcctggcttcc

SEQ ID NO: 77654 - DNA, 1059 bp, Homo sapiens
tgtggtgggcaaagtaaggcccctgccactccccaccaaagacagcaggttctaatcctcagagcctgtgagtgtgctgccttacatggtaaaagggtatgacatgactacagatgggatttttaaatttttatttttcagagatgggggtctcactgtgtcacccaggctggagtgcagtggctattcacaggtctgatcataacgcactgcagcatcaaactcacggcctcaagtgatcctctcgccttagcctcccaagtagctgggattataggcatgtgccactgctcttggcttacagatgtgaaggagtgaggcatcttgaaatagaaaatgttcctgcattacctgggtgggcctggtgtaattacaaggaggcaggagggccagaggagatgtgacagtggaagcagaggttggggtgttgtggccacaagccaaggaatgtggacagcctttagaactagagaaagcggaggaatcgatttctccctggagcctccaaaaggaagcctgcctctgacctcagaaccctaagagaataatacatttgtgttgtttttagccactactgttgtgatttgttacagcagcaatgggaagtgaatacagttttctcctaccctgctcttcttagggcttgtgggtgaatctgtgactgagaagggagggactgggtcagggtcaaggtcaaggccagagcccatgtgacccgacaccttgggactttcctttgacctgccatcccgaaaatatctgaggggccagggagatactccagtaaggtgccttgtggtttaagttttctgagatggggtcagggctgactcatgcctgtggctggggggccccaggaaaccccagtgcccatgacctggtctttgcctttgcttctcctggtgcttagcaggccttctctagcgtgccctggcagcctccctctccctcccctccagggcctggctcacacagcagctctactgaaacttccctgtgcctcctgctgtcccccaggtgtttgtgctatttaagggcctgtggcacacccgccagagg

SEQ ID NO: 77655 - DNA, 1726 bp, Homo sapiens
tgcagaaggtgcagagtgtgtgtgcagggacagcagggagaccgcctggtggcctgcaccgcagagctgtgtgtctcagggagtgggaagccctgcctgtgctggcctcagttcttccgctcttctggaattctgcatccttcttttgacatttctctctaatgcccagggtcctggctcttggctttggcttggtggcagctgtgaccccctgcatggggctctgagggattattccagctgtttggggactgtagccatggctcccagctgcagagcctgacaggcctggaggccggcaggaagaagatgggggctgtgcccgcctgccgagagctggctctgagactgactcttggcactggggtcctctgaggccccaggctcattctcacctcctccagagacccagctgacataccattctcatgagctgcagtcctgtgacccagctgatttctgtctcattggtggaaccctttagaggtggggtagggctcctaaaacattagccctactgccttccccacagattggcctctcttccctgcctgtgggcatctggcatctgcttgaatccttcttgtcacggggtgctcatcacctcttgactgccttcctatggaagccagcaacctcttcctatggttgagctgaaatctacttcataggaagggttccttctgcctggaaggtttgatattggacaggactgtcaaccgtgtggagaggggaggaacagggtgctggctcccccggcttctgggctggattgacccagggcgtgtctaccccacagcatcctgacatgccagaggctggaccttaggaagtgccttccgggcccttcactgcaggcctgctcaggggctgctcctcaggtcttggggcccctggggcaatggcatccatccttttggcctcctggggtcaaggttctgagggaggattagggcagcaggtggttgggtggagaggcagctctgtccagaacaaccctgttccagaaatcccagagcctcatccccaacagacccggtgggccccccaccatcacacaggtcccctttctccccaggaagtcacacagtgctgtgggatgaggagggtttcctgacagatttggggagagcgggcctgggtggggagtaagggagcctgggaattactggtatttggatgggtttagattgtggttctgcttcttacctgctgtgagtctttggtcaggatactgaactgctctgaatttccccacttgaaaagaggtgacaggccaggcgcggtggctcacatctgtaatcccagcactctgggaggccaaggcgggaggattgcttgagcctgggagtttgagaccagcaacctactgggcaacatagtgagaccctgtctctacaaaaaataaaaaaagaggcctggtgcagaggctcatgcctgtaatcctagcactttggggggccaaggcaggcagatcacttgatgttgggagttcgagaccagcctggtcaccatggcaaaaccccgtctctcctaaaaacacaaaaattaacagagtatggtggcgcacgactgtagtcccagctacttgggtggccaagtagctcctgcttgaacgcgggagaattgcttgaacccaggaggtcaaggctgcaatgagccgaaatcgtgtcactgcactctagcctgggtgacagagggagaccctgtctcaaaaaaaaaaaaa

SEQ ID NO: 77656 - DNA, 1027 bp, Homo sapiens
cttcaggtgccacacctgaagactgaggttaaatgggaggcggggaggagctggtgacactgactggatgccactatgtgccagcctcattcattccaccctctggcagtgtcctgagttacatgcccagccaccgtgctattttccaggccggaaaaccgaggtgtagagcccagcactcggcgtaggaggcacacagcaagtgaagccatccttgttgacatgagctggttgctcttggcatttgagtctgaatatcaaaggccctgaagattaaaaagagagaatgaagaatgatgtgcctggtgccttcttgggaagagcccgaggccagctgtggaggggagcaagactggttctgggctgggcttcctggcctggtgctttcctgggcagctggaagtgcttctgtgggagctgtctggccctggcgccgttgttggcttcattattttttgcctgcaggggcctgagtattctgtactgacgggaaaacatttgttgggctgacgctgtaatcacaccacaagggacacttgaaattatatctgtatttgggaagctaattttaaagaactttttctcttcataattatatgcaatcagccagctagtgttattggggattctctttttccctcttcagctgagaggccatctgccttcctcttcctgcctttccttccagcacacggtgagccatctccctgggagagggaccactggcccttggctgcctgcaagccccagggaaacctttccatggtgattgcggaggaagggatgaggaggaagagcaggggaggatgatgggggcctctggcttggctacaggatgagtccgttttcaagactggaggcgcaggttggtgatggaaatgatggagtgtagcgtttcgatttggacattgaagcagccagggctcttgtgaatgcaagtggcagaaaatccaattcagatgagtttaagcaaaaagaaaaaaaaaatacatttcttggcccaggtaaccaaactggcacaggaata

SEQ ID NO: 77657 - DNA, 1129 bp, Homo sapiens
gacgggggcctgagggttcgcacacagagtccagggctaggacgttgttcccaagaagggagtggagagtacctacccccacaagtctgagccccaggctggcctaccctgtgctgggcacctctgcttggggttccagaattctcggaggcagctgggtgggagtgctggtgggaagctccggaagggaggctgctcggggcctccctgtggctgtggctgcatgggcagccccgaagcggcttcctggaccccaccttgtgcctcagttaaacctgaatctggcttattcccacggccagcccgacacaggcagattctgagagtcctggctgcgcccagcagccagctgggtgggtggacatactggagggctgatgtcctatttgtgggctggggtttttccgggccttgggaaatgctgcctgagttcctggagaaggatgacatctttcctgccccactgtcgctgtcgctgtgcagaaccttggtgttttgacactgatgtgttctggagctaaacaatctcgtgttatgtaaacacaattagcctgttgctgtttgaccctgtcctgcttggggagggttgagaaggtgtctttttgctggatcctgggaattctgagagcctggagcagctgtgaactagtggctgggggttgtcggagctggaggggagtgttggtctggggagggccactcctgtccaggacactccgctccgatatactaagccagaccctggccccccacagctgagcaggcctggtggaactgcggggaggacatgctggactatttccacccggaaggggagaggaaatgaacggtgagtggctggtggccacaaacccaggatgttccatatatcagggccccagttccgagggccccgggcaaaggggctgggctggaggttgggagaagtgcagggtgacaggccctggttagagtatgggtcccttatggttcctttctgaaacgagtggggcaggtgagggcaaggcctgctcagagccccttgccccgggcctgcttaactgctgtgggtgcctctgcttggtgttccagaattttcagaggcggctgcatgggagtgctggagggaagctcgggaagggaagccgtt

SEQ ID NO: 77658 - DNA, 1104 bp, Homo sapiens
ggccctgtggtctctcctaaccttgctgggaatgtgacaggaaccaattctttggatttgggatgctctcctgggaaggatgggggagtgagtgggtgccccttccctgacgcagccatctgggacgtgggcagttctgtgagtgcttctgcatgtgcttcaggctgggaccccctggacagtgagacctatggagtgggccacatggctgcaaatctgtttccattgctgtgtgctccagtcctctcactctcaattaaccaacagatgtgatgagtcattggggtctcgtcagctaatgatctgagcagtaagtcgattgtatggctgattcctagagccacaggggtggatgggttctgacaggagcctcagtgctgagcgggttcggtaataaaggggatgtattggttcctgagtcagatccttggggcattctggcttcaggtgtaggtagactcaggcgacagtccaatagggcctggtctgtctgtctgtctgtctctctctctctctgtctctctctctctctctctccctcctctctccccccggccccctccctgcttccctggtctcttttacattggcttcattctcaggcccatgtggtgcaaggtgagtcctcaccctcaatccttattctcagccaggcactgtggcgttccttaggtgtgtgatctcatttgatccgcattaacagccctgggagggtggtggttttagcattcctgtttctcatagaagggctaagtaacttgcctggggtcacacagctggtaggggcagagctgggattcagagctggttgggttggctccagggtcccccatccctcatgctccaggtccacagggacagggattccttctgttggcctctgatttgtcatcctgggccacatacctgtctctgaaccagtctctggggctggggaatgcagcgcctcattcccttctacatggcctgagtgtgggcagggtggatccccaaaaggatgctgcaggggcactgtttcccagaggcaggggagggatgtttggcagctgaggtgggagtggacgtgctccctgtttctgggcttcagtggctggccagagtgag

SEQ ID NO: 77659 - DNA, 1392 bp, Homo sapiens
ctgtaactcctgagcttgatcgatcgcccgtctcagcctcccgaagtgttgggattataggcttgagccactgtgcctagccagcctattttctttttcttttttgttagtcttgctctgtcatccaggttggagtgcagtggtgtgatcttggctcactgcaacctccacctcccaggtttaagtgattctcggacctcaggtgatccttccacctcagcctcccaaagagttgggattacaggtgtgagccaccacgcccagcccagcctattttctttaagattttaaagtcctaacattcgtcatgggatccttgaaaagaaaaggaattatggccttgccactagaggcctttgccgcctccctgcaggaaggtgtgtcccgcggcattgggatcgtgttggagaaaggttttgcttcctgcacagtcagctcccaagcaccctttttatcaccttgacctgggcgcagccaagccgtggcctgtgcttgcggagatttgggtgccccatcctctcgctgctctggggaagcctgtagctgtggagaggccagtccaggccccagcttctgacctttgtctacatatcaggaggagccctcctggtgaggaatgtgcctcgttcttttgggggagctgacgaggtgcctgtagtgtggagggttaggggcaggggagtccctccagaaatgcacttaagcttgcagagtcaccctgccctgcattgttaagtggtataaggacagttagctccagaaacagcagtggctcctgtctctggagctctagcttcatgcctgacatggtgctgagcgctaacatgtggctctttgaagctgtcagtccgtatgtggagactgaggctcagagagggtaagtgactttcccggggtttcatagccgatcaccctgggggtggggttcaaacatcagtttgcacagtgccgcgatctcaggtcactgcaacctccacctcctggattcaagcgattctcctgcctcagccttccgagtagctggagtcacaagcgcacgcctccacgcccagctaattttttgtatttttagtagagatggggttttgccacattggccaggctggtctcgaactcctgacctcaaatgatccacttggcttggcttcccaaagtgctggcattacaggcgtgaaccaccgtgcccggcctcggcttcttactaggtggatgactgtgggtgtgtttcagctcctctctgggccttaatttccttgtcagtaagaggtgaccttgtgctcatgcataggagggggtcagcacatgcaaacttcccttctgtgcagggcagaggccatctctggaaggaagaagggggaaagtggccccttactcacctgtgtcaggtggtat

SEQ ID NO: 77660 - DNA, 2473 bp, Homo sapiens
agccgagatcgcgccactgtactccagcctgggtgacatgagtgaaactctgtctcaaaaaaaaaaaaaaaaaaccccacaaaaattagccaggcgtggtggtgggtgcctgtaatcccagctactactcggcaggctgaggtgggagaatcgcttgaactcaggaggcggaggttgtggtgagccgagattgcgtcactgcagtccagcctggtgacagagcaagactccgtctccaaaaaaaaaaaaaaaaagctccaggggcactggggagaagggagaagtacacatcctgaagtctcccttccctgtgagatgaagattctcctgggaagggggctggggagctccttgtgaagtaccctgatgatttttatgggaaactactcactgtcatttcatgaagtgcctcagaagaccttaccccaaaactgtcaggcgtggggaagcaccgagttagccaaggctgaagcagtgtgtttcagacttctcaggggcaggtcccctccaggaggtttgctggagccagaggttcccaggctggctcctgggtctctgtaccctgagctcactgtgggaatctccagtctggcaccgttcacctgaggcctcactggagccccctcatgcaggagggagacatggcaggggcaccaggtcgtcagcccagcccagttctacctgctgttgctaccttttgccaaattccttctcaaaagaagccttttcagatttcttgcctctggctgctggtttgcccggagtgtatagaaaggagctagttttgcacaagagacattcctgggaccgatctggccagatagacacttgtggcgttttcctcagcagtttacgctgcaaacccatggactcctcagcaaccattcttattagcctggggtcactctgggcgctcttggagcccaagccagaaactgggactctgggtttgttcaggcggcctgctgtgctttggcagggctgtgttgcttcctctctgcccccttgtacattcatggctcatgccagatctcagaggatcctgagaacctaccatgggggtcaggcactattgcagatgggataactaccctccaggatggctgaggggtctccatttgctagatgagggccctgagactcagggagaggccaggtgctgtgagcagcacagcttggattcaccctcagggatgggtgactcctgaaaccatgctgtttccactccgccaggttgcctttgtcttcaacacagcatccagctgccgtcgatcgatgtcaggaaaatcaaggagttctgttctttttttttttgagatggagtttcgctattgtcacccaggccggagtgcaaggtgtgatctttgttcactgcaacctccacctcagcctccccagtagctgggattacaggcacccgccatcacacccagcaaatttttgtatttttagtggagaagatggggtttcaccatgttggccaggctagtctcaaactcctgacctcaggtgatctgctcaacttggcctcacaaaatgctgggattacaagtgtgagcgaccgcgccctgcctcaaggggttcttttctgagcatcctttgtgtgcagttgttgggcccaggaggatagtgcatggtggagatggcagtgaagttggagcatgagacttgtcctgagcctctgccctcccaactgtaaggtgggtgcagtgcacccgccctagggccaaatgataggattccccctccacccaagaggccacctcacctgccctcctacccgcccaaggcagggcctggggcctctgacacatctctgctgggagctgccacccatctttttctgggggatcctccagtggtcagcttgctgcttcctgggcagggcggggcatggtagatgggtgcagagagaaccctcctgtggcagtttcactttcatttctgcctcacaccctgtttccatccaacagtcaagggctgggctgcggaggtgaggaaacatccggtctccaccctggggtacttgtcctagtgcaggttcccaggcctccccctcccctggaatgaatctggggtgggccgtggcatcttctttttaaaaaacaccccattcattcctttatgcacttacatgccacatacttactgagtgcctgctgtatgctgggcactcctgggttctggggattgatacagcagtgagcaccacagtctcctggagccccagggtcagtcttagggagagcttcagggcagttgtctcaccactgggagctcttgcccacagtgtgctgggtcacgtacctctcagggtcctgggctcgtgagtttcttcttcttcttattttttttttgagatggagacggagtcttgctctattgcccaggctggagtgcagtggtgcaatctcactgcaacctctgcctcccgggttcaagcgattctcctgcctcagcctcctgagtagct

SEQ ID NO: 77661 - DNA, 1044 bp, Homo sapiens
ctccccagcagagcctcatgggctggtttctgtaggcccatcctctggatggcccctgggagtgctcccacagccatttttagggttcggtggggtggatctgagattcgtgtcagagatcccgtggagccgtggagcgtcaagaatcactctcacaagggagctccagactccagaccccgctccgcatccccccacccctccaggcccttgagtgctgggtgccccaccctgttaattgctcatgatgttccagggcacacctgtggcagaggccacctgcagactcagctgccccagagggtgaatcgggacccacaggccaaaggccctcccagacagcttcagggagatgtcttcgttccaaacctctctcgccgtcagaatcttcactgatacttaggcccccaccactgggcctgttcttcctctctgacttgctcattgtcctgcttattttaagtctgtcttgtttttaagtagttggttctatgaaggtagagattttggcagctttatttactgctgaaaccccagtgcctataccagtgcacataggagctcaaaaaagaatctgttagtggctgggtgtgatggcttacacctgtaatcccagcactttgggaggctgaggcgggcagattgcttgaggtcaggagttcaagaccagcctgggcaacatggtgaatacctatctctactaaaaatacaaaaattagcagggcatggtggcaggtgcttgttatcccagctacttgggacgctgaggcaggagaattgcttgagctcgggaggtggagattgcagtgagccaagattgcaccattgcactccagcctgggtgacagagctggactctgtctcaaaaaaaaaaagtatgttagtggatcaataactgcctggtggtttttggaagcctttttcatgtccctatggctcagccaaagccacttgtgactctggaatgctctgggccaggaaggaaaccccaggggtgggggagatggggagagagttaggtggtaagtcccaggttccggaggg

SEQ ID NO: 77662 - DNA, 1840 bp, Homo sapiens
ggagggatgaggaaacagaggctccgggagtctataggacctgcacagccagctagagggctttcttgagtccactcctgaggcctttgcgctgagaatgtggcttcccttgtttatttgcccaggttaggctggggcttccaggaggctacagaagcacaagaatgtctgtgagtttctcatcctccagagacttggaggccagctgggctgacttggcttgcaagaaacgtgtttctggagcagtctcagaccttggtatcccaccagggacccttttgtcccaataccttagaagggactgaggagttcattaatgttcacgtttatgaccacccttggtaggtagcccaggcctgcatctgctctcatgggtctgggagtttggtgtcaacagtaaactggcttgggaggcgtgccagtgagagtgtagcatgccaccgggcctgtcccttccccttgggccctacatttgttcctttaaaatagggccatctccaaggtccttttctacagggatggcttagcattctggtctggaattctttcgggagattctctgcagggaggaaggaggatcttttccaggattaagtgatgctggtctgtgggtgggtatttttttatttgttttaatgtctggatttgccaccatttcgggggtgcagaggtgggaagaggtgctgacttaggttttctttgcagcagtgcacagggagtattcataacccagccttgcaaatgaacactttctaccagcctcctggggagcaaacagaacttcacataggaggaagcgtccgtgtgcacatggatctattgaagggactgcctcagtttcaggcctgactccacgactgactgcctatgtgccccatgaccctcgacacattccctacccctctgtgcctcactttcctcatctgtgagggtaataatttagcttagggttgcgagcatcaaatgagggaatttgctaaagggtccaggatagtgcctggaattctgtcagtggcggcggccgctgctgtcgtcgtccctgtggagtgagtgagtgggtctctgcccatggatgcctctctattcagggacctttggcctttgtagatttagtgttcttggttttggcagtttgcaagtcaccctgaaggccacgatggctgaactgatcatcttgcagggatgtgggtttgaggatttgaaactgttcagtgggcatagctaaggagggggcccaggcttgcctggtggcctttcagcatcacagcggggttctgttctccttcagcacatggcccatctgaatattacagccccccaggaggtggaggtgctgtccccacctactttatggatggggaagctgagaaatttatgttaagatgctacttgtatttttttaagtttggagattgagaagagtttgttctggatttcctgaaaatgccaagtctccactggtaatcttgttactattactagctaacatttattgttttctgtatctttttgaatatttaagacatgcacatattaaaaaaaattcagaggactcaaagtatacaatgaaacgtcagccctgttcgcttctcattgctgagttccagttccctggggcagtctgtctctataggtgtttatgcacactcaggggcgcgtgcacgtgtaggtctctccatatgtattactgttgtgctcttgcacattgcatgggactgtgtgtcttggagaaactccacatcgctgcttcatttggagaaagttttgtatcattacctctttttttttaaacagctgtgtggtccagttcttaaaaggatggaacatgtttcttccgctg

SEQ ID NO: 77663 - DNA, 2517 bp, Homo sapiens
tactgagggttgcggagggacctgggaaatcggggcatccacgctgtggggtaagggcttgagggtacttttggaccggagtgtttttcttccttcgtccccttccctttcatgaagaaagggcacccacgtttgtggaccacctactatgtgccccgcgtgtgctcggctcttgaggctgtcattgcatatcatgaggttaagcccagttgaagcgagtagcaattcttggcatgtatgtggtgatttgctgtctcattagagcctcgcagcagccctgcaaattggccagggtggtgattctgggccacctgtctgagaacggggaccgatcggcagaggagcggggtacctagcttggggtcccgcagctagggagtggctggtgcgtagaaagtgctgggtaaatgcccgtggtgtggagtggccttctgccatctgggctgtgtgcccctgctcccaccatgctggtgctccttggcggagtctccggtgtttaacagatcacgttcttaataaattacagaactactgagtcttgggtcaggtaggccttcccttgctccacaactgtagctttgcctctgagaagcagttaagcccttttctcaatgcaagcctaagagaatctagctctgaaagccttttgcaaactccaggtggaaaccttttgtgatgcagcttgttagactgatttttgaaaatgggctctacttgcatttttgtccctgtgggggccccacacatcttggagaattgaacagttgggtttccgtaacccctggtgctcctgggggcccgtggctggtctgagctggcatgcgcaggtgagcctggcagcacctctgtgtgcctcatgcctttcccaagggcctgctgctcctttgccccgtgcaagccccgcaggcgctcttcctgcagccagaggggcacagcttgtacaggatagtgcctggttctttatcccttggtctggggatggggttggctgccttctcccaggccggtttccctagaagacaggctcttcatgatcaatagggcatgcagagtggccccagcaattcatgaagaaatcaggaggagctcgaagccagagctttgaaaatgagtcttaggacccttggaacattacaaaagggtacttgaacgttgtaccgcggatacactcacttgtgggaagggcattctaagacactaaagaaatttggagcagctgctttggcatgttctcgaagtccagttctgatgtgaggcaccggagctccccctgcagtcatgtaagacttgggaaatcccagcgaatacctcgcaccctttgtactgctgtctgtatttatgtcatcttgtgtctgcaactcaagcttgaggcttgtcattgggttggcttgttttgcttggtaattaggaggctctcgcaaaatattcttcgccgagactcacaactaggtcctcgtgctggacctgcagattggcttgaccttgtagacattcttcctttaaaggggtgggaggttcagagcaagctatgctatcaacgttctggggagtagagcattactttctctgaaagagttgttgtcttcaaagtctagttgccttcctttggccaaaatattggcttcaaagaaggcagaagtcatcagggccattctagaacccgaggaagcccactttgtgttttcactagggaagctttagatattttatcacttaagcctaagaaggaaaagaaaacaccaaagagtttttccgtttcttatttattactttcagggcagtgccccctggtggccacatttctatactggctgcaaaatgctgcaactgttgagccagtgaccagggagccccgtgaggttgttttgtttggtgtgagggccaatgagactttagtggctgagagacagtgcaaaggacattatcatgttttccacattcagaatctgggggcgcagggcttctgtactgacgacgggtgatgaattgtctatgaattccctaatgaaaaagtctaaaggtatttgaaaatggccctgctttgggccgggtgccgtgtcttctgtctgtaatcccagcactttgggagtccaaggtgggtgggtcacgaggtcaggagatcgagaccatcctggctaacatggtgaaaccccatctctactaaaaatacaaaaattagccgggcatgatggcaggcgcctgtagtcccagctactcaggaggctgaggcaggagaatcacttgaacccgggaggcagaggttgcagtaagtcgagatggtgccactgcactctagcttgggtgacagagcgagactccatctcaaaaaaaaaaaaaaaaaaaatggccctgctcttaatgtttgggcaaagaatgacccgaatggtccggcccggggtgggttgtttagctgaatgtccggccttgtaaaaatctgatctcagagcaggaagagatgttggccatcatctcatctagcccctttgtcttacagatggggaaacccatcaagagagg

SEQ ID NO: 77664 - DNA, 1276 bp, Homo sapiens
cagcgctcctcagccttgccccctggtgcccgctcgcgactgtcatcgccccatcacttctcgttgcagacagtaccacaggcacctggagtaccggcatcggtcgctgtggcccccgagtgtccgtcagagcctaggggagcctgccctcccgcgcctcgtcggggcccggccaggcaccttggccgccggcgcacggacgcgggcacgagcactagatcacggtgagtggaagcgggcccgacgcggccctgcaggcccgacatccgccaggcaccagggctgggaggggtgaggggcgcgcgccgcagtgcggctgccctggcgtcgccgctgggggcagggcgcgcggggcttggggcctgcacgcttgccctggacgttggcacctttagctaacctgtctgctctgtcttgcaggctgctggacctcggcacgttgacaagatttctctggggtaccgcggaggattactttgaatttcggtggtcgcctgtggtctggcatatttagaacttaagtctattatttcgggcaccatgactttgaggcttttagaagactggtgcagggggatggacatgaaccctcggaaagcgctattgattgccggcatctcccagagctgcagtgtggcagaaatcgaggaggctctgcaggctggtttagctcccttgggggagtacagactgcttggaaggatgttcaggagggatgagaacaggaaagtagccttagtagggcttactgcggagactagtcacgccctggtccctaaggagataccgggaaaagggggtatctggagagtgatctttaagccccctgacccagataatacatttttaagcagattaaatgaatttttagcgggagagggcatgacagtgggtgagttgagcagagctcttggacatgaaaatggctccttagacccagagcagggcatgatcccggaaatgtgggcccctatgttggcacaggcattagaggctcttcagcctgccctgcaatgcttgaagtataaaaagctgagagtgttctcgggcagggagtctccagaaccaggagaagaagaatttggacgctggatgtttcatactactcagatgataaaggcgtggcaggtgccagatgtagagaagagaaggcgattgctagagagccttcgaggcccagcacttgatgttattcgtgtcctcaagataaacaatcctttaattactgtcgatgaatgtctgcaggctcttgaggaggtatttggggttacagata

SEQ ID NO: 77665 - DNA, 2619 bp, Homo sapiens
ccggcgaccgctgacgggcgctgggctcgcggcgctgcaaggcggcgaggcccgggcctggcgccgcctgcgcagccttggtcgcggcgtgccggcgctgcagcgcggcagggggcggggccggccgcccggaggcccaagtggcggggacgcctccctgccgggtcaggttctcagagcgggtctccggcggcggcgacgggggccgggccgcgcgtgacccgccgcagtcacgccgttcttaatcactagtagctggtgctccaggctggcggcgctcacctttctcctagccgggtgacccaggggatttattttatgttggctttctctgaaatgccaaagccacccgattattcagagctgagtgactctttaacgcttgccgtgggaacaggaagattttcgggaccattgtaagtgcttaggagttactgtcttaacttgggggcttgacttgtagcaccccgcgttcacgtctgaagcagtactgttatgccagaaagtgtttcacctgtcaaagtgaaatgtgctgtgagaaactagtttaattccagtttctggagggcgggtattatggacctgtttaagtaggatgcagtgatttattctgagggattcccgttaaaaagcagaactcagtatatactgaaatcaatggttttttgtttttttgtgtgtgttgttttacttgattgtaagtattacacaaaacaacctgtaagttttacatttcttaataggtgtttaatttaattattttaaatcttaagtgtgttagtgggatattttagaattctttttttttttttttaattagacagagtctcgctctgtcgcccaggctggagtgcagtggcgtgatctcggctctctgcaagctctgcctcctgggttcacgccattctcctgcctcagcctcccgagtagctgggactacaggtgcccgccaccacgcccggctattttttttgtatttttagtagagacgggatttcaccatgttagccaggatggtctctatcacctgacctcgtgatccacccgcctcagcctcccaaagtgctgggattacaggcgcgagccaccgcgcccggcctagaattcttggagataaagcaagtacatttggagtagttgccgtgacagcattactagaccctaattgtattttcttttttaatttgaaggcacagagcatggagaatgatgaacttccgtcagcggatgggatggattggagtgggattgtatctgttagccagtgcagcagcattttactatgtttttgaaatcagtgagacttacaacaggctggccttggaacacattcaacagcaccctgaggagccccttgaaggaaccacatggacacactccttgaaagctcaattactctccttgcctttttgggtgtggacagttatttttctggtaccttacttacagatgtttttgttcctatactcttgtacaagagctgatcccaaaacagtgggctactgtatcatccctatatgcttggcagttatttgcaatcgccaccaggcatttgtcaaggcttctaatcagatcagcagactacaactgattgacacgtaaaatcagtcaccgttttttccctacgattacaaaactgccagtcctatatggagtctgatcacaagactgcagtttcttcacagatctcaggaagttgtcgtggggcagaggctttttaaaaacatgtgattagggagctatctttatctgaataataacgaatttttaggtaaaacctgagatagagtactacaaaatcatgttgatgacttcagattttggaagttaaatcatgtctgttatttgcattctttagaaacttgactaagtacctgaattcatatttctattctactgtgcaacatagtgatgattcagaaatttttcctttggggaaaaaaatgaatatgaacatttccattgtgttaagtgtaaaaaggtccagacatgatcataaaatttaaattttatacaattacttggcttgctttaaaattcttcacacttaaaacaccgattcattctattgcagctaagccagctgtctagacttgctgtcagcttatgaggcattgctaaaaaattattgaggaaatggctgtcttgataagcagaatttgttcttcctcttggtaatggctaaattattattaatgcttttaatggttttattttttatatttttcttttttgtggagaatggggtctcgctatgttgcccaggcaggtctcgaactcctgggctcaagctttcctcctctctctggctccctaagtgctaggattacaggtgtgagctaccatgcccagctatttttaattaaaaaaattttttttttccatgacttgtgacacagtctcagaaggccctgagaacgtacgctccaatgctactgatttagaaaactatctgggaagaaactaagtgttaaatgttgaaaggctagaaataacttacaaatagaagatggaaacaatgtgttcaatgaaaatctagcaggttatttattatttatttaaattattattattatttttgagacggagccttgctttgtcacccaggatggagtgcag

SEQ ID NO: 77666 - DNA, 1032 bp, Homo sapiens
tagctcacacctgtaatcctagcacttagggagccagagagaggaggaaagcttgagcccaggagttcgagacctgcctgggcaacatagcgagaccccattctccacaaaaaagaaaaatataaaaaataaaaccattaaaagcattaataataatttagccattaccaagaggaagaacaaattctgcttatcaagacagccatttcctcaataattttttagcaatgcctcataagctgacagcaagtctagacagctggcttagctgcaatagaatgaatcggtgttttaagtgtgaagaattttaaagcaagccaagtaattgtataaaatttaaattttatgatcatgtctggacctttttacacttaacacaatggaaatgttcatattcatttttttccccaaaggaaaaatttctgaatcatcactatgttgcacagtagaatagaaatatgaattcaggtacttagtcaagtttctaaagaatgcaaataacagacatgatttaacttccaaaatctgaagtcatcaacatgattttgtagtactctatctcaggttttacctaaaaattcgttattattcagataaagatagctccctaatcacatgtttttaaaaagcctctgccccacgacaacttcctgagatctgtgaagaaactgcagtcttgtgatcagactccatataggactggcagttttgtaatcgtagggaaaaaacggtgactgattttacgtgtcaatcagttgtagtctgctgatctgattagaagccttgacaaatgcctggtggcgattgcaaataactgccaagcatatagggatgatacagtagcccactgttttgggatcagctcttgtacaagagtataggaacaaaaacatctgtaagtaaggtaccagaaaaataactgtccacacccaaaaaggcaaggagagtaattgagctttcaaggagtgtgtccatgtggttccttcaaggggctcctcagggtgctgttgaatgtgttccaaggccagcctg

SEQ ID NO: 77667 - DNA, 1047 bp, Homo sapiens
gcccaggagttctagacaagcctggacaacagagcaagaccttgtttcaaaaaagaaaacaagaaaaagaatgataatgcaacttccagagagtaggagagctgggctaaatatgaaataagataccataaaaaaggagccaccttggccaggcacagtggctcacacctgtaatcccagcaccttgggaggctaagaaataagatgccataaaaaaagagaagaggtatttctgaaactgatgtgcctaaccttgaaaacaatggccctatagccagtgtgttattttcaaagtataaaatgaatttcacaatgttgctataagtactccacttctcaggtgacctttgagatcagaattgctctatttaaagacatggcccaggaaactgaagttagacagtaagcttctatttaaatcttttaaaaagtagcagctgacattgggatagtaacaggccatagggtgcagttttaaatagagatttattccaatgcaaaaaattctactggggatagaagtaacttctagaaacagtagtttaaatgagtgctttatgagtccaagatattgaacaccagagtactggaattgtgtgctgtagctctaagagttgtgacacttggccaggcatggtggctcacacctgtaatcccggcaccttgggaggctgaggcagaaggattgcttgagccccaggagcttgaaaccagcctgggcaacatagcaagaccccatctcttaaaaaaaaaagagctgtgatacttgctgcatgttaggtggtttaaaaaaccattatcttcatgattgtagcttgagaatttctcagggactctaaccaccacttaaaccttatttgtgaatgtgtttttctctgcatcagtaaagaaaattggccaggcatggtggttcacatctgtaatcccagcactttgagtggccaaggtgggcagatcgcttgaacccagggctctgagaccagcctggcaacgtggtgaaaccctatctctaaaaataaaaacaaaaaataaagaaaattccaagac

SEQ ID NO: 77668 - DNA, 1004 bp, Homo sapiens
gttttcttgagaaataaatttcagaccctggaaggaaaatagaacacttcataatgtataaaatcctctaagttggcaactgaatttttatcattgttttctatttttaaaataatcattgatttgtgtgatgtctacatcttttaacttctggttctgttataaagagtacatgtcacggttcataggcagtaacatttcagagaactgacatgaacaagtagtgaaaattgggcattaaatataaaaataacagttcttcataaacagaaggaaaataaggaaatagaaataccgacgagaaaggagagtccttgaaagagacccaaggaaaccctgaattcatacccacgtcaaatatgcacatatcctgagatgatgccactttgatgaatgtgcattagtctgatttatcatgtaccttaagagagccagatggggtatgtttttgtgctgtgatatggtatttatacaggtacaaatataaggccttaagtaaacaatctgcattgattacaatttggatatttcctctcctcctgtagccatactttgattttgctttaaaaagattattgaatccttttaaaaatatatattcctaaaatatgtatgtgtgtgtgtttcttttctgctcgtcagtgggactaaggcatttttatttgctgtgcatccttcctgatttagatagcttcaatgcaaagaaatcaagtagcatgtacctagtaaaatacaaatagtcatggaattttagagttggaagtcactttacaaattatgtgatttatttcagagataaatctaaggataagtatttgccctcagattacagagctaaccattgacaaactgggttacataaatagcctttagattttttttaagctgataaaaggtgagagaagatcaactttttttttctttttttttttttttttgagacagagtttcactcttgttgcccaggccggagtgcagtggcacaatcttggctcactgcaacc

SEQ ID NO: 77669 - DNA, 1835 bp, Homo sapiens
cactgcagcaccgtctcagagctcaccgtccaagtcctcgtctggagccgccgccacccggtgctgcacttccccctgtaccagagggtcgaataattccgttaccatgtccttcatctgggccacgccagacaacaggccctggaaagggtcgccgtcacccggcgcctcacaggacacccgcagcttctgcggcttcccttcctgcccgacgtactctcccagcagctccatggtgaccgctaagcttccagaacacgacaccgggaagcgccacccggaggcggaaatcagcccgcgtccggcgcaggcgggagaagggagaggagtgacatccgtttgtcggaagtcgctcctcccccttccttcgctttttttccttgtcattggttcctggcactcgggccccacctcctccggctacgcccctcacggccgcttttcccgcctccgccggggccgagccgctgttcggctgacagttgaggatggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcaggtgggcgcgcggcccgggcctcctctcccccggctcccgccgaacctccccttcccggcccggctgtccctattcccgccttgccgcagtcgtctccccagtggtggtccggggccgccgttagtctgccgcttcctcaccccaagctcacccttcccttttaaccccaacctcctgggcccccttcagcctgtgtccagcaggggcccccctctcccctgtctccaactctgtccggcccgccaggaagggccctggagcagctgctctgtccgtcctctccagcctcttcttggtgcaccactgcttttcacgaaaccaccccgcgacctctcagatccagacatctttgtccctgattttcccatcctaagattatttatttatttatttattagggaccgaatgggagagtcaggttaaagagattttcaaatccatagggcatttgcggtgagctccttgacagctagttcctctgcaatttagttggacaagtgctagctagtactttttctttctttctttttttggcaaaatgaagcaagtacccatgtctatctgcagtctgcccccctcccctggaaatagaccggaaacagaacagcaagtggctctggcaagggaggggagagaggagaaaaggatctgtttggcatttggaagacgttgtgagtgagcaagtgtttgagggggtgtgatgtggtgtttagtgactcaccctacacttcgaggtacaaaaatggaaaaggatgggtaggaagaagactgacaaaggatgagaattggtaggaagaagggttacctaggaagaggggtggattggaacactggggagatgaggggagagacttgtattcattatgtggtatgaactgagatcataataccagttctcgttgttgaccaaggttagtttacactgcaaagtgctagattgttgaataaacctggtatccagacatagccccaggtattttaaaacctttggtcaccactaaaacaatttttcccctgctttacttaaaaaaaaaaaaaagaaaaaagttatgtctatatgtaaactatttttgaagtgtagttacctttataaaatggattccttaatattttctttgtggtaaaaaaaaaaatacggaaatttgcacaaatcatgtacacagcttgaaaggaaagtgtgcgtgttcccacaaccca

SEQ ID NO: 77670 - DNA, 1021 bp, Homo sapiens
agacttcctatcactttaagaaagaagtgctggcttgtgtcgtggctaatgcttgtaatcccagcactttggaaggccaaggcagagaattgcttgagcccaggagtttgagaccagcctgggcaacatagcaagaccttatctctgcaaaaaataaataaggaagaaagaaaaaagtgcttgcatgaaaaaaagcactagtataaaaatgaaacttgcaacgcaactgtgttttggttgatgctctgttgtgtaaactttttagtcttaatggtttttacagaaagatcttgaccacagataatctgattttaattatttttcagttcctagtgtgggtattaggtaaaccatgctactacattaattctcttttccattttgggggctttcagggctcagtaaagagacaagcactatatgcctgtagtacctgcaccccagagggagaagaaccagcaggaatttgtttagcttgcagttatgaatgtcatggaagtcacaaactatttgagctatacacaaaaaggtaaacatagtcaagagattgttactaaatgcttttgaagtatagattctttcccatctacactttttcctaatcttgttttttcatgcaaagcagttgaacactaatgaaattaattaattaatttatttatttatttattttgagacggagtcttgctctgtcacccaggctggagtgcagtggtgtgatctaggctcactgcaagctccgtctcccgggttcacgccattctcctgcctcagcctcccgaatagctgggattaaaggctcccaccaccacgcccagctaattttttgtatttttagtagagacggtgtttcaccgagttagccaggatggtctcgatctcctgacctcgtgatccgcccgcctcagcctcccaaagtgctgggattacaggcgtgagccacctcgcccagcactaatgaaatttaatgtaattattttatataattggagagagttgtttctagagcctttaaaaacat

SEQ ID NO: 77671 - DNA, 1097 bp, Homo sapiens
aattattttttccctgtgtcctgaaaaaagtatccctttagtggtagtgagttttttttttcctactttgaaaattaaagatcagcctcttgggggaaataatgtggaaatgtattgaatgcataaattttataatgtgtgaaattatagttaaaattagaccatattattattgaaatcaatattatatttcaggacaaagcaaaggtaaattctggcaataagtacaatgacaacttttttggattgtactgcatttgcaagagaccttatcctgatcctgaagacgaggtaagagaattggaagttaaacctgggggtgtgtcccctctagccttgattcctcaactgcttgtcatatccgagcctctggctcttcaagaggcagtgtgggatggtgaaagggctctagatttatcttttcttatgaatctgggttggatctataattggtacacatctcaaccattcttttcatttttacatcataagaatgaaatattggagaggactttcccaaagccagagcttcttcccttcctctccttccctgactgcctcccccagtccccaaacactttctaagaaatgaccttcaacttcttttgtctctttacggaaaaaaatggggtatacaaacagcatcctcttaaaaacgtcaatgagaagtatatgcaaaattcaaaacgagttcttcctcacttctgcacctcttacctcccaggcataaccactgttaacacttttggtgtgtatatttttagtcctttttctgtgcacatagaagtgtttgagtgaatgtgtgtttcaatgtgtagtttcctttctattaacagaagtgaaaattctgtacactcacttctgcagctggcttttctcaccagtatatcatagacattctttcatgtcaacaaaacacacttacccccttctaactgctgcagagtatcctataatttcatatgccataagttagtcaacctgattgttcttctacagcagaatggcattgtgtaatttttcaatattataaagaaagctagagtgaacatcctcatacagtaatacaactgagtatactccaagtatttatgtag

SEQ ID NO: 77672 - DNA, 1042 bp, Homo sapiens
ttttgccattctgataaatgaagaatagtatcttttttttcattttttttttcagacggagtctcgctctgtcacccaggctggaatgcagtggcgcgatctcggctcactgcaagttccacctcccgggttcatgccattctcctgcctcagcctcctgagtagctgggactacaggtgcccgccaccacgcccagctaattttttgtaattttagtagagtcagggtttcaccgtgttagccaggatggtctcaatctcctgacctcatgatccgcctgcctcgggctcccaaagtgctgggattacaggcgtgagccaccgcgcccagccaaagaatagtatcttaaatttttttttctttccctgatgataagtgaggttatgcatcttttcataagttcattggacatccataataaccttctctctgaattgtcctttcatatcctcagtccatgttttgattggtttgggttttgtctgggtatttaccgatttgaaagagtactttttgtctttagagatattagtcttctgccttcttccttgctttctaattgcgttggaactataattattgaaccaaattatatagagggacagattgaaagtctctttgagttaacaaaaataaaaccttaaaactggattttttttttcttttttttaagacggagtttcgctctgtcacccaggctggagtacagtagtgcgatctcagctcactgcaacctctgcctcccaggtccaagcgattcttctgcctcagcctcctgagtagctgggattacaggcactcgccaccatgcccggctaatttgtgtatttttagtagagacaggatttcagcatgttggccaggctagtcttaaacttctgacctcaggcgatccacccaccttggccttccaaagtgctgggattataggcgtgagccaccacgcccagccaaaactggatattttaaggcatgtggtaaagtgttacagctcctcctgttccacaatatgtgcttttttattccctttaagaagcctac

SEQ ID NO: 77673 - DNA, 1704 bp, Homo sapiens
ctccttgtctacacagttttgtgagaatcagatattaagtaatggatgtgaaagagccttgagattgtttgtaaagtgcttatctcaatgtaagcctttggaacaccagttcatgtagaacaaatatttagtatcttattttactgtgtgccaggttatttccatgttcccgaattcaatgtaatccttaacaaactgcttttctctgttagattccagatgagatgatccagtgcgtagtctgtgaagactggttccatggaagggtaaggaaaatgttccaccttttgaaaccattgttgtcacaaaaagataaaggttatattttacattataattagtcttctaaaaataaattctaatgatatgatcagtgtattattacagtatttataaaataatgggcattttggacaatttggcaatcacaagaaaatttttggtgttctatattcacagcatcttggtgccattccccctgagagtggggattttcaggagatggtatgccaggcctgcatgaaacgttgttcttttttgtgggcttatgctgcacaattggcaggtaggtatctttgtgaagttggtgtgccacaaacttgtgcttgtgaaatttgtatgttcaattcagaatttttagcaactatttttaactgggctctgtggttataaaatagtatatgttctggccaggcatggtggctcacgcctgtaatcccagcactttgggaggccaacaagacagatggatcacctgaggtcaggagttcgagaccagcctggccaacatggcgaaaccccatctctactaaaaatatgaaaattagcctggcgtcacggcgcttgcctgtaatcccagctactccagaggctgaggcaggagaatcacttgaacccaggaggcagaggttgcagtgagccgagatcacgtcactgcagtccagcctgggcaatagaacaagactccatcctcaaaaaaaaaaaaaaaaaaaaagaatagtatgtgttctttctccacaaggtgcatagatttgttgggatactaccaaaaacaaatttatacttaaatgatatgatgcagagtattgatgagaccagagttagagaatggaggaggcagtttttgaatgggattttgaaagataaatagaactgaaataagttgttaattctaacacatggtatcagttggggaggaggtggtgtcttagtctgtctggggtgctaaaacaaaataccttaggctgggtaatttataaacaatagacagatatttctcacagttctggagactgggaagtccaaaattcaggtgcccgcagagtcagtgtttggttgagggcccattcctcatagacagatccttctacgtgtccgtacctgttaaaaggggcaaacaagctcgcttgggcctcttttataagtcagagccctcgtgaatgggattagtgcctttataaaagtggactacaggcacacactaccatgccctgctaattttgtattttctgtagagacagtgtttcaccatgttgcccaggctggtcttgaactcctgagctcaagtgatccactcatcttggcttcccagactgctgggattacaggcatgagccaccatgcccagtctatctggtgcttttattatacactaagaaattaaatcaaaacaactaattaatgaatggtcctgaggcattaact

SEQ ID NO: 77674 - DNA, 1778 bp, Homo sapiens
tcacgccattgcactccagcctgggcaacaagagcgaaactctatctcaaaaaaaaaaaaaaaatagcaaaagctattgtatgcctgatgtggtggctcacacctgtaatcccagcactttgggaggctgaggcaggcagatcacttgacatcaggagttcaagaccagcctggccaacatggcgaaaccccgtctctactaaaaatacaaaaaattagccagtcatggtggcacgcacctgtagtcccagctactcgggtggctgaggcatgagaattgcttgaacctgggagacagaggttgcagtgagtcaagaccatgccactgcactccagtgtggacgacagagtgagactctgtctgtaaaaaaaaaaaataataataatagaataagtgattttattgtctgttgggattttattgtccgttaggtcagtggatatgtgtgtatgtgtttttctttttctttgaactcacagtaaccaaaatatccactgaggatgatggattggtgcggaacattgatggaataggtgatcaggaagttatcaaacctgaaaatggagagcatcaagatagtaccctcaaagaggatgttccagaacagggaaaggatgatgtccgggaggttaaagtagagcagaacagtgaaccatgtgccggctctagttctgaatctgatctccaggtaatgtgtgaagtacgagccatcaagaaataagactgggccaggcgcggtggctcatgcccataatcccagcactttgggaggctgaggtggcggatcacctgaggtcacgggtttgagaccagccttggcaacatgggtaaacctcatctctactaaaattacaaaaactagccaggcatggtggcacatgcctgtaatcccagctactcaggaggctgaggcaggagaattgcttgaacccaggaggcggaggttacagtgatccgagatcatgccactgcactctagcctgggcaacagaatgagattccgtctcaaaaaaaaaaaagaaaactgaagtggaattaattctgtaaacttatggctttggatttcaattttatcctttgcctaaagaaatctctttacaaaatctaaactatgaaaactatggtagtttaaaaaacatgcttcaaaacttaattttatttcagacagtgtttaagaatgaaagcctcaacgcagaatcaaaatctggctgcaaacttcaggagcttaaagctaagcagcttataaagaaagacactgccacctattggcccctgaactggcgtagcaagttgtgtacctgccaagactgtatggtaaagtatctgattgtgctcagtgttagcatgttttgtgtactggtgccccaaaataagaacacctggggaaaacattcaatttttgtaccagaggaagaaaggaaaataaaaagaacacctgaacaatatatttatgaaattaatgtttaggagaccctccaaatttttacattaagcaaatttatgacatagtacttacagttggaatgtttgtggaagaaatggataattatgcagtattttaaatttacttattttaattttagtttacttatctttgttatatcaaagttgcttggaaacactggttgaaagttatagtaaattggccaggtgctttggctcacgcctgtaatcccagcactctgggaggccaagttaggtctcgatcacctgaggtcaggagttcgagaccagcctgaccaacatggtgaaatcctgtctgtactaaaaatacaaa

SEQ ID NO: 77675 - DNA, 1034 bp, Homo sapiens
gggtttgggggtattttctcctctagtggtttcctgtgaaccactgaagcaacctcaagaactgtcaaaatggtgacatgccttgctcaagaacatgacacataatgtccaaaaattgtttcaatggatggaaaatttgcattcatccatctacccttaatcagaatagcatatgttgtggtttctcaagcatgtaattattctagcatgtaactctgattcaatggtaaaagcagctgaatacccaccaatatgaaaatcaagcaatggtctaaaattcaaaattttaattctttgtattaaattaaaaatataggtgtttactgccccctttatatttttttacatagtgaaggaaatgatgaattttcacacacacacagtatttaccacaaatgagttccacttgctggactctattcatgctgctaagggtatccattaggggatcgctcctgtcagtggcctgggcaatcttccctttgttttcataagccagaactgtgtcgtattcatctgtcaggaataagacatctagatctccatacattttctttagggaaaaaaaaaaaaaaaaaagaaagaggagtttccccattagaactgtttatcattctcagaaagccaatttcctgagaatcactaaaaatgtaatttttttatattaagacctagaaaaactggagcgtctttaacacagaattgctagaaggatttattctttttgcctaaatttctttcagaaatctcccaatttcccagatgtcatatggtctatgagatctttatttaaaaaccattgatttactgttaactttttttttttttgagatggagtttcactcgttgcccaggctggagtgcaatggcatgatctcgactcattgcaacctccgccttctgggttcaagcgattctcctgccttggcctcccaaggagctgggattacaggcatgtgccaccacacccagctaattttgtatttttagtacagacaggatttcaccatgttggtcaggctggtctcgaactc

SEQ ID NO: 77676 - DNA, 1050 bp, Homo sapiens
ctgtctctactaaaaatataaaaaagtagccaggcatggtggcgcgtgcctgtagtcccagctactcgggaggcggaggttgcagtgagccgagatcgtgccactgcattccagcctgggtgacagagtgagactccatctcaaaaaataaaataaattaaattaaattaaatattcaacaagtccaaggttatttcagctaccagaattccagagaaataggaagcccttttaaaaattcttaatctttatgggattaggatatctctgctttttatgctttttaaaaaattttgctttttttttttttaatgaaaaagggtctcatatcaacatggtagacgtacagataatttgggaacgagtttctatgcagctttcacttaagaaaatttttatttagactacattattaacagactcaggtgtcaatggcaaagaatattttgtttttgaaagcaaatggtttatctaaacttaaatacttttgtggttttgatttagaatacaatgatttgaagactgaacttaaagactatctcaagagatttgctgatgaaggcacggtatgttgagttaaagaattctaatcatagccctgtaagttttgaatgaagggtttatttcctttgacgattaaaaatgactgcgactggcggggtgcggtggctcacacctgtaatcccagtactttgggaggccaatgtgggtggatcacaaggtcaggagttcaagaccagcctagccaatatggtgaaaccccatctctactaaaaatacgaaaattagccaggcgtggtgatgggcgcctgtagtcccagctactagggaggctgaggcaggagactcacttgaacccaggaggcggaggttgtagtgagccgagaacacgccactgcaccccagcctgggcgacagagcaagaccctatttcaaaaaaaaaaaaatgactgcgacttaagtgggtacttgagagttgaattcagggactgttttgagcaaattggcaggctaaggggaatgaataagaggtagtgaaacatcagagtt

SEQ ID NO: 77677 - DNA, 2650 bp, Homo sapiens
aaatttaaaaattagccaggcgtaggctgggcacggtggctcacgcctgtaatcccagcactttgggaggccgaggcaggcggatcatgaggtcaggagatcgagaccatcctggctaacacggtgaaaccccgtctctactaaaaatacaaaaaaaaattagccgggcttggtggcgggcgcctgtagtcccagctactcgggaggctgaggcaggagaatggtgttaacccgggaggcagagcttgcagtgagccgagatcgtgccactgcactccagcctgggtgacagagcgacactccatctcaaaaaaaaaaaaaaaaaaaaatagaaaatggagatgttatcattaacataattcttaacagtatcatttgacttgtttgtgaatgctatgacctcggattgcgattctgttacttagttctctttcataatctttgcttttcaaaaacaggttgttaagagagaggacattcagcagttctttgaagagtttcagtcaaaaaagagaagaagagtggatgggatgcagtattactgcagctagagtggagtatgaagctttctcattcaagccaatgaaaatgcgcttcccattcttggaataaaagaggtgtggttcacatttggccccctttccgtcctcctctgtttggagaggcctcgcgctcccttcattctctttagctgcagtagccaccgtgtggatgctgacttcacagccagcgtcctctgtgactcagctgatgcagctcattccacagacttctccagtgtactcctactccagtgcacccagggttatttgcatagtttttaagtttgattttgttttgagaaagcaaattggtgtcttgtttaatgatctgttatttcactcccagatgtgtgtgttttgccacagagctgttgccttccagaacctcctccgcaggcatcacggaaggctctcttcccgtcacctagaacctctacaggtcccctcgcccctatgatcgtggtgccttgggtcaaagcttcctcaagcctggtctgctccttctttcacgtccctgttttctgaggtttggtcatagcttagaaaggatcttggggcttgttttctctaggcccaacctccagagtagccaggactgatggttttctggtctggatgtctgtcacaggcggagagattaacagatgacagggttgaggaagcaagcctttgttatgaattttactaatacagttcaagtgaaattttcgttcatgattctattggcactagaattagaatttcagtactgtagtgctcacagggcttcctggagaacatttgcccgtatactagtcccttctctgctgcctagaaaacagaccgggtctcacccctgtgaaatcttggtggtttacgaagtcctctggatttcttgatattatcagggatattcataagcatatatcaaaaatggacctattttgatattctgttatgaaaatgttattagaaccccaataaattattatttttcccccttgaatctgctaaagaaaacagatcctgacttagcttacttgaaataagcagggcagggagccctgttttggaagagacagactgtggaagagattacaaacaaggcccgaggctgcacgaatgatgagttttgtgtatataatgttaatgtccaccgccacttccctaacgactatgagatcttttttttgaagatcctcatggaaggttgtacagagccccacatttgaggggaagtcctttcagttgatatgagatctctttaacacccctcagtctatgtaggaaatgccttgtgatacatagagaaccctcagcttctctctgcctctggaggaccaaggtctttcctgacagtcggagacacaccttgatgtatgttaataaaagcatttcaggctgtggggccaccatgtatattaatactccttatgtgtccagcatctgtgtattcattcgagtgcccaatccctggatgagatgaactaggccttataaaaagtcaaagcctcaaagaaatggcacaaccatgttcttcggcactcaggctcctaattgcagatcctcacgaagggtggtatgtggagctggaaggtcttgtggccacaggacatgctggtgagccctgagctggccttgtgcagagggctccgttcaaaggctcggggtgtctttgaggttgtttatcaagctggggaactcttccaagtctgacaatgtttcgaaccctttttgcaaggttgcactattagtataccatcatgtccggaaaacttttaatcttctcaaatatctgatgtaactaccagaaagtcccttacttcctatgaccaatcaggaccaagtcttggaggtgatgtgttacattacgtgcagcacaatagtaccgatcagttaactcagcgctgaagggcttgttttatgaaaggtactattccttctttcacattaactggaaacctctttttttacctgttgttcacaactagttttcttattgactgtattggactgtctcttcttgtagagactgattttggccaacatattaatgcatgttttatgcaaaacacaaatatgatattagttgcttttaaggagttctggcattgtatgtgcatttttgt

SEQ ID NO: 77678 - DNA, 1271 bp, Homo sapiens
gaaggcaaattggaaacacgcgccagcggcagtggggctcaaagccgacctccatgcatcattctctagagttgaaaggattgacatttctcagtaactacccggcaaaatatatattttcataatgttgaatttgccttttaggaaaacaatgtttcatgaaacacttgtaagatacttattttgaaattaattataaggcattcatatttttaggactgaattcaaagggaaatgcttctttgactttttttcattgttcggttgactttcagctttctggagtgacaaagcagcagtgatgggtgctattcctggttctgtggtggtttactttgtctactaagtgatttactttcaaacctcattacagataatcttactaaaagacttaacatgcacactgctaaaaggtgttttactgttttccattaacgctgttgtatgaacaatatttggtgacatgttgtctttttgtcctgtagattgtcatatctgttatgtagttatccttttggcaagtcctttgatttttttttcctctagaaaatcctcagactgtcaatcttccatattttgaatattataatgctgtggccatttctatagaaagattacttgcaagtgtgtgtcttgaaaataacctcttgtatttgtgtgtttatgtgagttctgtctaagagatcagataagctctggaagcttcatcatctgtacctacatgtaactgtatctgggttacatgggcaggcggtaccaagtcctgctcttcgatggggtggctgagagataaaggttcctgaactctccttgctgtgtatgcaccacatctgtacttcagagaggtggaaaatcatctacaacactgcgtttcttgtggttgtgctgttactggtataaagtcaagtgccttcaatgctaaaggctcagaaatttttcttaaactgatttcatgtcctatgcaagtgttttctacaacctgcataaccagtactttgtaaaacttgtttacgcttcaattgtacatagtgatttttaaagaaatatatagtatttttatttaggtacctccaaacttgaattcgtctgtgtgaagcattgtaaaacgatacatttctcttttgagtaccattacagttgtacagaggttttcactgcttctatttttctactgttactgataagcatgtaacactgactttatcctacatatagttggcatttcaaataaatggcttgtatagaatctgctgagttggatacagtctgtt

SEQ ID NO: 77679 - DNA, 1102 bp, Homo sapiens
gttttacaaagtactggttatgcaggttgtagaaaacacttgcataggacatgaaatcagtttaagaaaaatttctgagcctttagcattgaaggcacttgactttataccagtaacagcacaaccacaagaaacgcagtgttgtagatgattttccacctctctgaagtacagatgtggtgcatacacagcaaggagagttcaggaacctttatctctcagccaccccatcgaagagcaggacttggtaccgcctgcccatgtaacccagatacagttacatgtaggtacagatgatgaagcttccagagcttatctgatctcttagacagaactcacataaacacacaaatacaagaggttattttcaagacacacacttgcaagtaatctttctatagaaatggccacagcattataatattcaaaatatggaagattgacagtctgaggattttctagaggaaaaaaaaatcaaaggacttgccaaaaggataactacataacagatatgacaatctacaggacaaaaagacaacatgtcaccaaatattgttcatacaacagcgttaatggaaaacagtaaaacaccttttagcagtgtgcatgttaagtcttttagtaagattatctgtaatgaggtttgaaagtaaatcacttagtagacaaagtaaaccaccacagaaccaggaatagcacccatcactgctgctttgtcactccagaaagctgaaagtcaaccgaacaatgaaaaaaagtcaaagaagcatttccctttgaattcagtcctaaaaatatgaatgccttataattaatttcaaaataagtatcttacaagtgtttcatgaaacattgttttcctaaaaggcaaattcaacattatgaaaatatatattttgccgggtagttactgagaaatgtcaatcctttcaactctagagaatgatgcatggaggtcggctttgagccccactgccgctggcgcgtgtttccaatttgccttctgcatcggcaccttaatgcagatgtacaaggactaagctcattgctagaatggcaacaacaaaccaaaacaaaaatccaatgaaggatggcagatgca

SEQ ID NO: 77680 - DNA, 2134 bp, Homo sapiens
agagaagtaacttaaaggtcacactgacagaatttctggttctgagcgtcaactctccagctgtgatggcggaactgactgcttgctgcctttaattgtcttgctctctatgggaaaaaaacaaaagggcttcagtctcatggatgttatttggtgtttgtaaagatacgttttcttttaaacgattttcaaaatatgtctaaattttggtgttgtgtaatgcataatgctttctcaccaacagaaaaaaggaaaaaaattgttttcagttaaacactacatgtcctacttgaactccactgggacgctggtttggcatttactaaaccactgagcacatggggtctttcaggatcctctcccttggaagggcaatgtgtgagctaaggactgttttttttcttactctccaatgtaaatatatgagtatttgagtttttaaatcacttcaacattatttgagcatttactttgtatttttacaaacacataaacacacagccgtagcacttagaagaaaagaggctttctaagcattccttcctctgcaggatatttgggatcctcttttctatgtatgtatatatataaaaaactatgaatcactcacactcactcgaaaactatgcagggctagggagcgtttatgagctaccgggtaaatgaattacatgcactttgaagtaaataggttttctattgggtgtcaacaacgctgatttctcccaaaactatagtttctcttacggtcttttcctcctttaccctgtggatatacactcaggaataatctgacattttagaaaagccgaacagtagatagtctccaagatgggaaacatgtcgtgtgtctgcacgccccggcaaactgccgccactcgttctgctgcctgactggttagctgctgtgcgggtgcgctcggtgacactggtggtggtgcacgctcccgagctcccagagttaacactaatctgcaggtcggctgtgcatcgcattcgaggctccttttttaaagagaaaagcataggcctctgttctcatttgtaagaagtttgactcataatagaagacggtgtcttttgaagcccagtctctgtctgtcttcagaaacaaaagtgaatgccgtcatgttccttgatgtgtgtttctgccacatatgtatgttgacatgttcatgtactgcgccggtactgcaagtaagactcaacagacctaatttggatggggagaaaaactctcatccctgacccttccccccccgcaaatgttagaccagagctgttgatcccacacattcatttttctgaaaattcatgaactattctctcatatccctgaaatataaaagtaagtggccactattcctaagattatttagtttataaagtttgcttttaatcatacaatagcttacctggctaaaactttgcgtataaagggaaaacttgctttaatctgtgggattgcggaccgatgcgacttgcagaaggtaaacaggcgtgggttttgtgtgcgttaggttaggtgttagtggacttttaatgtatcttgtgaagtatggttactagggtaggttcaagagctacatgcctctggcttttgaacccatctattaaatcttttttaatgctgtactaagataaatgtgaagtctgagtaaggttgctctcagaaaaaaaaaaaaagcatatatatatataaaataaaatttaggccatgggaactggcattttacttggtataggaatttaatgagaaccaaatcacaaaaataccagatctccttttgagatcgtggacaatcaggcctttggacaatcaccgcttccagtgcccgctgtgcgttgaggttagagacctaccgtttacacgctagagccgagaggacgttcaagtttcttaaagatgctgttggtcttttttcttatgttattgttttagttttgtgattttgatgaataattgaagttcagagtcacccgtggctcctaaggaaaaaacagcatcatgaaaggcaaaaagtatttgaaacgtaattgtttcaattttccacgcccgttctcacatgccccctttagctttatttctgggaacatgtcactagacctcagctagcctgacaccgcaataacc

SEQ ID NO: 77681 - DNA, 1074 bp, Homo sapiens
ttagagtttggttttattaccagtttttgcattatcacataatctgagatgagtgacctgcttgaggagcattcgatcaagcagctttctttcatggctgtgtcctaggctgcactctgtgcctttgtactataactaaggtgatttttttcttgggcttctggcctagaaaaatatattatgctttttattcttgctgactgtggttttcttaagtacctcacttaattctctcagcctataaatttccacttatgaaatctgctaataaatgtcctttttttttttttttaatcttttttagaatcctcacaaattctttcctgatgaacgttttggggatgaaagtccactcttgacaatgagacagcctgggagatgtcgcgtaaacagtacacctcctgcagaaaccatgtttacagatctggactcttttgtggccttccatccacccttgccccctccaccacctccctaccaccccccagctaccccaatccataaccaactcaaagcaggctggaagcaaagacctcccagtcagcacccttcacgttcattttcttatccctgtaatcattcgctgttccactccagaacagctcctaaagctggccctcccccagtctacttgccgagtgtgaaagctgcaccgcctgattgtaccagcactgcaggactgggcagacagacggtggctgctgctgccgccaccaccacctcaacagcaacagcagcagcagcagcagcatctgagaagcaagtggtaagtcaacacttcagtaacttgcttcaaattcggtttatggagaattagaagcaattttcttggccccaagagccccactgggactcagcagtgcccagaagtattgctgacaagtggaaggcatagacttgaggggtatggaaaagagggaaaaacgctagtgtacttgaatgagaaaagacaggaggagagagaccaagaggtgtatatggaggagttgagtatcttcttatctttatgttcatttggcaggattaggaaggaatggggttactgagcaacataaaggaatataccagtttcat

SEQ ID NO: 77682 - DNA, 1071 bp, Homo sapiens
atttgaggtatttcaccgggcacggtggctcacgcctgtaatcccagcactttgggaggccgaggtgggcagatcacgaggtcaggagttccagaccagcctgaccaacatggtgaaaccccgtctctactaaaagtacaaaaaattagccaggcgtggtggtgagtgcctgtaatcccagctactcgggaggctgaggcaggagaatcgcttgaatccaggagacggaggttgcagtgagccaagatcacgccactgcactccagccggggcgacagtgagactctgtctcaaaaaaaaaaaaatttgaggtatttctaaatttcatatacatttctaaatttttatttaaatgataaagtttgcatatttttatttatagttataaatatttttatttatcttagtagtattatagtactacacagatttctatctaaaaaaaaaatttttttttagatgaaaagaggcttgattagtactcctccatcagatatgcttcctacaacagaaggtgggaagtcaaatgcctggttacggcaaaaaaatgctggcatctatgttcgtcctcgactcttctctccctatgtggaagaagcaaaggtaatgaaaaccatttgaagatagtagactactttattacaaaccatatgcacaaagtggttcactgtagtattacttaaatatttggaaatagcctatattttcaacaatagggaaaatgaaagtaagttctagtttgactactcaacagaatagttttctaaaacgtttaattttaattaagcatgtttttaaaacttaggttatgttaaaatgcattttatatttttctcattttagttgccttgcaaattgttaactgccttgcaaattgttaccacttactgaaaatggttgtcactattttgtgatcttgagcatgagggaaatgttctgaaagaagattgcccacttttttacttccttcctaaattaaaggaatgccacgacctcttgtaacatatttctgcaatagctgactgttgggaattatgtttagttttagaataaatgcacaaactaagaaaa

SEQ ID NO: 77683 - DNA, 1043 bp, Homo sapiens
gaaaaaaatgactcttttctacacagttaacaattttattctgaatgaatccagaaaaaaacttagcttctcaaaaacaatcaattctctctctctctctctcatacacacacacacacacacacgatttaaggaagataccagttttcctgtagaatatttgaaaaaaatccagcatttcatgaataataagatcttattctgtgttaatttttttaagaaaaaaattacagacccctagattaaagccatgattaaagatttccaaattacataatttttcttcccacctcaatagcataagcatacatgtatttcagattgttgttcactaatgcccaatgaagaaatcattctctgccttggatgatggacatatattacatgtcaaagatcaaagggtctacttttatgcagtaatgttcccatattatggaaatttgggagattttcataaaaatcttaaaaccaaataaagcacattatgctttgctgcttcaaacaccaagtgattaacatgttgttaaattactgttacacatatgtaggctaatgagcatactgataacttacagtgaccagaaatggcatatgctctacaatgaccttatactactaaacactggtcacaaaagtgagaaggctttttaaaaagcccttgataaaactagattttagtagattgtcatcttttctcttttgagttagtctatagaaaggaatcctttattctttattgcagagcagtgataaaataattttattgtactgttgataccatgctttttctttatccaagaacatccctattaaacaaacatgaaagaaaataattgatttataaccctttttaaagcagaggcacataagtctatagagtggtactgttagtgtatgtactagagaacaaaggaaacctgtctcagaacatttggatttggttggaaacttttcattttctgtctcatagagccaaacttactgagtggcactgcccatagtgtgaacaaaagaggtgtaaaaagacgggacctggacatgga

SEQ ID NO: 77684 - DNA, 1040 bp, Homo sapiens
agcctgggcaacagcgcgagactccctctcaaaaaaaaaaaaaaaaattagctgggtgtggtagcacatacctgtagtcccagctgctcaggaggctgaagcggggagaatcacttgagcccaggaggttgaggctgcagagacccatgatggcactgctgcactccagcctgggcaatagagtacgacttcatctcaaaaggaaaaattaaaatgaaaaaataaaataggaagggagcagattacagaaaaagaagatagaaatgaaatttaaaaattagttggagccaagattgaggttactggataaaatatatgtaatgcagtcttgtatatttcctgttgatggaccacagatttaacactaaaacttcaaacagccaatggaaagagtgaaacatggtaagttgcatgctgttatttcccacctacgaaaagtccttaatgaaattaaccacttatctaatttcactaaaataaatataaaccattttttattataggcaagtgaacaagatatccttaaatatctgattaaatggggagagcatcagttgatgaaaagaatagcagatagaggtaagctccgaaaattagcttgcactagttaccttgtgtaaaatttggtggttcttatatagaaatgcatgccgcacatcagtcttgaaaattgacactgttgcctggtgaaaatggaagtttttaccaccagcaaaatcctttagtggacagggtatagtttattaaaataaatatatcagaaagtcttattttgcagctttaaaaggatactttttattattatgttcttaggtgcttaataaaacatgactgattcgtggaagtactagaatgaaaaatttcatataatttcatataatgactaaagtattacaaaagcataatgttgatgaaaatttggaattagtgttgatggttgcacaacaatacaagtatagtaagagccactgaatggtacgctttaaaatgttttaaataaattttgtgttatgtgaattttaacctcagtttaaaaatac

SEQ ID NO: 77685 - DNA, 2109 bp, Homo sapiens
tatattttatctttatattttgaaatgatctttcctaaggaggagagttgagtctccttaggttttcttttcttccttgagttcttgaaatgccatagttgctttctccaggatcctggtcctcttcacttactttttcaagtttgccagaattaagctcagatgtattttgtctattttctgaaggattaaactgtcaacaatgcaaggtgctatgttttcatacaaagagtggatgtctgcatagctggcagcccacctaccttattctgaggtgtgcattctctcatcagtcaggtgtcatccacttccttcctctagccagtttccaccactgcagcctttttgcctactcttctttcccttttggtccaatgtcttcctctatactgacttactcacattattggtttgcacatagatgtttattatcttgaacttgggaggattctctgcctttttctgtagatccatctctgtaaggcagcagattttctatagatgccatagtctattgtttacccatcccaccaagtcttggtgattttcatgagattttatttatctccttgagttcttttttgctattgtgacttttaaatatcgtgcctagcacactaatgttcaataagtaatatttatgattaatctcaagaagtatttgccttctcttttaggctgtgaggatatcattgctgagagcatctcattagataccttaattgccatcctcaagtggagttctcatccatatggctctaaatgggtgcaccgacaagctttacatttcctctgtgaggaattttcccaggtcatgacttcggatgttttttatgaactcagcaaagaccatctgcttactgctatccagtctgactacctacaggtaatcatttaaacacctctcaaactctgtcattcatatgtgcgccaagaaacccatctatgctctattactcttccatctagggtagggcaggggaagagaaacaggctgtgatcaaaccacccaggactgccctcttcatagttgtacaacaaaagccttctggctcactggctcttcatgtacactgctaccatgactcaacattgaacaagcccaggtcccagccaaatgcaccaaaaagagattggggcagtaggcaaggtcagaagcacatcccaacatgattttcttgacttctattaatgtagcttctctatagtggtttcttacttttggtggagcatcacatacttagattgtaagacagtagcttcagcagcacaaagtaaaaataatattcaatttctgatctgctcacatttttatcaaaactcagtgcatgtattcttccaaagtacggtaatgttttcaactacttatttttaaccagaagtagtttttagcaaattcttgtgttcttgacttaaatgtcaatttaatttggaaatttacattaataatagattttatacattacagaaaatacttacaggcaaagtatatccaagcttaatttttgtgcattggctatatgaattttatgctaaaaactgtacaaccgttttaatgctattaaagacataaacccattgaaccacttcctatttctttgtatttgtactagaaaaataataaaatgctaccattttagtcagaaatgcagtggagagttaaataatacactcagcatctgtgcttttcctttgtatgttgctttgattgcagtacagatggcatacttgggcttgatttatggagaatctttgttcattaaccttgtctcattgtcctgatcaaaactggacgctttatgtttgtgttagaagttgttagttctcttagattattgtctttaggagctttgcattccttcttagaaagtattaaaaaaaaaaaaaacagagagcagcctagatttgctctaagattttaaataaaatacaaagaaatgagggctacattgccatttcacagattgtgcttcactaaccagtagaataccttgtagagattgtagtttcttctgccaaaacaagttgactgacttgtttttcctgtccctccaggagagagtagttactctgcctataccctatacttacactttcatttacttatct

SEQ ID NO: 77686 - DNA, 1032 bp, Homo sapiens
tgaatctggaagtcgtttatatatttcctgatggacatgagccagcggaaaagtttcccactggtattggtgaaacaaatagggtggcattgtaggaataacaagtaagggggaaacaaagatcctgacagtgtattcaggagaactgtcaacgttgaggctatttttagttaccagagggacaaacatgaagaggagaaacaaaaattgataataaaaacagaaagtgatcctatttaacatgcagcaatacagtcatttgtgttactgaatttcagattgatttgttagctctttaagtctaaaccttcagccttggtcattcattcctactggttatgtgactcaattttttgagggaaggtatttttgcttacattaaagattagaaagaaaatatcctagtaaaagagaatagaggaaaggattaaataagtaggagatggatctgtaaagtgtggttatcacacaagcaaaagaaattgtaagaagttgactttgtactacctgccagcctcccaagagcatcactgaaagtctgcctgagcggaatgtattggtgccttttatccattaaatgccttggctacaggtggaatttttctgttaccaggaaattgttaataaaagcttttttttttttttttgagacaagagtctcgctctgttgcccaggctggagtacagtggcacaacctcggctcactgcaacctctgcctcctggattcaagtgattatcctgcctcagcctcctgagtagctgggactctacagacacatgccaccacacccagctaattcttgtatttttagtagagactgggtttcgccatgttggctaggcttgtctcgaactcctgacctcgggtaatctacctgcctcagcctcttaaagtgtgggattacagatgcccaccaccacgcttggctgttaataaaagcttttggccaggcgcagtggctcacgcctgtaatcccagcactttgggaggctgaggcgggtggatcacctgaggtcaggagttcaagac

SEQ ID NO: 77687 - DNA, 1040 bp, Homo sapiens
ttcaagcaaataaaggtaacaatgggacattattggagctaaaaaagatatagcctatcaactcaaataagccccttggtatagaattagcaccatgattcctatactcatttaacaaacacttattgagctcttactgtgtgccagaacctgagattaaagtaatgaaaatgatagtccatcagtctggccaacatggtgaaaccttgtctctactaaaaatacaaaaattagctggacgtggtcatgggcacctgtaatcccagctgctcgggaggctgaggcaggagaatcgcttgaacccgggagtcggaggttgcagtgagctgggatcacgccactgcactccagcctgggcaacagagcgagactctgtctcaacgaaaaaaagaagaaaaggatagtccagtgttaagtaccaataggcagttagagtgtgagtgccctaatagaacactgggtgctgggggagtacctaggaggacgagaagccccagaccccaatatggaaggggagggcaggaggacatatcagaaacttcccagacaatgagacctggagtaggagttaagcaaagattggaggtaaaagcgagcatatcaggcagcaggaactggcctagagataaatgacagctaggcctttttggctggagatgctggggttgcaaagagaggtatggcaagaaatgaggcaacagaggcaaacacggctataagataaagaattcagtatactaaactgagacaattggctttatcctcactatcataaatcttgtggcctgattacatttgtattttctaaaagctctctttggatgtagcatgtgaagaccgtaagaaatgttctagaaatagtgagggtcttaaaagtacatacattctgctgtaagtagatgaaatctgtaaattttatatcaaaattactaattctttttaaaagttttatgctctgtgtattcatttgttcaggagaatttgtggggcacctgttctttttcaggcactgtgtcaagcactttactcacgttgtcctc

SEQ ID NO: 77688 - DNA, 1140 bp, Homo sapiens
catccttgtcataaatactgttgacctcagagcaaaataccccagaattagcaccaacatctacatgcatatttactgtagacttcaaactgcagattttgttttttcatcttgatcacaaatgcatttttcaatctttacaatatgaaatttatttataactttagttccaaaatggactctgtaatgcatttgcccatatttttagtcgtaatggatgtgattatattttattgaattaaaaatctaacagaagcaactgaaagcaatgacctcgttttttcccttagcaacttggtcactttccaagagtgtgtggcttgaaacaaatgcaaaatagcaaagacttactgtccccactcactcatccatttcaccctcttcccaacctccactgtctacatattgacactcttccctctgtctcagttctgttgagttgacagtttattttacttctgtctataattgtctcctcttcagcaaatttgaatgtacttcctagagaagaatggggccaagctaaagaccattatcaacagatcagagtagtaaatgcaggtttcaaacatgcaacataagagttaatctcagtttcatatttatatatatgtttatatataaaacataaaaagtttatatatataatattgcatcttttgttttaaaacttaagtcatttttcatagactacaaactcttcacctctgaccctctgctctcacttttcatttgtctggggggtattttgcctttgatcattaaatgtccaaattctaccctaacctttaagaccgaactcacatgcttactttccttgttttgcttagccattccaagttaaaagtattttctacatcctgagaatttctaaaacactttttattgttcttagggttttatatcttctgacttgttttgaaattacctaggtacccgtctcatttcctctgtcacctagtgtattgtatgctcccaaagttgtgtatcaaaatcttggtcatctttgaataacctgagaacctagcacactgctttattcttagtatactgtcagttacatgttttgaattatttttaatacctttgaaagctgagtaaccttttctttaaaaaaaaaaaaagtggggagtgggatag

SEQ ID NO: 77689 - DNA, 2052 bp, Homo sapiens
ataggaatcagatggtattgagattttcagtagcaacaactgaataccacaatacagtgaagtagtgtcttccaaaagctgatggaaaattattttaaacacaaaatcctatatttagccaaacagtcaatcaagtgtaaggctaaataaaggcatttttcagtcatacctcgaaaaactgcctgtgtagggatatttcccctgcttccccactcaggcagctgctgggaatgtattccaccaaatgacgaagcaaaccaagaacaaagaagtgaaggatctagaaaatgggctccaacacgggaaggaagcaaagggagatcccacgcatcagccacacagtaggtcttgtgggcattcagtctagcccagaccgggagggtgaaagtctccaaggaaagaggtgtctcggaagaaatcaattactttcaatgtttgaacattaaatagcaaatgacaaagcaattttatggctcttgtggtgcatttatgaagaattagcaataagttcttagaaaatgaagcaaatggaaaaagaagaaatgaatatttccaagataaatttaacagtacatatgaaagaataaataattttagtacacagcatggctcagcagtaagcactatttaattataaacactaaatattgatttaataaaaatagtaatatagagaggtaaatactagaagaaagagctaaagaattgagagtagttacctctggggagcagaactgaaagtggaagggatgtaggacggggtgggggggcgggggggtttagggttagcattgtgttactaccagactttttaaatgatgagcatatactactttgattacaaggttaactttttttttttttgagacagagtctcgctctgtcgcccaggctagagtgcaatggcccaatcttggctcattgcaacctctgcctcccaggttcaagcgattctcctgcctcagcctcacaagtagctgggattacaggtgcctgccaccatgcccggctaattttttgtgtttttagtagagacggggatctgctctgttggccaggctggtctcaaactcctgacctcaggtgatccacccgcctcagtgctggtattacaggcatgagccaccatgcctggcccagaattaactttttaaatgtaaagatatgacatcagtgcccataagaaccagagagaccaagagaaggccacaatcctaaagaactggagactttatcatatctttgaagtctgttaactaatgagctcatgcttataatttgaatgtacagagggctgttacttatctccattggtcatcctgtcagccgatgaatgtggtgaggctcagagattattaactagccttttcccaggtttggaagtcacgaagctgtaactcataccagctcttctgactctaggctcaggaatttgggcatggtaggagaagggagaaatactggacccaatttccagggatgagggtgggaggctgtggcctactcttaggaacaaaacagaaaactatagtgattgaaacatcaacttgtaggagcctcagctgtgagcccgatttgtggctgaacaacaaatcattacccccgacttgggttgagggtaatgtgggctcagctaggaggtttaaagctgtagggtcagggatctgagtagctcactcaaactttgcttcagagcacttagccagagaacaggggctttgtactgtttcagccattgtttcctgaataggtagcattcctatgttagtcatttgacttttctggctgcccagcattaggaccttcttcccagccttactgtgtatgtcttcataggaggcagagcccacctcccagtagaaaagccttaaaggtcatatactttcttctgcagccttctctagtcagggttagtggtacagaaaagcagggactatagagaattttttctggaagcagagtggggcagcaacatctagtggaaaaggagagaaggccatggcagtggtgccattgatgacattcactatccagggacagaatgtaggagct

SEQ ID NO: 77690 - DNA, 2217 bp, Homo sapiens
ctcccagctacttgggaagctgaggttggggagaatcccttgagcccaggagtttgaggctgcagtgagctatgatcttcccactgcactccagcttgagcaacacagtgagactccatctctaaaaattaaattgaattgaaaactaaaatgagttaattgaactttttgtcttcctttataaaaaacaaatgcaattttgagtggttcggtaatgtctgcttacagaatttttcaacatgaaaaatgttaaacgttgaaaatgaatgttaagaaaaaataaattttcatttgtttaatttttttcttagggacctcatcctattctcagcaaggctatggttgcgaatcaaagttgtatagccttgaccatggccatgagaaaccacaagacaaaaaaaagagaacctctggtcttgccaccctcaaaaagaagtttattaagcgtcggaaatctaataggtctgccgatcatgccaagcagatgcgagaactcctctctgggtgggatgttagagatgtcaatgcattagtggaggaatatgagggaacatcagcattaaaggagctttctctacaagccagtttggctagaccagaagcccggacattgcagaaagatatggctgatctttatgagtacaagtattgtactgatgtagacttaatatttcaagaaacttgttttcctgttcatcgtgccattttggcagcaaggtgtccattttttaaaacactgctttcttcctcaccagagtatggggcagagataataatggacatcaatacagctggtattgatatgcccatgttttctgctttgttacactacctttatacaggagagtttggaatggaggactcaaggtttcaaaatgtcgatatccttgttcagcttagtgaagaatttggaacaccaaattcccttgatgtagatatgcgtggactctttgattacatgtgttattatgatgtcgtccttagtttttcttcagactctgaactggttgaagcttttggtggaaatcagaactgtttagatgaagagctcaaagcccacaaggctgttatttctgcacggtccccattttttcgaaatttattacaaaggaggatacgaactggtgaagaaatcacagaccgaactttgaggactcccacaagaattatattagatgagtccattataccaaaaaaatatgcaacagtgatattacactgtatgtataccgacgtggtggacctctctgttttgcactgtagcccctctgtggggagtctcagtgaagttcaggctctcgtcgcagggaagccaaacatgaccagggcagaagaagccatggaactttaccacatagcactgttcttggaatttaacatgcttgcacaaggtatgaagttctggtttttaattctgatttatagaattatgtattgatcttccaaattgaaaacacaaccagtatattctatgatttcagtgtttgggatgttacagggtcagtttttttgaaccttcagttatgacatctgagacagattgagggtcagtattaatgtggttctttatttactagtaaaaccaagtattcagtactaatgacttcagagcattaaatgagacttgaggttctttcttccctaatgtaagacgataggtatgggaatatataattaccaacctacaccctctccacccaagctttgaaagagcccagtttcccacattttgagtctcatatttatgttcagtaccttgttgatgtttaaatgtttggataagaataaaaattcattacaaaaatgaagatagtcacatttagatacgaatttagttgaatcagaattgggcagggtttctgatttaaattttaaaatattccttatcttatttttagattcaacttgtacatcaagccacagcctacagcgtgtaaaacacagttagcgctagactcatgtgccttcttcatttaatttaaactaaaatttttttaaaattaggacggcacgttttttgtgttataggcaaacaaattcatgaaagttacattaaaagaagtatacatctgttggtaaatgttagaatcttaacatttcagagctggaaagagaccttttgtaggagagcaaagacagtttgctgttttgacagagtgcattcttagctttctgtgaccatatattaaaagaaaataagctatgtgacatgagact

SEQ ID NO: 77691 - DNA, 2077 bp, Homo sapiens
acacgatggctcacacctgtaatcccagcactttgggaggctgaggtgggcggatcacctgaggtcggcagatcacctgaggtcaggagttcaagaccagtctggccaacatggcgaaaccccatctctactaaagatacaaaaatctggtgtggtggcaggtgcctataatcccagctacttgggaggctgaggcgggagaatcgcttgtccccaagaggcggaggttgcagtgagccaagattgcgccactgcacttcagcctgggtgatagagctagactctgtctcaaaaaaaaaaaaaaaaaaaaaaaaattggagcatgctgcttctctacttaaaatacctttgttaacttcccttgtcgataaagtccagactcacaagagtttatagaatgtgttcaaccttaggtctcctgtcactccagccatgctgtttcttgttccctgtgcctctgtcttgtgtgtgtttatcccattgtttggagttcttattctttgcctattctgttagctgcccatctaatgtctacttttctcttctttcctaacagaaatctgcttttgttcatgcatgcagcagacttggagaagctgatttgtcaccacctccagtagtagagttccattagttcaaaccagtcaaatcatggcatttccctgtaaactcttatttgtaccgatcagatttgaagggaagtagacattctgtttctgggggagaagattctttcctctcttgtatgtgaacaagggaacacaaggcccctattgctaccgacagctgtcttgggatcacaagggatgaagcacttcctgaagatggcagatcagagaggtagagggtatctggatccttggtaacatcatttaaccacatattttattgggcctggagccatccccaccacaggacttctcatgacagataattttcttaatgtttcagacagttctttggagttatttgccatcaaaaatctcttttttttttttttgagacagggtctcgctctgtcacccaggctggagtgcagtgatacaatcacagctcactccaaccttgacctcttgggttcagcagtcctcctgcttcaggcttctgagaagtagccaccacacctggctactttaaaaaaattatttgtagaggcagggtctccctgtattgcccaggcgtcttgaactcctggtctcaagtgatcctcccacctcagtctcccaaagtgttgggattacaggtgtgaaccactgcacctggcccaaaatctcttgattgatacagtcctctttatttttcaagatcaagttatgatacctttaccaacagtcatacattcttttggaactttgcacaatagtcatatgttcttttagaactttacacttctattctttattgccctgtattataattgcttgtatgcctgactcctctacatgactgtatggtttgaaccaaagtgtacgggatgtcgcacagtgtctaatagtgtcacacaacaagtaataggtattcagtaagtgagttaagatgaaatagtaacatgaaagagtgctttgaaagcagttttttaaagagtttctgttctgctaattgtaagccattttttaaataaacatgacgtgtggtgttgtctttaaagtaaaaatggaaaaaccagtgagatcagacattgttttttgcttgcccctcattattacctagacattttcatttagataaaaactatgtcagtctcctggctgtagtcctttacggaaggagcaatattacatttagctctgtttcatctgggattcaattgtgaattattctttagagaaaaattctataatatgcttcatgagacctattcttgtcttcagacttgcctaaaatattttttgcttgcttaagaccagacatgagaattttcttgtaagcagaaagctttgtgacaggactggatgagtttgtagtgaatgttagtgatagctatgacagaagtctcatagcctcaattgcagagtcatagttctgtcacatgcttcaacaataatgtctgataagggaggaaggatggggaagaaga

SEQ ID NO: 77692 - DNA, 1182 bp, Homo sapiens
tttcttaggctcatgactacatatttctaaaccgaaactgtccattttcccttacccccagcccctggcacccacagttctactgtctcttttattttgactactgtaagtaccacgtataagtgaaattatacagtatttgtccttctatatctggcttatttcacttagtataatgtcatcaaggtccatccatattgtagcatgtgtcacaatttgctttctttttaaggctgaataatattccattgtatgttatttttatattttgttaagttcccctcaatgggcacttaagttgcatccacattttgactgttgtgaataaagctgctgtgaacatggatgttaaaatatctgagtctctgctttcatttattttatgaattttatatccagaaaattttacaaccccaccagcagtgcacaagggttccagtttctctacatcttcaccaatacttgttatttgctgtttgggtttttttttcctaatattcatcctgatgagtatgaagtgatatttcattgtgtttttggtttgcattttttaaaaatgattggtgatgttaagcatcttttcatgtgcttattgatcttttgtatttttttagaaaaatattcacattatttccctgttttctaattaggatttttttttgttgttgagtgtggaagttacttatgtatgctgaatatcaatcccttatcagacatgatttgcaaatgttttctcccattctgtaggctgccttttcaccctgttgatagcgtcctttgatgtacacacagtttttaattttgatgaaatccagcttacctagattttcttttgttgcttatgcttttggtgtcatagccaagaaatcattattaaatccagtgtcaggaagcttttcccctatgttttctttcttttttaaagatagataggttctgggtctgtcaccaaggctggagtacactagtgtgattatggctcacagtagccttgaactctggtctcaaacagccctcacatctcagcctcccgaacagctgggactacaggtgcgtacatccacgcctggctaagtttttaaaattttctgaggagatggggtctcactatgttgcccaggctggtctcgaacttttggactcaagtggtcctcccgcctcaacccaaggtactgggattac

SEQ ID NO: 77693 - DNA, 1659 bp, Homo sapiens
tccctaatagcatctgtttcctttagattgctgaaatgaattgctttcttcctgaaatgtggaagaaagacttgaaattgctttgcaagaatcatacgttgttaatagcaactgttattagacttgtcatggaattttggagtcagaaaaacttttagagatctaaaggtgtgaatattgttttagagccgggaaaccagacccagagaggcgagtgacttgttgtggatcctacagctggcgatggattagaccaaaactaagatgtaggcctctacaccccattaccccatttagagagctcattgttactacactgctgagctgcttacttttcattgattgcattcttcaccattcactacctacccctatccatagggttttggtgtaataaagttgaaagcgaaaatgagagcctctgtctcattctgacagctacttcaagtaactgatgaagattttttttttttcctaacctgaacttaataaaaacggagtgatatttcgtttggagttttcttaggctcatgactacattttcacccagttttagcatggctcattcttgcatgaattcagtaaaactcataggtcaatattctgtcccacaaaacctgactactgtattgttttgtgtcccaacaccagcatttaaacaaggtttttctatcagactctgattttaggatttaaagcacctgtgttgatttctaggttacactacctagtttccaggtatcatcttgagtcacagcatttttatagtgtgtctcaggtaaaccttcggaagtgcagtaatgccaaagttattctgatttcagattctagtcacggaagctcacacatccaaaattacataggtgactgttgaaggtctgctttttgttttgcattagatgaatgatgtggaagaaaggaaagaaacataatattaggttggtgcaaaagtaactgcagtttttgccattaacatatagacttttccctcaagttcttattggaaagatcaggtgtaccaacatgagtctcgaagacaatctagtgagttctactaatgcaaagaatgctgttggtatacagggtagagagagatgagtgagaccccaagagtccaaagaacttgggaaacttcggatttgagctggcctatgaaagtttagatttaccgagagattgtagcagttactttgtgaggaaaaagcaagagtgtaaagtgaagattagcttagggggagggaaatagaaggagactaggatgagctgacaactgaatttcctgaggagaatgttttcgttaggaaactttagtcagttggaaagctatttgtctgtagaagagtttgagtgctgaattgaggagatttctacttttatcctgttgtgcaaggtatagagagcctttgaaagtttggaggccagggattaatgtggtaaaccaggaaggtaaacctgttaatgatctacaggttaagttagagtgaggagagaatgtaatgaaccaaggaagacagtagctgctgtagtaacccaaataggagatcttagacccggataaagtcagtaggaaggatttggatagcagatatctgtgggcttaattgtggtaaaatccacatacaatttaccatcttaaccatttttaagtgtatagttctg

SEQ ID NO: 77694 - DNA, 1106 bp, Homo sapiens
gatggctatgataatgacaagcattgcccacttttaaatagtccatctcctctaaatagttaggaagctctcttgtgattttttttgcatgtttctgaaagttaaatctacattcaaaattaagttttgcttttacagaggtttttgaaaaaaattgggtgcattctgttttgaggaatggtaacatagtttgagtccatgtagaacctcccacttgagaatatcacatcctgatattataataaagccaagtggttttattatagtatggtttttaaaggaaaaaacaccacctgtcatttgattgtgtagttacatattacgtaagtaatttcaggctaaagccagtgagtattactgtcctcttcctgtgttttctcttccttgttacattttgaaatggactggatgctttgtcttgtctctttcctgggcaatgaataaaatctatctatggacttgattctgtagagcaattagtggacttaagtagctattttagacgtgttagtgaaacagatttttttcatctgtagaggatgaaaaggacaccatatctggagctagaacatgtggacttgagctttgtatgtccttctgattaattgtgagacacggggcaattaacttaatagttttgtgcctcagagtttccatctttaaagtaaggaattgtagtaggagctatctttgctttagtcttaagggtttggagggcaaaggaggtaaatgggagtaggctgtggaaaggttaaggatgctatggatgtttttagatatctgtatttagaatgaaggtaattaaggaatctcttttctttttctgttaatatgcactaacatgagtggattgacattttcgtgtatgttatgtacctgaaaataaagcaaaaacacaataggctgcatagttgatgttcatgaaggacaaatactttttataaaaagaacgcagattggcagcattttatccttggacttggtagaagtttagctacgtgtaaggagcaagagaaggaaaggtcagggaatttttttttttcttctactgggtgtgaagactactggataaggagagaatgggagagctcgtttctcctctgcat

SEQ ID NO: 77695 - DNA, 1019 bp, Homo sapiens
agacattgcttttctttttattattagtgttgccttttatagaatttcatgtaaatggaatcattcagtgcatactcttttctgtctgacttcttttttttttttttctcaagacggactcttgctctgtcgcccaggctagagtgcaatggcacaatctcagctcgctgcaacctccgcctcttaggttcaagcgattctcctgcctcagcctcccgagtagttgggattacaggtgcacaccaccatgcccggctaattttttgtatttttagtagagacagggtttcaccatgttgggcaggctggtctcgaactcctgacctcgtgatccacctgccttggcctcccaaagtgctgggattacaggcatgagccacggcacctggcttctgtctaacttcttttatttatcataatgttttggagagtcactcatgttgttgggttaattaatattttgtttgtttttattgctctatatagtccatggcatgtgtatattacaatttgtttatccattcaccagttgatagaaatttgggttgttttcagttttgggccattatgaatatttgcatacctggtttcatgtggacatatgtttttatttctctaggttgaatacctaggaatggaattgcttggtagtatggttaatgaatgtttaccgttataaggtatttctatactattttgcaaagtggctgtaaggttttatgttcccaccagcaatgtaggagagagtttcagttgatctgcatcttcatcaacacttggtattcacagtctatttaactttagtctttctagttggtgtgcagtggtatcttgtggttttaattagcatttctctgaggattagtgatgttgaacatctttttatgtgccaattgactatttgtatatcttcttttgggaaatttctgttccaatctttggtctatttttattggtttttttgatcttttgattgagtcttaagggttctttatatattctgaatacaagttcattgt

SEQ ID NO: 77696 - DNA, 1047 bp, Homo sapiens
tagctgtagaaacttaaagaatgattcatagttatcagccttcgtatatccccgaaattatttgattttcaccaaataattcctcagttcttcaaaaacctatgattttttaagtagagagctcagtgaaatttagtaatgagagattaaataattttctagttttcatttgctaaatccatatatctgaatttatactttcttgaaaagatcactaatgctcttgtttctctcccccacttgcagtttcaagtacaataagcacagtattcagatatcttatctcattaattagaaagtgcaagctcataagtcgctctttcagtgggataggaagtacttaaaatttggcctcagattctctgatttcaaaatcttgatctgaggaagctgcttagtaaactttgaaaaataagtctttataacctaacccagttgcatcaaaatagaatagattttcatattctgtttcaaattgttacatatccaacattcaacttgaagaaaattcactgcctgtattaatttcttcatcacatcatgaaatgaatctgactttcaaagtttctagtacaagttctcttgaccaatagtgcaatagaaactggaacagaaacctccttttttgaggaggaatagattgtttgaggggaataaattgtttttcccttttctttattgcaagtgtcccatctctgggacatgtgaagcatttccatgtttagactttttaaatctttttttttttttttgagtcagggtctcgctgtgtcacccaagctggagtgcaatggtgccatcatggctcacagcatcaatcttctgggctcaaaccaccctcccacctcagtctcccaagtagctgggactacaggtatcaccatgacacttggttattaaaaaaattttattttgttgagatggggtctcactgtgttgcccaggctagtcttgaactcctgagctcaagcaatccacttgtctcagcctcccaaagtgctgggattacaggcatgagccatcacatctggcctagacttttttcca

SEQ ID NO: 77697 - DNA, 1051 bp, Homo sapiens
ggttttgtctccaaggatcttaaagtgttgttagggaaactagatttgcacacatgaaactaatttagaaccatctagaacagtttataatcagtgaaatatttatataatgaagtgcaaaaattttggaagcagatataacatgctctgggtagtcagaaaagggagctattgataatgtccagagtcaattagaaggcttcactcaaggctgcagtgccgtggcgtgatctcagctcactgcaacctctgcctcctgggttcaagcaattctcctgcctcagcctccggaggagctgagattacaggtgggtgccaccaaaactggctaatttttgtatttttagtagagacagggtttcaccatgttggccaggctggtctcaaactcctgaccttggcctcccaaagtgctgggattacaggcatgagccactgcatccggccaatgtaactcttaagatgagccttgaagggtgaaaggggtctgatttttcaagaaagtaaagggcaggactagtgaagtaaatgttttgttttgtattttctaagaaataaataactagtctaatattctaaatagtctaatattttgtctgcttactgcagttttacttagtgaaatattggaaacaacctaaatgctgaacaatagaataggggaagtgtccatatttcatgctaaatctgtatcactgaatattattaaaccagtaaaaataattaaagaacaatgtagtctggcagaaaagcatggcttgcagcctgttaaactatcagttttatacttattagctttgtgcctttgggcaagtcacttactgtttttgaactttggtttattcaacttttttttttttttgagacggagtctcactctttcgcccaagctggactgcagtggcgctatcccggctcactgcaagctccgcctcttgggttcatgccattctcctgcctcagcctcccgagtagctgggattacaggcgcccaccaccacgcccggctaattttttgtatttttagtagagacggggtttcaccgtgtta

SEQ ID NO: 77698 - DNA, 1054 bp, Homo sapiens
agcgagactccatctaaaacaaaacaaaacaaaacaaaaaaagatttcctctatgatggtgtattagtttgctccagctgccataaaagtaccacagactgggtggctaaaacaacagaaatgtattttctcacagttctggaggcttgaagtctgagattgaggtgttggcaggtttggtttctcctgaggcctctctccttgacttgcagatggctgccttctctctctgtcctcacgtggcctttcctctgtgttcccacatttctggtatctcttatgtgtcctaatctcctcttaaaaggacagcagtcagattggattagggtccaccacggaaacggcctcattttaacttaatcacccttttaaaggccttatctctgggtacagtcacattttgaggttaaggtttcaacatatgaattctaagcgccacaaaattcagtcaataacagatggctttttaaagtataaggaaaggggtggccccggggggagttttgaagatagtataactataattgaagagtgtagaagaaggagcttactagagaaatgtagccttagggtcagttgaggttgaagatcattcatttatatctattgggcccaattattcgagcctccgcagcagcagtcaggtatatgtgtggagtaaagaggagccctgctttgatgaggctgctggatgctcacatgggcttattaaccagccaaatgaccacctctcgtgcacaaaattgaactgtaaatgagttttattcacatccttggcacaagtacaaattactatttgtcatggacctttttggctgctctcaagttgttgaaaacgtggatgttaaatctattactgctaagattttgttgcattcaccaatgcacaaattggcttgaacatttttttcaatctgttctaaaaatggtctttcatgattactcaccactctcttcctctttctctgtcccactttctttcttccttttttttctccatcttcacttatcaacaatttattgagtacctactaggtgtctggcactaaggatg

SEQ ID NO: 77699 - DNA, 1136 bp, Homo sapiens
aatattggcaataacttttcattacttatacagacatgtgacactaacctcagatgatttaagataaactctaggatatcaaactgtcaagtaaccattaattatacaaaaccagtttttaaacatgagttgtaaattttgttgctttttcatccactagtttaagattaccagacagggtttgggagacatttacctttgatcttttaaataaattgtaacatagactataaataaggtgttagttcattttttgagtacatactatttcagagtacatattagccaattcttggaaaatttattttcaaatgctctccagcatcagttttcatggaaataattgatgtgcccactgaaaagaattcttatgcattcattatgtagacagtaatttgacagtcttgctccaactggtctacccgtgggtttgaaaattgctttctcttaaataaccctacagctggttttacacacacacgttaagagtgatataaattgataatttaaatctaggtagtccaagttagtaattttgtctacagttttgatattgcaaataatccgatggtgatgctgtaaatatatcacattaacccagtgtcatagtataatgggaagaacagtaaatggggaatttggagacttgaactcaaggtctgcccctaccattgatagcttgtgtgaccttgaagaatttacctaaccacagtggttctcagttttgtcctctgtaaaatggggaaataagattaaatttgtttggctttaacaagatttgatttctaagtcatgtctgaaaagattaaattatttgtaaaagtagcagtgtgcaggtgtttttaacctcactaaacatacactactagatgaaaagagatctatttcatgatttctgaggaaactagaagccaataaaagtagacgataatttatgagccaagtgaaaatctgtttgggccaagtccagaggtcatattactaagatttaaaagattcccccttcatggctgcccttattttaaatgggctctagacctggcatggtggcttacacctgtaatcctagccttttggagggaggtcaaggcaggagggttgcttgtggccaggagttgaagaacagcctgagaaac

SEQ ID NO: 77700 - DNA, 1180 bp, Homo sapiens
tgcttttgctcacccatcttatgcacaatgcttttgttcagtaatttgcaataaaagcctatgtgtaattctgggataggagtccaattagaaaaaggtttgaattatactgcaatttatggtacttaactttagttaaggatatatcttgtatgctagaaatctcaattgttttgaagtggagtgcaaatagtccaatttgtatgtgtgaaaaacatacccagactgactgtatatggaaagtatttatgtgtaagttgaacaatacatgtagctaaagattcttcctttaatatttcctttagtttttttttaataatagtttctctaaaccacctccatcttctcttcttgttttaataattgaaaagagtaagaggaggcagtatgatgtcataaaaaagaatttttgactagttggttgagattcttggactctggccagttctgttccctcctacctatgtggaccttgcacacatcatttaaactttttgggatgttgattgtgagtaggtatattggagggctgtctcagttatctatggatgcataacaaaccatctgaaaacatagtgtctcatatggcaaccaattatttaatcacaattctgtggattggcaatttgtcctatgctcagctcagctaagcagttcttttgataaattactctaggctcactcatgtatttgcagtcagttggtgggtaagctggaattggctggccccagatggtctcactcccatatctggggctaagctgggatggctggaatggtgagatgggtggggtgtctgggcctctctttccacatgatgtctcatcgtccaggggctaggctggacttgttcacaggtggcagtcttctgagagagtgagagagcctcactcactcaaggcctctcagaagtcacacagcatcatttctgtagcattcaacaggtcaaagcaagttccaaggccggcccagattcaaagagtggagaaataggatctttgtggttattgaaggattggcaagaattttatggtcacatttaatctaccacaatctgtcctttggacataattatttaccttctttccatatgcaaaatatgctcaccattttatatgacctccacaagtcttattcatttatggcttcaggcttaaagtctagtatcttgtgatctgca

SEQ ID NO: 77701 - DNA, 1058 bp, Homo sapiens
ttattttttactatcttgaggaagttaatgtaggtgcacagctgcagaaatttaactatagcctgctattgtgatctatttaccatatcattgtttattcttgctgtaacgtttacccccagtcctagtaaactcaatttaaaaagtacattttgatgtggaatcttgtcaatatagaacttgaatggataggtaaggcatgattttgtcttgtagaaattttactgcattttctcaggtttttgtcgtgttgcttcatagcagagaaagggcagatgaaactggttcttatgtggattcatggtttttttaaaaatagatctaagtagtttttttccctaaaaagtcctttcacaaattggtgcatctctttagaattagatacatttaatatctacccaacaaatttctgttcattgtctgtccatctattcatccatccatccatccatccatccatccacccatccatccaccatgtctctattcaactgtctatctcattaatttttagggctatatctttgaaaaatactttaggagctgtgtttaattatttaattgtttaccattgtataattgtttaattaaaattgttttaacctgagaatgacttttttcaacaaggatattatggcatgggaatctgttgagatgcagtcatatttcagattttccttttgctaaactaaatgctttcagaacatatttgaagcaaaagttatattaaggtggaaactaatttttactttttttcatatttattcacagtgttctttagattccagtttaagaattatgatttgcctcttgaagatcccttctaccaatgctacaagggtatgtatgtttcagaaaaacataaccaattggttagtcagttttttttaacctaatgagataggcttgtagcaatactgaagacatagttatggcatactgaatgcttccctttcagcctccttctttttcttcatgctaggtcagtgccttgtataaagaactctatctaatacatcacaatgtcatggtttataactggtcctgctaaccctggg

SEQ ID NO: 77702 - DNA, 1075 bp, Homo sapiens
tgcaggagaaaagggaacagtttgctaccagactgagctcagtgtgtagtctctgagtgggcctgattgttcttcccatgaactgctaatgatcccctcacagaccctgcctcctctgaactcactcactcagggctttatcccagagacatcgagctggtcaccaggcaccagcccttctgactgtggctctggggaggctctgggaacatttgaaaaggcagaagcaatcaactcctgggcctatgataatgaccataagtgtccagcctggacagctaccagcaagggcagatccgggctcaaccctggcacccctgggaaccctggagggggctgggctacagccccgtggggatgagatagcggaattgtggcatggaattgggctacagagagcatgtggcttagaccaggaggatacagacactcaggctgggggccagagccctcctgaacaacttgagggagggaggaagtgagacttgagccaggcccaaaagtacactgtaatttcagaaccccagcaagtgagcaacagccttctcagagcctccctcccagccttcctgatcccttatatgcgtaggaaaaaccacttttggggttaggggccctctggaatgagcttcaaatggctcagtttaaagtgttcaggaaccactgatgtgtactaacttagtgtagatattcaccaccatcattgctaccaccgctgccattaccatcactatcatcgccaccccatcttcattaccactgtcaccatcatcaccgccatcatcacctccatcaccaccactgttaacccaaccatcacaaccattacgctaaccaccactatcatcatcattaccatcatcaccccatcatcattaccgctatcaccatcgccaccaccactgccatcaccaccaccaataccacctccaccaccatataaccaccatcactatcaccaccagcattttaaccttcaacaccaccatcacctccatcacgagtatcaccatcaccaccattgtcaaccgaaccatcaccaccaccattaccctaaccatcactatcatcacca

SEQ ID NO: 77703 - DNA, 1114 bp, Homo sapiens
agcagccctcagcctgggtggggctcattcaacttcatgacacccaagatatggaaactccaaaagaaatgtctttattcttttaactttctcaatatttacaaagaacaagaagaacaagaacaacaactgagattggctcgcagagtgggtggcaggtaaacagatgcgtctctctggcttctggggtgactgcaaggcaaggaagggcaacatcccagtacctatggtctgcacagggacagcgggacaagctgctgggccctggcctgcctggggaggggccaaccaggtccagcctcccagcttccaaggctgcaaggctgaagggtcactgcctgaggagccctgccccaatcctgccctccactcccatgcgcacacaaacggaagaggccacactgtggcccagccacctcctcacaggagagcgcctcggggacctcgacactcctgcaggccagaggtgggggctgaggccctctccgcgtggctagaggtagccaaagacattgaagatgggtgggggcacggctggcttggtggggatgggtttcagcaccacgggcctgcacaccttctgccccaggccgtccacatccttgcagaggtgcgccagctccccgggaaaggctgggctcttcctccaaaggcccaggctggggacaggactctgaggcagtgcccccagggggcccggatagatgggctgtccatggtactggaaggggcagcaactccaggcattgacgcggcccaccaaggagaccccaggcatcttgagcggctccttttcagccagggcccttggagacatggacaccagggtagtctcaggtcccaggggctccaagcccttgcaatttttcttaccctcatagggaggtccctccctggggcccagtcccccctccagccccacatggtagctgtgggtgggccttggctcttcccagaaggaagcgggcagctgtcttttcctcatgggcacctggccaggctgggcagcttctggatgctgcctctgtgggagctgctccttagcaagacattcctccctgtaggggttcctcagcaccttctccttgcagcccccacccccgccggggctgga

SEQ ID NO: 77704 - DNA, 1103 bp, Homo sapiens
tccactttgggcagcagaagcctgtgttgaggggacatggttcaggggatcctagcctgggtgtgcacagtgtctgtgcttggacacatccgctgccgtccctggccgcaggctcttgcaggtgggatgaactcacttcttggtcccggcatgttctctttcagttctgtgagttcgtatctgccccagaggtgagccgctgggcggggcccatcatcgatgtcctcctggactacgtgggcaacgtgcagctctgctcgcggctgaaggaacacatcgacagctttgaggactgggccgtcatcaaggagaaggcaggtagggacttgctgctgctgccaaggctggcagatctccctgcctgactcagagtcccaggcctcagggagtgcgactgttcctaaccctgtgagcacctgctgcttgccaggctctgtaactccttggatgaaacatgaggaatctgcctctcagagagctgtgccacctgggccaaagtcacagttagttagtggcagagctgggattaaaacccaggtttgaccaaccccagagtctctccgctacatctttccatgatgttttaaacagctacagctccctgaggggtaccgggaccttcagggtaggttgtgaatgatttggggccaccaagaggcattgtaggaggggagaggggaggatggtggtctaggatgtctcaaactaaagtgcacatgaagcacctgagtgtcctgttaaaaatgcagcttctgattccgcaggtctggggcggggccggggagtctgcatttcaacaggctcccaggtgacaccaaggctgttggtgcacagaacaccctggtgtgggagacaggcccctgaaccctggagccagccttgccagggccttgctgggtgaggcctctccccacctgaacagaggggcctgggcaggctcgttgtccagctcctttcagctggacccgcctgaactgtgccaggcacagtgaagtggagttcggccactgtccctctgatgtgtgcagagtagatggggctgcctggctaagtcaggctgaggaagccagaatccctcttaggcatttttggagctcacctgg

SEQ ID NO: 77705 - DNA, 1070 bp, Homo sapiens
ccgcgggacgggggtcggacgcgaggctcagcccccagctcgcccccgccgctttccgaccccctgaaatacggagtccggacggatactgagggccaagtcgcgcccccctgtaccccgtggatgtgcagctgaggaggtccagctcggccccgagcccccgcccccagcgtgtccgccccaggtggcccggggcgccgcctcgacggcgctgggtgggcgccctcgacggaagcagggacagggaggctgcagcactacgggtcgcctcctctttgttaagtagccccccagtcagcagtccacggccccacccacccgacggctcggccgtcaaagacctcctggcccctgccccaaccccaagggaggatctaggggttgcacggggcaccaggtcgtctgctccgtgggcgactagaccgtctccatctttggagtcaggacccacctagagaggatgcctcaagttgtgaggcgcatgagttaggggtcggggaaaagaaaatactcaggaatccctgatggagagccttgtctgcgcagaacgaggcccagagaccctctgagccaggctaaccctgggcttgggcaggtggggaaactgaggccagacagggcagggctggtactgattgtggtggacctggggcttgaacccaggctctggactctcagttcagtgctctttgtgttacatcggctcaccttccaggttgccgtggggtcaggcatcctgcaggggactgggtggcatggctgcctaagacccttcaaccctgagcagggggagcctgtggagtgagggctgggtggcttgagtcggggccacacagccccaggttcaagtctcacttccacctgttggaaagcgaagaggctttggttggtccgctctccccctcagcaccgttttgcacatctgtgtcatgggaaccatgtgatatgattagctggagcttttcctgtgacaacagagtcctggaaatgggtgtgcacagatgcctggttcttcaagcttagcctcctctctcctatgactgggcaggaaaatgggtcaccacggcagc

SEQ ID NO: 77706 - DNA, 1050 bp, Homo sapiens
gagctgctcctggaaggcagcccaggtgtttctgcatcacccaccagggagtggtggagctggggtaatgatgggcttagccacccgggagctggaggctggcatgccctctggccaccactcggcagctgagagcacagcagaggcggtagctgctctttgtgccatgcagtgaggccgctcactctgctccctatctgccctgactcaggagactggaagttagatggcagatggggtccaaagccctcacccctcaccgggggcttgggtgccttggcgaaggatgaagtggttaacccactaaaatatgacgtctgtctggtaatcacaggggtggaggccatgcagggtcttttcccttccctgcacatggcatttattgagcacctactgcatgcggggaccatactgggccctgtgctgcatggtgggtttttatgttgaacttgcattgtgtggatggtggtgacagaaggaatatccttggaaaatacagcatcttctttactttcctgtttctacatcactgggctaagcttgaggaagggcgccccgtggaagacacaaagacacttgggaaggtaggggtgagacaaggaccagacctctggcagggactgcaaatagctagggttctcgtgcactcaaggtgcatttcatgtttgacgaatgaatgagtcagacataagcaggaaaaccgcagggtcctattgtgctttgttctgttatttgtcaaacaggcccccagtgggcacctttgtcaggcctgtgctgggcactgtgacactgatgagaaagacaaggtgcctgcccgctgtaggagctcactgcctgctggccaagacagctggacacaagcagtgtctgagctacaggtcatgcctaagaggcctaaggacattgggaacacagtgagaggtcaatatgctctgagggagtgggggtgttggaaggttctgcagaggaggtcttttgagctgagttgaaggatgtatatgagtgttcaagaaggatttgggaagggcacattccttttggcgggtgcgg

SEQ ID NO: 77707 - DNA, 1975 bp, Homo sapiens
ttaaaataaatactaaaaatcctaccaagttaccatagtccatagtggataggcctcgttcccaggggctttgcccaaaaggctgcacattttcttgctacagtctaaattgcttaaaaaattgaagagccggaatgttccattcagaatgcagtcccattaggtgacaggttccactgcatggcctaaaattaatcaatgtttatcggctgcataaaggatgttgtagtgggatgttttatagagcaggtaaacggaaggggtggcggcctcagggaacacgtggtggttcagggcggtatccatctcgtccacgtactccacttgcagggcaatgctcagggcctgcgacaacgccgtgatctggatgtggtcacactccgtggccatgggctctacttcctgcaggggccaaaatgaaaacaagccagcttaggagggaggcctggcagaggacaagtgagttcagctctggctctcagggtcatggtcacagcctctgtgctgggacgtcatcttcacaacatcccatgagttgggtatggacgttctcatgccacacgggaaacagcctcattgagaggcagcatagctagaaatcgctacaattgcaagaatcgaacctgaatcttttccattctagaccttgtagttacacctgacagcaggctactaatttagagggatctggaaacggggggcagacatttttcaggttgggcatcaaagaatcttagagataaaaggcaccctgtcatccaggggtgcctttcaagcttaagtgtttacagaggctaggctggtgagtgagggtgcgagtccgggtgctgcagagacgatggaagaagcagaggcggtggcaagcaggcgtatgtcctacatagagagggcagctgctgcttagtgcctgctgagactgccctgcaagagcaaggacctgggggctgtacttcttactttccagcagaaatccaaatattcatatgaaaagtgcctaatttttaaatatcggcaactctttctggtaaataccatgcatcataaacacgtcaagcaaatgtgactcttggactatgactgtggttttgtaaacaggccagtccaaatcccttatttttcagatgggaaatctccagagaggggaagtgacttgcctcaggccacacagctcaggcagctcaggtgggacctgtctgcagcttgctgacctagctctgtttgaattgcaagggcagtcgtgacacccgagtcccttggctacggatgggtgctgaagtctgcaggacagggccacaggagcagagcccagggctggggctgagaccccaagcacctacgtgagtgcagaagtctttgatgtccatctcctcatcaatgaagtgccggaagaagtctgctcggttcctgatgaaggccgacgtgagcaggcgcaggaactgcacgatgtggtccgaggcactctggtcgttgaacaccttcagcaggctggacactgagccatccttctctaccagttccaccacactgtaaaactgcgcccgcccggccctcagctagggaggccaagcaagccccagccctccctctgcattctccctccgctccctcccttcgcgtgaagccctcacgtgcattttcatttgtagattctcaggttgagttagaaaatcagtctgagattctgcctaagctaagtaacccagggttagcaagactttgcagtttgtacactagtccagaggcatgtttgggagcggcagttgggtctccccaccatgactacctgggtttggattctcacgtgcacactcagagtggcaagcgtctgagagtcctcgatcccgccccttcactaattggatagggaggcatgaggtggagatggaatagggtgagggaatagggtgagggctccctgtgcccacacacccccacaagcaggaaggaaccctctgtccttccccagccaggagga

SEQ ID NO: 77708 - DNA, 1084 bp, Homo sapiens
gacagctatcagagaatggcagggagactctccattttccaaatgatgcagtggtggtcagtggggttagtaagcgggcttaatatcccctaatggcacctgagccgtgggagtgaagccacttgccataagccaaacatagatcccctgatgactgtccgtgtcctgccctagccatctaacagcaaattcttttccttggtggaggagctaatacgtagacaggctttaaaaggcaggagcagccttccaagcagtgctactctcgcctggtaaggtgaagttggtgggcagagcttccggagtgtcctggatctgccattaaacaaggaatatccctccccagctaatctacttaatacataagcaccacggaaaagcagagttcttggctgcatgccaggtacccagtattaagaagccaggacaaaagtagttatggaaaccattttaatgctaggagaatgtttttacttactgcctagggaagctgtagggcttggcccacatccagcagggcctggggcccctggaagccactcactgagttacagccccctccccactcctgtatctgctcagggtggtgatgtgtttgctcctagactctctctcatggttcccctgacactcctgcttgggaagccaccgagtcactgccaaggtgacatgcttccccatctgcagtgccctatgcttcctgtcaggaaggacaggttggggaatatccctttgcagagcccatacgatgagtgtgtcaggtataatagctattttcacacaaggaatctcattctgttttaaccaataatccagtgacacataggtattgttgccatttcacaaacttgggaattggggctcagggaggtgaagtgacttggccaagatcatacagctagtaagtgaatgctgaagttagaaccctggcattctggctccagagctctcatttgtgcttaaaataggaacccagtcaaaagcagggactgtgctctttctgttgctaattgttcccattgatttaaaagtttcctttggagagaaagtatcataataaacatgcagttgtaaaaacaagctc

SEQ ID NO: 77709 - DNA, 2097 bp, Homo sapiens
gcagagatgttgacacctcggtgcccaagtcagcaaattcagaggcagacttaactgctgtctgctcagcatggaagccaggagccaaaccagtgggcttgatgacagtgagctatttctggtggctcagggttggggcttgggccgaagatgtggaggccctggcttcccttcctgaggacagactgaggtggaaccttttggctctgccagcttctccatgtgcagtcacagcactggtggcaaggcataggagagctgggctacaaagaagcattcagtgtctcctggggcggcagggaggtgggggttgtaattgtgaactcaccaaaccccaggtgggcagtaagtgggtgggtcataggaagaaaagtgatcttcagtcaggagacttgggttctgggctctgtctgatgactggctctgtgatgtgagccaggtgacttctctaaccctgagttgcctcatctgtaaagataattccagtcttggaggatttttatggagtaaaaaaggacagagcggtcctgtgtatcccctgcaaatggttagacgttatccatttacagcccctgccaagccaccactagcttcttcagagaacttttgaaccctgcctccctaaagtagttctaaaacatttttcactgtgttacccatcaagggaaacaaaatgtttctacaaaccatagtaaataggatcgtttttgtattgtgtttcaaggaggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcagagccattgtgtcatcctgattttttttttttttttttagatagaagatgggggtggtggtgtagtttgtttcattattaacttagtgattctcctgggccagcacagtgctaagcccttgaaaggacaggaatagtgtcaggcctctggctgcaggccaagattggacagtgtgaatggagcaagaggctggaatgttcaagaggtgcatgttcctgctttacccagagcagcaccctaatagctccttagctctctccactctcctgggtattgtctgagccaccgtgggaggtgggcagggatgaggttgctgtcttcaggcttccctcacatcacagagccaacagtaacagtcgctaggtctggcgtgtgaagccctcaggatctagccccagccttgtctccactccctcctgtttgacagagcaggctcctgcccacggttccatgcaccccttctcttgtcctgagcctttgtgcagaataggcttttccctcggtctggattgccttttggccttctccatcctggagcactgccatgggtcctctagtcctgagcctctaaggggaagcagtgcttctcctggggctcccttagtgtcccgtgcttaccctcttcatagcacttgccatgctgtgttcccttagctgagctccttgggagaagaggaactcaaggcttggtcagcctggtataaatatgtgctcagggaactagggacttcctgatgctgccccagctttgtctggatcagtgtaggtgagtatccacaactcccacaaccatgggagaagcatagatgatttctgcacagctgtctggcttcc

SEQ ID NO: 77710 - DNA, 1103 bp, Homo sapiens
tcaggtgatccgcccgccttggcctcccagagtgctaggattacaggtgtgagccaccatgcccggctcaagagctttttaaaaacactacttgctgggcacggtggctcacgcctgtaatcccaacactttaggaggctgaagtggaaagattgcttgagcacaggagttcaagaccagcctagacaacacagttgagaccctgtctttacgaaaaaaaaaaaaaaaaaaaaaaaaaaaaagaaattacctaggcatggtggtgcctcccagctgcttgggaggctgaggtgggaggattgcttgatccaaggaggttgaggctgcagtgagccatgatcatgccactgctctccagcctgggcagcagagtgatacctgccttaaacacacaaacacaactcaagtgagactttgcttcccagaggcctgaactctatttcagatgaatattttctgttacttccccccaggagcgaatccgtttagctcgacagattgagaaatctgagtatcggaacttccaggcttgcctgcacaactcttggattgagcaggcagcagctgccctggagattgagctggaagaagacatgtataagggtaagcccttgggcgggatgggaattgaggaagttgaaatctctctttaacttttgctttgttggaaccatctctactactgtgggtcttgtcaaaatcagcaaggcgtccttccccctctttgctaacaggccctggtcccaggtgagcctactgccctcggtcagtctttgtttcctctgtctctgtcttgtgccctcagctgcctcctcttacatggacaggcagtggagtacagtgaggaagggagcaggctctctggccaggctgcctgtgttagaatgccggctcattgccttaactatgtgactgagtcaagttatttaacctctgttgtgttctcagctttctcctccataaaatggaagtagtcaactacctacttcatgggattgttgtgaagactgattgagttaaaaaatgttaagtgcttatagcattgcctggcaaatagaaagtattacattttaagttatttgtcattatggttcctactacac

SEQ ID NO: 77711 - DNA, 1065 bp, Homo sapiens
gggctagattgctctacaatgctgcagaagtttctacctgcctggctgggaggtaggagggtctggtttggggatgtggccctgaggagaggaccagtgtttggcagtggccatgtattgatctcccagttcttcctgtggcaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggtagaaagcagttaaaaccccagtgctaatgaagggattgtgctgctcccttgcagagcaccttgctgtgggactctggcagcataacccttgaaaactaaggaatggttctgccaacagctgaacaaggagacttgtagaaaggattgagagcaacatacctgggaaaagggagaaaaggggagtgactgaaggtgggaggcattttctccctgaaccatttcttccttctctggccctgaagtcccccctcctcaccagacagtgcagtggtcatggctgtctggatatcctgtcagagggttgtagacagtgtggttagtgtttcctgctgaggcagatgctacaggtttggcacatccctggagcaggtgccagtaaattctgtcttttgggttttaactcagcaggcattccccaggtaggtgccgcttaccatgggacactgtattagtgaccaaagtggggtgggttctccttcccagaggtttgccagctgtgaataaagttcaggtacagtggagcagtatggaattactgggcatatggttacattgggaggagaagaggttctatcccagcttcctgctggcaaagatgtggaagggtacagaggaggtggaattccaggaattgagggagcaaaaccatggcacagttcaaggaatgttggcttctctggctcaaaaggaatattagctgtgtggggaaatagggtggagataaggatgg

SEQ ID NO: 77712 - DNA, 1839 bp, Homo sapiens
aggtgacatggtgtgggcaatgccttcttctcatcgcagaatgctatggtgtggtatcatccagaccctggcctttagaaagccaagagtgcatgagggagattagttgagggcctgatggtggtggtggtagtggggtgtgtacgtgtgtgtgtgtgtgtgtttaggatgagtgtagggtgtgctatagatgattcctcttaacccgctgctgaccaatgatatgggtctctctggatctgcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagagtaagttaggactgtccccagaggcttaacctctagttagttactggggtaaaaggggtcaggatggtggggaaatggtagaaaagccaccttctgtcataggggccttgtctcagtagtaggtagcctttttttttttttgcacagcatttggcaaggttactgtcatttagtgaatttggttgcagttaaatgccatacagaaacttcaatactaatgaatataggtgacaatacataatattgaatgtatagacaatagattaggtcctgtgctggcactttagattcagaatcacattcagttactctcctaacatccttaagaggaagcagaatagattcatggttaagagcacagatcctggaaccagaatgcctgaaatcaaatcctagttctgtcactccttaggtggtcaagttatttaatttctctgtactttaattttctcattatttggataataatagaacccattctagggttgttatgaagattgattgtaaattcatgcgtgtaaagtgtttagaacagtctctagcacatagtatgtatatattgctaaatgttagctttaataatttctagtccctttactacttattaccattatcactattctcatttatagatggaaaaatgaggtctagaaaagctgatcagtgtgcccaaggtttctctgcctggaagtggtagagctgggcctcagacaagcctgtcggacctcagagcccatgctatttcttattcctgatgtctttgtccatctgcctttggaccagactgatgctcagggaatggggtgcagattgtcaagatgagggcctggaaagttgaggcagactacaaagtgtcttttgccagtgttttgtcaggtcatggggtaattagtttctagaacaagtgtttgatttactggtttttaaaaattggtaagtagtatcagtggtttactgagattagcttagaacaaggcttggcaaactataggcctcgtgccaaatcttgcttgctgccctttttttttctaagatggggtcttgctatgttgcccaggttagacttgaactcacgggc

SEQ ID NO: 77713 - DNA, 1173 bp, Homo sapiens
ttaagaaaattttcttttactcctttctcaccaaagaaaagtcttgggaaagtattgtatggattactgtttcctgctcctcacagaaacaacacatacacccaaaacttgccctttctctctttattgtttcatttcttggacatttgtaattcgttactggtgacctaagacctcagtgctagcctgccatacttttcctcgggttctaatttacatgtgccttctggttccttctggggaaatctgtgtagagtggaggagctttgggtcggtcagggtggcacttggctaccttattctatgcaaaagaatgaattccagactaaagtatgttcatctgttgattcacactgtttttactttgttttgtttttttacttttaaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggtgaggtttagttccatttaataaatattttctaggtaaatcccaaatgctcgttggtaaagatgaatgagctgtggctcctgccctctagggtaagccactctcatctataagccagacaattaagccctacagaaaattgatatagtgacattttttcagttccctcaaggataatacatggttggtgccattgtggatgcataggaaatttattggatacagtagatgctcagggcagggattagcaaactgtctgg

SEQ ID NO: 77714 - DNA, 1355 bp, Homo sapiens
cctgcccccacaagaaaaacccctgagattcttactctgccttcagaacgacttaggtgtggcaggtttcatcctccgtgctttacataattttctttatttacataaaatgtacaacttagatattgttaggtaccctcccccctttttatagatgagagcactgaagttcagagaggagtgggtggcactatccaaggtcacacaggcagtaagtgttggatttggaattcaaaccaggtctagctcatatgtctttgttccatcacatgtgtaccctgtgttccaggcaaagctgtctgttctgtggtattctttgttcttctctaggtgggagcaactgtgtgatagccatctttgtatcctcagttctttgtagggcctagttgcttagaaaatatttgttacatcagaaccctctgcttctcagacaccaacctaatagaacatgtatctccttttcagcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggtaagggcaactctggccaaagcaggattgcttctggattgagcccatagctgctaataggccagataattgggagagagaagaatgttgaagaacataaccacaaaagcaacgctgaataaaggtgtttagaagtcagcccctctggtttgaaatatgctcttctt

SEQ ID NO: 77715 - DNA, 1054 bp, Homo sapiens
ctcatgaatcttgctaatcactgaaatacagacttaggaatggtaaaacatatctccctttgttatttctgtttattgtcttcacttcatttttccctctcagattttgattttcagtgatctcatctagtcctttacaccctttattttagtggtggaatgtggcaatcagggatagggaaaatgatgaggtataatcattaaaggtatcttagaacctggcatatttcaattattcatatttaacctatttgaaagtcttttataaatatcatgattttataatgaagagggctattacactattatgttaattactaaaacctcccacatttatgatctttaatagcccagatattttatatgtccctgatcttcagtgttttaatatagaagtccctattatttaatttcaaaataatcaatgctatctctaaaaatacacagatattttgtaattttagagttcctttaccttttactagcactattcatgataaatatatttttcagttttattcaataagattcttttcagaatttgtgaaacttaaacacttgctcttttggagtaagccaatgatttatttaatgcttttctatattgtgtattttaaggagaaatatcttcctgatggatataatacaggcttgttggagacagctatttccctctctgcaaggagtgtattatgttgttttacaaaatgctttcttgcaccactcatgttaactaaagagcgaatttaaacacagacgtgtctactgcactttccttccttgaatgggtacagtttttaaaacttggaaacgtgccattaactcttaatgtctcatttcatttttgaggaattcaagttgggatgccagccgtacaatagtaatgtaagaggaatggtaactggcttaaggcatgcacttaagcaatagaggaatttacttttcagtgtcttccaaggtccatgaggatgcacacttatttatccagagagtatggatctcacatatgtttgtccagagggtgtgactctgtggaggagaacacttactggta

SEQ ID NO: 77716 - DNA, 1070 bp, Homo sapiens
aggtaggacacctagagtgatatatcatcttctatatagaaattagttaccataatttcatgtattaggtgaatggaaaataatttataccctgaaatctagatagaaatatattatttaggtttctgcagttactactgataagtttttctaattagtccagatttttgctgaagttgcttaaaatggaaaactatattataatttataaagtttgatataaactcttagttattaagatttctgtaggtaacaatattatgctggaggaagtgggattgattgaaatcattatgaaattactattaatgtttcttatatgtatggtgtgctttcccaataagactgaaagcttctggagagcaggaacagtatctttatgatttttcatattttctgcagcaactagcccagtcactggtttttagtaagttcctgctacacatttattgatttgatttattttcttctattgcttattgtgcaggacagaacttacaaaaagtgtggtgctccctgaattaatagaactttctagggatgaaggcagcagtgtacgacttgcagcttttgaaactttggttaatctgcttgatatatttgatacaggtaaatcatgtggctacatctttgcttctgaaaacagtgtttttctacatgttttatgtcactaataaggaataaaagtagatttagaatttcctatgttaagcctcccttcctctccctctttttatgattcattctgttttcgtgtcttcttggctttcacttttaccctcatggtgtcgtagtccattttgtgttgctgtaacagaatacctgagaccaggtaatttataaaggaatttattttggcccacatttctagaggctgggaagttcaagatcaggcagccccatctgacctgtttctgatgagggcctcatgccacctcgtaatctggcagagaagtggaaggtgaagcaggcctgcaaaagggagagggaacaaaagaagctgactttgtaacaacctgctctccagagaactaacccagtcccacgagagctaacccagtcacttgtga

SEQ ID NO: 77717 - DNA, 1078 bp, Homo sapiens
gcacttgagatttttggaattttataagaaactttgtacattgggtttgcaacaagaaaatggacacaatgaaaaccagattccaccccaaatcctagagcaggagaagaaatatatttcagtacggaagaactgtgcttataactttccggtaataaatatgtatttatatttactgaggatttttattataactttaaaatatgtgcatagatggcattcaaaatattgccatttttgacacttgctgcttgcattatgtctagcatacatagtatgtgcagagtaaatatttgtgaaatttatatctctacgtataaatcagaataatagacacatatttggatcttccaaatatgatttttagttaaattacaattcagagaacatgatttcaatttaagtgaaacgattataatattaggtattgatgcatgtttttctttccttcccactcatctcctcccttccacctccaccaggccatgattgtttttgttgatcctaaaaacttccacatggaactctattctacattcttctgcctttgccatgaccctgaagtaccagtcagatacactattgctatttgcttttatgaagtaagtctgaagacttgatatcactttacgtttgttgttaattctacctatgtatactagatgattttgtgcttatagattataagatatagactggatatctctttcatgttctagtcttaaatcttgtttaaaaatttccttaattttcttcttttttagtatgtttactgaatcatttccataaatacattatatttgtgtattcttttattaacccattcattcagcatatctataccaagtgtttaaaccagacattgtggtagatatgggtgatgcggattttaaagtaaaatcagtttttatatgctttataatatttacagttaactttgcacctaaacttaagcacttgagaaccaatagaaaattgagacacattaattatttttactacaaatggatggtgtttcgtgagcatggcttttagattctgctattatgactataaagtaagagcaaaaataaattga

SEQ ID NO: 77718 - DNA, 1047 bp, Homo sapiens
cctcagcacatcctgctgctggtaaaagatattcagaatccggactgggcgcggtggctcctgcctgtaatcccagcactttgggaggccaaggcaggcggatcacaagttcaggagatcgagaccatcctgtataacatggtgaaaccctgtctctactaaaaatacaaaaagaaattagccaggcatggtggcgggcacctgtagtcccagctactcgggaggctgaggcaggagaatggcatgaacctgggaggcggagcctgcagtgagccgagatcacaccactgcattccagcctgggcgacagagcaagactctgtctcaaaaaaaaaaaaaaatggtattcagaatccaactacttctcaccaccttttactgctaccactctggttcaatgtaccatcatctcttgcctgaattattgtaagagcttttcctattgtttctctttttctgttcttgactagctgcagtctaatttcaacacagtagacagatgatgcttgtaaaacattgtcagatcatttcacccctctgctgaaaacctaccaatggcttcttgtcatactcaaaataaaagacaatttccttacagtagccctcaaagcctcttatttaccactctgagctctcctgctagtctcaccttcactctgtttaggcatagtggccaatttgctcatttggaccaacagtagagacaagctctctatatttgctgtgatgctcttttccagatattcacatagctcattccctaattttctttaggtctttgcttaaatatcatcttttcagtggaaccttcaatgacaaccctctttggccacctgctttaaaactgattaatcccctgcccctggtactcccttgtctttattcttcactttatttttctccatagcatttaacactatctgacagattttacttgtttcttttctcttctctgctcccatactagaatgtaagttccaggagagcagagaattttgttggttttatttactgttgtatctcagcatccagaatgatgaatgtttg

SEQ ID NO: 77719 - DNA, 1076 bp, Homo sapiens
cagaatggaaatgtctatggatgctgtaagtatactctctttaccttattgtgttggtccattttcatgctgctgaaaaagacatacccaagactgggcaatttacaaaagaaagaggtttaattgaactcacagttccacgtggctggggaggcctcacaatcgtgacagaaggcaaggaggagcaagtcacatcttacatggatggcggcaggcaaagagagagcttgtgcagggaaactcccccttacaataccatcagatctcgagagactcattcactatcatgagaagagcataggaaagacccacccccataattcagtcatctcccacccggtccctcccacaacatgtgggaattaggggagctacaagatgaaatttggatggggacacagagtcaaaccatatcatttatattgaaaggaatattttaaacttggcagaaactcatcactaatgtttcacaatttcattttaaactttaaacagtttcagaaaaagttttatgagaaagatttgttggatcaagagaaagaaagagaagaactacttcttttggaaatggtatgttgttttcacatgcacacacatatactcttttctgattaataactgtgtttttttattaaacttaatcatttctttccatttcaccatttcacattactcttttttcttcttaaatgatagtccagttttttgaaatctgttcttttatgaactagatagaaaactatatttgagagccttttaaaaaaactactttgctgaagtataattgacaactacatatatttaaagtgtactatttaatgaattttgacatatcgatgaaaccatcaccacaatgaaaatatgaaacatttctattcctttaaagatttctgcccctttgtaatccatgtcttctactctagtccccaacaaccaatgatatagtttctgtcactgtagattagcttgcatttccataatttatataaatggaatcatatattaggtattaatactatttttggtcctgcatctttctaccaacataattactttgagattcatccatattatcg

SEQ ID NO: 77720 - DNA, 1031 bp, Homo sapiens
cacatccctgtaataccagtgagtaataattgctaatgagacatttttccttttatggaacaaaggctgtcccatttctcctcaggcaccagcctcccacatgttgtcatgcctctttcccccactttccctaaaccttctttctctcttgcactccttattccctggttcctattgatttctcatttagcacaaggaactaggtctttcttttgtggcccttttcccaatccaagcctgctgggctctccctcacccccaataacttttactcttgccaagctacttctctaaaccaaagcagggtccctcctatgagggactctgggcacttccactgctgcggaagcagggtcgagcagggcgacccttgcactcacaccttctccaactgcttgctccaccttcagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcaggtgattcttcctggcccccaaagaccccacatctctccacgtcaaggtctcaccaatgtccagggacaagggcatggtggtgggagaactcatacagggacaggtggaatttacacttactttgccctatgctgcctacatggctttgggcttgatttttctttttcttctttaagacaatgacatcagacaggacaaggggctgaggcttcctctgactccagcatgttctaagtcatgagaaatcttctgcacagtcccaaacactcatgcatggtttctcctggtctcaatctcttgaagggagagagaaacagaaggaattgtgatcagttgagggctgcagt

SEQ ID NO: 77721 - DNA, 1050 bp, Homo sapiens
atgttgcttagaagaaaaatgctttacattgttcttgctcttcctcccaacagtagtggctgttttgggggcaaaatagactctcaactcagacacaaagggatgcatatgaggtgctccattctttacctcgatggctctgggcaaatcatactcagcatctgggtctccatttgcacatctaggcatcaggactgtgcaaaactagttggcaggggagttgggaggagcaaacattcaacagcacaaagacaggccagcactaggtgctcaatgcacattagaccccttagtggcacacaggcaggtcgctgaactcctgcgcatctgtgtttcccgtgtgtaatgttctgctgtccccacaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggacacgttgcttgtgcctttccatgctgactatcagactctgcgcccctgaggctacctgtgccccaaagacaagccccttgagctcccatgcaggctcagctccaccccaagatctgggctccttctgccttcagctgcagcagcctgcccaggactacctaagcttgtggccaagctcacccagacctcaggcccagggttgggaggggaccctgctgctctaaggccaattcctgcccccc

SEQ ID NO: 77722 - DNA, 1034 bp, Homo sapiens
gcaaggattcccaagtgattccttagagccacagggagctctaagcgagtttaaacacagaggtgatggaagcagctttacacactagagaaggaccctggctgctgagtagaaaagtgattcatagcccaggacaaggatgtgggttggacatcgagggggctctgtgggaactggggcaaaataggtcagagctggggagggagagcgggatgattctgttggaaggctttgaggagaatgggtgtgaatttatgattgcaggtggggtggaagggagaataactatttgggtttgggtgcctgggtgatccccagttctctgaataggaaacccagcagggacttgctggcaagggaagtcgatacattcagatttgaacctcccatgtctgaggttcctgggagacaccccaggggtttgttcaggaagcagctaggctgaggtcaggagagaaatctgggctggagggaagcattcaggatcctcccctgggatgggcaagtgagtattgagggtgtcccctcaaatgagtgccatggagtgaaaagaaaagggaaacctcaatgactggctaagaaagggcagcccaccgaggaaagtcaccagcgtggggcaggagacaagaggacaggacgaaagctgtcgccgcaggaacaagaggagatacttatccgggggagaggggagaaaacctagagacaaatgatgaatgaatggaatgaatgggtctgtgggatttagtgatctaaaaccactcggggatcacaagtgcaatgttagcagaattaagggaggaccacagtgggctggagagtgagcaggagagggagagagggaaggcaagacagcgtgtagggaaaaaagagatcagactgttactgtgtctatgtagaaaggaaagacataaaagactccattttgaaaaagacctgtactttgaacaattgctttgctgagatgttgttaatttgtagctttgccccagccactttgccccaaccttgagctcacaaaaacatgtgttgtatga

SEQ ID NO: 77723 - DNA, 1377 bp, Homo sapiens
ccattcagtggcctgagcagtgggagctgcagaccagtcttccatggcaggctgagcactcctgtcttcagtagggaactactgaataggcacagagggcacctgtacaccttcagaccagtctgcaacctcaggcttagtagcagtgaactcaggagctggagcagtccattcaccctgaaattcctccttggtcactgccttttcagtagcagcctgctcttctttttcaatctcttcaggatctctgtagaagtagagatcaggcatgacctcccataggtgttcacgagaaatggtgccacgcatgcgcagaacttcccgagccagcgtccaccacatcaaacccactgagcgagctccctggttgttgcatggaatggcaatgtccacatagcgcagaggagaatctgtgttacacagagcaatggtaggtaggttaacataagatgcctccgtgagaggctggtggtcagccctggggtcagtaaccacaagaagccttggctcccagaagtctgcctggatctggttagtgaaggttccaggagtgaagtgaccagcaattggagtggcttcagtggcagcagcaaacttcagcacagccctctggccagtattcctggaggatataacactgacatcagcagggttttcaatagcaataatagcacgagctgccagcagaagcttctcccaggtcctcttcagatttatgatatagatgccatcacttttccttttatagatgtactgttccatctggaagtcaagattggtgccacctaagtgggttcctgctacaaggaacttaaggacatcctcctccttcatttgcaggacatcaagcgctccagacattgtgaaagtttccctttaagttacgacgggaatccagaacgacgctgtatggacccctctgtaggtagcgcggaaaggctatcttttcaaaattaatgggcaatgccattttttttgtacttaaaaggagactttgcaaagatgagtcaagtttggaaggatggttgtgtgcagactcatttttgtagttctgaggagcaaaaatgcctaaatctagctgcatgcttcttttccagaacatgacaccctgcccctttatttgttgaaatggttgaagctctgcaccatcaaaaaggctgaattgcttttgccactgtaacagactgaaagcctgtgatgacggggcagtgatgtcgacttgggcagaatggagcccgtgaattattgggacgccctcggtttctcagtccagtacagtatgctcttctctgtctctatttttgtgattttttggtggcacagatcctctggaaaacattggtctatgctgaccttataatattgcaacacatgata

SEQ ID NO: 77724 - DNA, 1784 bp, Homo sapiens
aggctttcagtctgttacagtggcaaaagcaattcagcctttttgatggtgcagagcttcaaccatttcaacaaataaaggggcagggtgtcatgttctggaaaagaagcatgcagctagatttaggcatttttgctcctcagaactacaaaaatgagtctgcacacaaccatccttccaaacttgactcatctttgcaaagtctccttttaagtacaaaaaaaatggcattgcccattaattttgaaaagatagcctttccgcgctacctacagaggggtccatacagcgtcgttctggattcccgtcgtaacttaaagggaaactttcacaatgtctggagcgcttgatgtcctgcaaatgaaggaggaggatgtccttaagttccttgtagcaggaacccacttaggtggcaccaatcttgacttccagatggaacagtacatctataaaaggaaaagtgatggcatctatatcataaatctgaagaggacctgggagaagcttctgctggcagctcgtgctattattgctattgaaaaccctgctgatgtcagtgttatatcctccaggaatactggccagagggctgtgctgaagtttgctgctgccactgaagccactccaattgctggtcacttcactcctggaaccttcactaaccagatccaggcagacttctgggagccaaggcttcttgtggttactgaccccagggctgaccaccagcctctcacggaggcatcttatgttaacctacctaccattgctctgtgtaacacagattctcctctgcgctatgtggacattgccattccatgcaacaaccagggagctcgctcagtgggtttgatgtggtggacgctggctcgggaagttctgcgcatgcgtggcaccatttctcgtgaacacctatgggaggtcatgcctgatctctacttctacagagatcctgaagagattgaaaaagaagagcaggctgctactgaaaaggcagtgaccaaggaggaatttcagggtgaatggactgctccagctcctgagttcactgctactaagcctgaggttgcagactggtctgaaggtgtacaggtgccctctgtgcctattcagtagttccctactgaagacaggagtgctcagcctgccatggaagactggtctgcagctcccactgctcaggccactgaatgggtaggagcaaccactgactggtcttaagctgttcttgcataggctcttaagcaacacggaaaaatgattggcggaaaataaacatcagtttcttaaaaaaaaaaaaaaaagaaaagaaaagataacaatgtccttctttgcaaggcttctgtgaattcagtcctttctcccagtttcacaggcaaataaggacagggactcagttgaggtgactaatcctcggagccacagccccccaattccaggggcttggaaatgctgggatcacaattaaaggctttgaacttccaccagacaccaccaccagagctcactccatccgcaaatgctatgtacattcttggccacaaaaacacttccaggacaaaaaaatgtttcagagttcagaactattcaatcccacatttgttctctatgaacaaacgatgcaggaagaaatggaagaagctgaatctctctgagggcacactttattttgccctgatgagaacttagtagcacctaagtgcttcccaatctgacaaggccatgctacacactccaaggactattgctgaagttggctgttcacctgcaaaaatactcaagga

SEQ ID NO: 77725 - DNA, 1040 bp, Homo sapiens
gatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgtttt

SEQ ID NO: 77726 - DNA, 1474 bp, Homo sapiens
ggaggaaaaaatctttcaaatataatttccctatttccctacaacagcgatttctgctccccaaagcagcatacacccgtgccagcaccagaccaattagtactattgaatgcttgccaagcagctagggagtagaactgttttaaagtatagttctttgattacgagtgaatttgaatttttttcatacttttattgactatttctaattctttgttaaggttgtttaaagttagaagtaatcttttttctttgctgggtatatagaataataaatggggtggggatattttttctttttttcttgagaagtttgaaaaacttttttaaaaatataacatttgttttactattacaatatagtaggcataccataaatggtatttccccccttactaaagaagtaacaaaagtcatatatccaagaaaagaaactacatctgtggactgcctgtaaaagtggcctttttgcttacaagtcacttttccctctgtaatagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaataggtattgttggctccctttagaaagaaaaaaacccacaaaattaaaaacaacttcagagatattattcatattattctttcattttgattgcagaaaagttttctgcaaatgtaccccgttcccctgtgcgagaattgcttgaaatggaaccagaaactgccaaatttaggtaagcaaaaaatgtacatggaaaaaacattaacttaaaaacatcaaaggggaaaagttcacaaagatattgtaaactaatgattctgaaaaatatttacactgtggtgtgctgttgtcagatttctgtttgtaatctgattgacttctcttttttccttctgtttttatgaaataatgctgtaataaagactagacggcagccctgtctgtcgggggtatgcaattgcagtaagtcgtaacgcgtgtttcctttgtgtggtgtcagcttatacatgggactcctggcctgagagtgcacactaaatgctgattgacaatgataataaatacttctgacttctaattcaagctgtttggattttttacagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgttagtgagtggaatgaatt

SEQ ID NO: 77727 - DNA, 1028 bp, Homo sapiens
tccttcttaacaagcgttagtcttttgaccacttgaagattttatgaccccagtttatataagaaatgtacttaatttgtcattaaaatttagtttccagaggctttttagtatgatatgtcagatatcctttttgaagaatatatgtatgaaaatgattgtaaatacaaatcttcttcggatttggggatcagttgctatgtggggatagtgtaaatgcttctgcacaagcttacggttccacttcggatcccctcagattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgaggttagtgctgttcaaaacgatgttgaaaaaagtggtctaactaggagtctctgtagtttcagagttctgacggcatagtggtctaaagggacagcaggaggtcaggggtgtgggacccagtgtgctgtgttctgtgggagcacgagtgaactgcagtttgcaggtaggcctcttgaacttgtctgcccccactgtgggctgtgtggtcattcaggtgaagagaaggaaccaggcctttcagttaggtacccttcccacgccttcatgagggcttccagcattgaggcatgccaaagaagtggcctccactgccggaccccaaggcaggtttagctttagtaaaagcccagtgtagcttatccttccttttttaaatggatcagaaatatttgctaatatctcagggaagcatcataaatatacattctgcttctacttgaagtgggaaaatctaatttaaaaaacaaacttctaaatttttgaccattggaatttgggag

SEQ ID NO: 77728 - DNA, 1044 bp, Homo sapiens
ttatcctccgcaaatatctttctcttgcccattcagtgctgcttttggtttttgatttagttgtatattctggatgtatttccacagccttttattgttcttcctggacaaaaagacccctcctttagggtctttttaaagatggatagattaaaagattaaaagcaatgatttcacaagaaggttgcgtggcccttgctgtgactctgctgtcatcttctacttctcactgtgctctgtatttgcccctcttttaatagactgtcaacccattagattagaagggagaacaagcccctcacacccaaatcagcttcaggctgtgaaacacagctgaagtttacatttcaatttctgtatcagaaaaataagtgcctgaattcagaacaccaaagcaaagtataaagtttgtagtttatataataaaagcagcgtaggttaaggtgatcagcaaaatgtaaaaaccaaaaagtgaaaaactatctgactctggactggaaagactgatgaaactaaagcctaattttcgttatggaggaaaaatgatacgtggctttcgactacattctgctggaagttccgagacctgggttctcgcctagcagtccctgcttcttaattccttgcttattctgggacaagtcaccatcggtccctgcctcagtttcctcagctggatatattattttaatcactgtgagaaaatagaggtgttgatttaacattgatcattttcacattttgacaaccagtttacctgcctttgctccctttcacaactcttctttctcaatctcttggtttgtggtaaattcatttctataatagctcaagttaagaagagggtcttcttttcctgtcatcctgtgtaacaaaaatagcccaggaatagtgaggaatggtatcacttatgcacagattccagagtgtgaatgagactttagcgatggcagcacagtgtagccacatggagaggtgtgtgcggccctggtttcacttaagtgatgatgtgtgagggagactcgagaggaaggccccagcacc

SEQ ID NO: 77729 - DNA, 1206 bp, Homo sapiens
tatgattaaataacttattttatgttaattgaaaacaaatggccatgattttaaagttgccttttagtatttgtggttgtcatttgaaattatccataacccttgcttttattgagtttcaaacccttttaaaaacagcagctatgtttcccctccttccccattccccctcgtttcagacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactggtaaggagcccacgaccagacttcatttctgggaaaatgagactttgtgttgatctcatcgtgttggccttgtaaaagtgatctatgcatgtacagtgttcatgcttaatattcaagggatggggcggggaacaaaag

SEQ ID NO: 77730 - DNA, 1419 bp, Homo sapiens
gtgtttcttctcagtcattcataaggagtatgcatagttatatacattattttttctgctctgcatcttatattcagaaatatttacaccaaaaaagcatagaatatgtgggaatttaatattctttttataacatgaatgggtagaaaaactgtagagcccttataattaattgatgacatataattaattgattaattttaagaacatttaactgaggatatgttaatatgccttgaatgaattccagcagtgatcatttatggataagtatcctaatattttctgctaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatggtaagtttgtgtgtgtgtgtgtgtgtgtgtgtgtgtgtgtgtgtgtgtaactggagggatttacttttcggtgagccaaataatttgttttattaattttttgtttcattttcttggtatgtttataatagagtagatatttgatatatttaattaattcctttaattacactgtcttttcactgaattcagaaatagtattataattttgatggaggcaaatttctatttttattatttcttttccaaaggcataagagtatgtgatgttttgactttgagttttgctcttctttaaaaaaatttcactttgctgttattacaatttatcctagatccttagctctgttcagtgaaatgacttttcagtgacctgtgatctccagtctgtctgtgaaataattaatttcagtaaaatcttgcttttgtagctcagggttttcccagtcaggactcctgtgaacttaaaaaaaaaaaatcatccataaagattgttattttctggaaataatttaaatcttgccagtgacttaagaagactccaaatatcagcaacagccacttcattttgtcttgtcttgaaggccaccagagggcacttgggagggcctccaaactgcaggaaccagcgcagtggtggttgactgggagagttctagtgcctcttccgaagttaaaggcaatgcttcagacagtttcatttcttggagatttattttgcattaaaaataaattggctcattgttacttcatttttacctcaggccaacaatgataataccgtttttttctttcaaaggttatatttttaaatatccattttctccatgtcttctttgtgatgcatgtatcctatatatctgcctttaagtatttccaggtagcatgttcagtgacactatttggatttttacctatttattgaggatgtttttaactcatgtagtatttgtcttattacagaattag

SEQ ID NO: 77731 - DNA, 1264 bp, Homo sapiens
ctcatggaatatgaagtggaaatgttcagataattgaggctgtaggattcagatacggttttgtagagtagtcgccatacggaagctctgagaatggatgagatttccaagaggtggttgcaggaagaaagtatcagaggcttggacaagtgtggcataggcaataggataggatactctgttagacaagacagaggtgactttctattacaaaactcgtccatttgtctgctcagaaaccttctactccttatttctgcagaaagaatgatcactccctcagcctgctgttcaggccctttcagccctgatgcgttttggatcctaagcaggtggaagccccttgcagctcattggacagactccacgctcagacccccagccttggggcccttgctctgtccttccttctgcagagggcttgcctccatctctacctgtccagaattttgccccatatttgagaccttacgtagctctttcttcatcctgcccaccatttctgtcaacttggaatgtgatttccctcccatgagtccacgttgtactttatcctcttcttggcgcttgtgatgctttgttctcttagcttggaaagggaagctagcatttatttcagcctgctacgtttcaggcagagagggagagtacttttggctatagtggtcacacgtaccctccttttccctgctagcctgtgtgtcacgaggactgcccctctgtcctgctgccatcgttccctcagggttgcccaatcgagtgcctctcatatggggggtgtctattaaacaatagttgagttacatgggaagagggctaatgaagtacttaataataaggaaccgagctttatgaaaatgaaaatgggattgacaattctagaccctagtttccaagtactaacttgacagaaatgcaatgatgtgagaaattaagaaggagatagaggcattaggaaaaacagaccggagtagagggtaagatagtaaagctgttccattaatgtgaataaacagaaaccttttggttcattttttttaagttgaataaaagtgtcttgaaatggctgtaaaacaaaggaataatatttgagagagcattacagttgaaatcccgtttgtggcttcgattctaggaatataacattgtttcagttttgttcggtgccagttttcactttgcagctagagctgatggcatcctccccccatttcattgaaaatattgtgacatcttgactttttctatgggttcttttctactt

SEQ ID NO: 77732 - DNA, 1751 bp, Homo sapiens
gtaagttgcccagagttactcagcgggttaaccagagtgcctgggattccaacccgtgaagctaggccccaggtcctgcaggatgcctgcaagcttcgtgaccttcttaactaccacacctagagtctagggccagggattaaagcagtagataaaaccatgtcccactttataatttacactgtaaattaaaaatttggaaacttgcttctattctaaagtttaggagtacatttttgggatctttgtttttgtttttaaattcaaattgctgttgctctcagcctagctgttttgaagaatctgatgtaaagttataaaaatgtctttgcagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtaagagatgatttttttattttgagcagttaattattcagtgtgcctgaaagtggtttgcagtgttggataatctcagaggatgagaacgtatcatgctcagaaattgctacaccggccaagcacagctgctcccttgttctaccagggccagcgaaagcctgtggcagaactacctggcagttgatgagtattgctttacaccaatcccacactcaggttttggggcttagctgatctccacgtgccttactttttgattgaaagtcagttcaaaggaagctatgcaagtgtgtacaccccttgatcctgagggggatatgaagaaatgtgcattgtagtcagtcaaggagcttctgctttgttgagttaaacatttatttgagagggtacgtcttggcttacaaggcatacagacatgagtaagacacaagtcttgtggaggagctcatctccaaagttttggagagtggagcggagaagagtaacaagcttcacagagcttggctgctctccagtgtgaagagggtgacaccagagttctgagtaattaacgctcgatagctcagagaaagggcgggctcttaaactcagcatggactaagacttaagaaaaggaatgaaggtaagatattc

SEQ ID NO: 77733 - DNA, 1050 bp, Homo sapiens
gaggaaagccaaatgggaaagtctgcagaataaacaggtaatgagttaattgtactagcataacttagtatttgtttgagtattaaagattattaaagataagtttgaattttatcttaccaagttaaatgcatgattcgttaattttttagaagttacctaatcctcaaattttgttttgttttgttttaattagtattatgtgttgaatgttatttgaatgttctttttggtaagtattgagagttttgtttttatacttggcccattaatatatcacaaaatcattctcataaatcctttgataaatcccatttggccttagaggattatttttacaaatattttttaaaattaagttttactagcatttatgattttctttatccattagtgaaattggtctttttttttttcttttgtgtgtgcgctttgtatttatctgtccatttttccccttacttgaagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttaggtatgcctgtgcagtcagccagaaagaacacagatcatgagatcctgtttgcaaaagaacagaattaagttaaaattgtatataaaataattcttaaaagagtaaaaagaaaataatggatatcttatgtcttgtcaagtctcagagggagatgagaatctgaggtcagaaataaccattactgcttaagccataacagttggagtgagaatgaaattgttctttgttactgcatcagcattttcagtctgttttttcttttaaaaatccaaatatatgttaaaaagcaatagccttagcatgttctttgtcttcattattttcttcccattagtaaaatctctgcattctaaagaaactgttggcttaaacactcacattagttctggttatccaattggcaata

SEQ ID NO: 77734 - DNA, 1096 bp, Homo sapiens
tatgtttaatatttaaagatcgaggtgcctcttctatttctccactagaaagcatcatttctgttctgaagttaactgtaatggaataaaatacctgttaattttgaggggtgctttacatttccttttgctaagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttggtaagaaaaaaatctcttactttgataactctagacacatatacaaacatacagctttggtatgaaacttatctgtatcatgttttaacaagctaaagagtcgtttttctcttctaagttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaaggtaggtatttaaatggaaaggaaaatggtggtgatactttgttttaaaagatgcactaggtcgggcacggtggctcacgcctgcagtcccagcactttgggaggccaaggcgggcagatcatgaggtcaggagattgagaccatcctggccagcatggtgaaacctcgtctctactaaaaatacaaaaaattagccaggcgtggtggtgcacgcctgtagtcccagttactcgggaggctgaggcagggcaatcacttcaagctaggaggcggagattgcagtgagctgagatcgctccactgcactccagcctggagacacaccaagactctgtctcaaaaaaaaaaaaaaaattcacttattcacatgggaatataagtgggctgtgattttagcattgtaattactaataggaaatatattagtcagtcaggcatggtgatgcgtgctgtaatcacagctactcagggctga

SEQ ID NO: 77735 - DNA, 3091 bp, Homo sapiens
gcactgggctgtcccgccctctgctgatgccttccttatatgtgtgctggtagttggtgggaaatgtaagatgattaaggaaaaaacattggcagtatgttttcttactggattctgaacaatactttgtgctctattatggtaacactcgacacatgttactatttaaattcaaaattcaatttaaaataaaataaaaaatggagtttcgtagttgtacttctcacatttcaagtgctcaccagccactgccctgttgggcatcgaagatatagaacatctttgcagaagttctgttagacaacactattctgtcttattcgaagtttgaagcagtaaagtttaaatgccacatataaatacaaattcagtagaggggaagaggcacatgacaaatcaaactcgaggttataaatatcaatattttctcagttgtagattcagcctcagaatttctttttcttcacagatactgtgctagattaccaagtgatccgtttactcatctagctcctaaatgcagaacccgagagttgcctgatggtacattttattcaactctttatctgccaattaactcacctcttcgagcctccattgttgtaagtttagaagaagaaatgattgttatcttttaaaatgtgtcattagtggattttttcagcttttctaagacttgcaagttataggtaaatttgattttaaaatctactttcatgagcaggagccttgtgttgacagaccaaaaataaaaataaaaaccaaatttactttcaaaagtagatttatagattgcttttgtagtcatctacatgttcatatttgtaatagactgtctaatttacagatacttagaactggactaggtgatctctgaagtttcttctaaggtgttactaacatgcacatttttgacagaatcattcaactgtggcttagacacttagagtaatataaaacttattatagatcgttgcgttgtcctagttattttgttggtgactcaaaaatctgctttttgtaaatactgttcttggtctcagtactgatttccaagtgttccaaggtgactaatttctattgcacataaaaagctgctcaatactgttaatgttatagctatgttttgataaatctttctttttgttacatatttattgattagtaaaaataagatactttaaaatcttactgaaatttaaattcatcaaaattgtaaaatcttaattatgacttagtttttactaggcaggacttttaaagatgaatatttcaaatatggagattagaatttttaaaaacttgctggaatttttcaaaataaagaattttgttttggtaaattgaactttaaaaatgttggggcagtggtttcataggtgtttcatgtgctagaggtaatacagcgatgtgcatatataatggaaaggtttttgttattttcagggtccaccaatgagctgtgtacgattggctgaaagagttgtagctctcatttgctgtgagaaactgcacaaaattggtaaggatgtttgaaaagcatatacgaatgaaaataaattgcaaccattgtaaaaaaaaagcatatagaggactttatagatctgtaaggattttgtagagctattcacttgctgatcttaatgtgctttggtgaatataaacataagtgttagtaacttgaagatcctacattgttgtgggagctctttgttttccatagcttgactgcaaacaactgtcatttatttgctctctttaatgactccttttaagtacataaaggtcttttcgtaattgttgaatcatgcaccatgaacacttgtgttttaatatgtcagtctctcaaattagtctatactagtatagaaattaatccttttttaaaaaatgaactcagtttcttttttttttttttctcaatcctgctcctgtataagtggacccattttctatggccattttatttagcattgatatgtggtgatgtcatgtttagatgtttttgtttctgaaccttagaacagaatttgcagtccagctcatattggaatatatggatgccaaaatagactttgcctgaagtgtgaatctgattacttttaaattgtaaaaggcaaaggtgctttagtttccattacttttccaggtccttctaacatagttctgttctaaattctttactaattaatcaggcaaaatctggattgtgttaattctctctttaaatttgttaggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcagttagtattggttagaacagagtaaaaacctagcatttctgactttgttttccgctacatcaaatctcagttcctctgcttggctggcttcccacacccttacagtttggcccactctggatctcagctcctttctccgattcacagcttctctcagatcagcctctttccttcctaatgtagaatgtgtgctcttccacttcagaggttgcttttgtttttcttctcaaaaggattcttggacccatctgtcatattctatccagaatgagattatttcatttaaatagacattctttgtttcattcagtttagtggtgtgattcttgttttacttatgatttggggctaagacagaagaggatttgtgtgataaaataagcaagtgaaaagatgccctctcaagatgacaggtacactggaaggtagaagcacaaatatctgtcaggagttatgtcagattcccagtgtgggccattgggaatcgaaataagttatttccatggagtgtttccagctcaatctgtgggcatcctagcagagttcacacatgaaagcatctctaaatctaacttctagtaatagacaaacttggctgaagtatttatttttaaaatatttgttaatatttttacctcataagaaccccaagcaaaagcagaattttgctgtgtgtagtagtcccgcttacccttggagggtatgttccaagac

SEQ ID NO: 77736 - DNA, 1932 bp, Homo sapiens
gtgcatggtctagagaagggtgttgagttgagagatgagctagtagaactggtagagggatgagtcgagcttttttcattggacgtcctgtcccgaggccaagatctatgaggatccgtgtttctctctgactagctcagtctcatcctgggccacatttctattaaatcaccgtcgccaaatcagctgttggaggtaacgtgaccatttcatttgtcagtacaaaccaatcttgtatttggcgttataagtacttggtccacagatctatgtggtgaagagtgacagtgatttctgtttaagcaagttgggaaaaaaggaccaagaccgttttgttaggtatgtttgcaaaaaatgcatgtacttccattttaaaggaggctttaaaaacaaaagtttattttctttcagcaacgtttaacttccaaatgtgtataattttcttagattgataaaggaagctggcaaacaagatccagagctggcttatatcagtagcaatttcataactggacatggcattgggaagaatcagcctcgcaacaaacagatggaagcagaattcagaaaacaggaagaggtaacttaaatcaaaataagtgtacaataacagttttcgggacatatacagacaaagtgcccatagggtctcccttttttcatagtttcccagaattactattattttttgtattatagaatacttcttcatatattagaccagctgtccccatgaggtagctgtagagtgatttgtatgctcagaattagaatagctatctggcaaaccaattttgtgtcttaattgccatcaaccaacttattttctgtgattggattgatgttacacaactgcatttcatggaaagacaaagcatgtatgaccttaactcttgtacattccatatgactatgaattaacaaactgaaatcttttcctagaaagtgttttctttttttcatttaaaggcctattttgtttcaattcttaaaaaaaaaaacagcactatattttatagattttagcttaaatatttttgtgccttgtaaggtcttaatacaggaaacagcattgtaaagatgctaaaaactaataccatggtctggcttgtacacaaaaacctatttaaagtttattatttaacttaaaattagcagaataattcctgttgaaggccttttctacattgtagctttttgataatttccaaatttggagagtccaggagccagtctgatagatataactgtctgaacactagcttatgttaccatttaatttatcctgaattggagagtctcattaaatcagtttctttgtccatgtttccatgcatgctgagttttctgtgatactgtcatcttctttagcctggccttaaggatttagaatgcccaagagcatgtgtgtcagaaatgacagttgtcatttacttttactaattttttttgttcattttagaaattttcttagaagtgcttttcttggtggattttttttttcaggtacttaggaaatttcgagcacatgagaccaacctgcttattgcaacaagtattgtagaagagggtgttgatataccaaaatgcaacttggtggttcgttttgatttgcccacagaatatcgatcctatgttcaatctaaaggaagagcaagggcacccatctctaattatataatgttagcggatacagacaaaataaaaagttttgaagaagaccttaaaacctacaaagctattgaaaaggtaagatcaacatattaacatgtgccggcagattgggaaaaaaaattaatgtggcttctttgttattctttgtatccataggaacagataatgagttttatctacaggcaataatctcaaaagaggtgtactctgtgtacattgtaaggaagttgagaatgatcacaaagacccggcagtgtt

SEQ ID NO: 77737 - DNA, 1768 bp, Homo sapiens
catttgggtttttcttatgttcttggggttgtactggggtgatcggatatggaagaataccatggaggtgacctgctcttctagtcacattatatcagggggctctcatggtatcaaccacaaaacgtcactcgtcatgttcatcttcatcaatggattgtgatagtgtttgtctgctttctctactgtaaagttacactgtttcccttttcttactctatttggaaggaagtctccaagtctagcccaccctggtagggagggattaatctccacttgctggagagggatatatctatatgtatttggaattcttctgtaaggaaaacttgtctggtttatcctttttatgtaactgtctacttatatttattaattgaatcatgtatttcagttggtggtttcatgtttattttatactttgggccataatccaatactgtgttatttatttgttgctcaaattgttgcagcggtggccactgggagctcttcgagtttagcacccgtgtccctttgacataccctcatccttttgtttttgagcactttctttgtgataccacagggtgctctgggctcttgtatttctccctgcctggccctagaatcagccattttgccgaggagacttggtttcttttctgcccactttgtggatgtatattttgtgaaagttatttaacttttaaaagtttcagtatgttcattcgtaaaatggaaataatacctccctctcttactggcttgttggtaagagactttgtattaaaaatggcagttttatcaaccagcacacagtagatgctaattcttcagccgcttatgcacccatctagggagtgcaacatccgtatgctattatgtaactgtcagtgatctttttttagtgaaatcatagaggaattatatctggttttctccacattgacaagaaaatgtaaggagtaagggatactgttaaaggagttgttgataatgtatttcaataacctggcaggaatttcaaataatgtgtttatatctttgaatttcttttcctcttatggttgtctgcattagttagcatgtttattcagatcacaattttttgtaatacatctattagttttctgaacctaccatacatatttcctatttttggttatgttattttcattctaattggggagaattagatgtacatatacacacaaagtataggctatgaattggtgccagaatttacctatgtcatgagttaagtacaaagattgagaagaagcatttagaaactcttagagcagtttgacagtaattttatatctgctgaatacaataaaattgatgcttgaattttaatactttttaaatttcattttcttagtcattcacttttatgaaattctacaaaactgcctctgatggattggaaatttaaaaagaaaagctggttcttcactgcagatcgtttcagaaacactgtgcattagggaacagtatactttgctggtgaacagcttgctggtgaacagcttgtataaactgagtgtaaaaaccaaaagaaacaaataatacattgtcttattttttctgtggtgttacaaactctttaagcagtttgcactgtccattatcctctgggagttcacatgatgtgactgcctggctttgttttccctgaagcctgtagctttgtcctgggtactggttaggcatggccaagattcaccaagtagataaatacatttttctctctaagcattattagcataggtatatcccatgt

SEQ ID NO: 77738 - DNA, 1499 bp, Homo sapiens
gggttggttcatagactgcatattaaaattttgtgaatcagaagagaataagaatgttggggaaagttctaagactattagcaaaggtgatattgaatccaaattttaggccgtggattcctactctttctcccttcaatgaaagattttttttctaatttagaaccagccagggagctatacttcagatttctgtcagatggtcacttaatgtatggtccttttggtttgtagatagatactcttatttttttctgccaaaaaaggtccttattttgtacttaaatcaatttacttttctatgagatccattaattggccacagttgatccctaacttttctgcaagtagtgatctcttaggaaaaactaagctttgcttcctaaggtaatttgggatttttttttttctttttctttctttgtgtgtgtgtgcgcgcgcgcgcgcgtacacgcacgcgcacacgcgcttaactgcttctgaatgtttaggggttttaaaaacttttttgagtaacgagaaattggactcgagggtcatcatctggcagtttttagtctggtaattttcatagtcattgagcctgatccttctgatgaatacaaaggaaaataactttagggaccaaattacatttaaattagaagttgaagattggaaggggacctcactgactatctaatccaacccacttatttttgtaaaaatgagaaagagcctcaggagagagagtgatttgctgtaagttaaattgctagtcaatggcagagacaattctagaatcctaatatcctgactcctagtttccagttctttctatcatagtaatgcccctgggcatcacagaacactaaaaaccagtgctttacagcaggaagattgccaggagacggacctgggagagcgtgactaaggagggattatttcttagggcagggaaaaagcattttgggagtcaaaaaagtttaatgctggcgcagttgtaagcctagttatggacatactccccgtctccatttaggattatataaggattaaataaattttctggggcttggagagaagaaatgggggtgtattttccgccttcctcctgttttctgcatgtatttttaggtaaagatgtgccagtttttattgcaggaatattagcctgaaaaggtttatccagaatcagtcggttacttcctattgactttaaggatcagatgaattgtgatcaactttcataaaatgtgactggaatttagtgctgtatgatgaatcaagagtgctctgagggttgactttatgagcagctaattaaatatacaatagaggtcttgttccagtaagctttttaataagcttagaaaaacttcctgaaattcagattctttccttccatcagtttaatgggaggaaaaacccttctatagtgaatagtttcatgggcatataagctattgtaatatacatgcagttttctactctcctaattaaaaaaaataaatcacagc

SEQ ID NO: 77739 - DNA, 1104 bp, Homo sapiens
tttaatttctgtttgattattttattgaaaaaaggagatggttctaggcatatacatacgaaatgagcttgaaaaggctaatggcctctccccccaccttcagggacttaacctaaggctgggttacatttaaggagccatttgagaacaactgaaatcccagttaaaccccacatgaaaatgctacattattattatttggcattaggttttttcttttcttttttttgtagatactatcagactgtcgtgccgtattggtagttctgggaccctggtgtgcagataaagtagctggaatgatggtaagagaactacagaaatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacagcagtttgaaagcgttgagtggtataataatagaaatcaggataattatgtgtcatggagtgattctgaggatgatgatgaggatgaagaaattgaagaaaaagagaagccagagacaaattttccttctccttttaccaacattttgtgcggaattatttttgtggaaagaagatacacagcagttgtcttaaacaggtaaatctgtaagttgactcctttcacatgagaacagggaggcgtcctgtgttgtgatgtgatgcgctgcagcagctgtaagagctagcatgagggttatgtaagtgtccttgacttggcgccatcattgctgatacgtcatgctgtcctgggattgacagagaggatgttttccagaaggctgcttttcatatggctgatatttttttcttaaaggatgctaatctattctaatctacctaaaatggaggacaagtatggtttttaaaaaaatcagtatacatttaagtaaagcattgttttatattcaattttagattcaattcagatatttattaatccttaactatgtgttagacattgtgttaagcatttcacaccaagtgttcccctcaggt

SEQ ID NO: 77740 - DNA, 1007 bp, Homo sapiens
cattatttaaaaatattgtgtaaaattaccttcaagctgtaaggtgtatatgaaacataaatgaatttcatgtttagacttgggtcccatcctcaagatacttcattttttatatgcaaatattccaaaatctgaaaaatattggaaatccaaaacagttcaggtcccaagcctttcagataagggcactcaacctgtgcagataaacatgagtaccactttaggaaggcatgttgtaagcctgccttttatattgattagatatacaaactgaaactaggaagcttctttttggagttagacctataaatggatcataatgctgtagtgagttttttagaaatgaaacaaaaggtgttcagggaggcagtagggtttggctgaaagagccctcagaggaaggcagtcctgagttttgtttagacagagtcatgtaatgtctttgaaccttcatttccttcgtcatcctccctgtgtgtggattcagttagaaggtatgtaaattcccagcatcatgcttggggatgcagtggatgctcatttgtattcttttctttcccctcttctccccttgccttttgaaaacatcttttaaacaacactttactggtttataaaatacattatttactgttgagaaatatggtaatatagaaaaataataattaaacacctaaaatctcaccccactgctaacattctggcatttttttttttttttagtatctattcccttttttttttttttgctttttgaaaaactttttttaaattgcattctcactactgcagtattgataccttttgtttcttatgttaaaggtatacttctcagccatgtgagattgtggtggattgtggaccatttactgacagaagtgggctttatgaaagactgctgatggaattagaagaagcacttaattttatcaatgattgtaatatatctgtacattcaaaagaaagagattctactttaatttcgaaacaggtaagcatataccaag

SEQ ID NO: 77741 - DNA, 2446 bp, Homo sapiens
tcatcttgcaatcctagaccacccctatcgagaaattatgaaggtaagttttagacctaagtcttagtaattcttggtaaactattgagtaaatgcagatttttgtttttagatttcaaaagcaataatattagttatcaatattgggagtttggctgcagtgtatgaatgaatgaatattaaattaatgttcatttaaatctataataaacttttaaacatcataataaattctatataattttcatagtgtatctaattgagcctttttgaaaaacagatcttttaaacaaactacagtaattctatgagtaattttatgttgtccttggtatagtggcatttccaccaaacaaattcttttttactatttgttagtgattttgatatgttttaatatggcgatgtctctcttgttatagccttgcaaaatgaagtctttactgtcagtatcttttattatgttagctctgtgaaaattgtccatcatgtcctcgcattttgggactaactgcttccattttaaatgggaaatgtgatccagaggaattggaagaaaagattcagaaactagagaaaattcttaagagtaatgctgaaactgcaactgacctggtggtcttagacaggtatgcacttctgattgactcagctttaatgagattagttgaaaacaatattaagtctttggtgtttttgtagtaccttgcagagagtacctatttaagtgaacaaatggcagtaaaaaggaatgggcaagagtaagaattctctataagtaccattacctgtgagttcaagaatctaacgttgtttccacagagagtagcagacaggcatttctgccttaagagattatgtgtcagctcttcctatttgctgttgttgccaaggactgggaactttgacagtaaatttgtattttttttctgtcaatatgtgtgctttgttgttctgacctgaatgtcttacatgatgctttcaaagaacattaagttatttagagaattcagcagtatactttaaaatgtttggaaatacccctttgttttgaaaatgggttgtggatttcagagaaagttgctgtttgtgatttctaggtttgactctttttgagagggttactattttgagtttcattgaaaagcgcacacacacacaaaaccttcataacttaggttggtggaagggagcctttacaaattaggaaaatggcttttcaaatgcaatgaattcgatttatgtcaaaatagccttccattcttactagatgtagtcttaaataaggctaaagattacctagtggtggttcttaggacagttacaataagtagcggagactgatttctcaagttgtggagttaagtcagacatgggtttgaatactagctccactaattgtaagctgtgtgaccttgagtgagtcacttatttccttgaacttgtaaaatggcattgacagtggtttcatgggattctttgatgatcaattacattgacacatagaaaaatctgcagtgtgcctggcatttagtaagaatttgaggaaaattttctttggagagtgagaaggaaaggtaatatttgggatctatcaaacttaggtatccaaatgccatgtgaaatataaatcttacgacctctagaacgtgctgtgtctgacttcttgagccaacactgtggtggtgaagtagaaggccgtgcttgtgcttttgtctgacctgagttagagtgcttcacttgtattgcccaaaggttttctgagaagtagaagtagtagagcgtttaagtaaaactgataagcaatctgttgaataagcattacctaattctgcaaataaggactctttggttgagtataaattctgttttgggttaagaaaaaaagaactatagtatatatgtttttgctagatttcttttattaaaattatcatatgtacttttaggatattatgtgccattctggtggtcattttttatgaaaggcataaaagacccaaggaatgatattagaaatgaatgaaagttgggggagttttccttatgaggatttaaaaatacattaaaaataaaagtgatatttgcaaatattaaaaattcacacagatatggaaatggataaattgaatgataaaactcccagtgatcagtcttcccattcttctttccgcttctgcgaagtgattgagtttcatgagtattttgaacacccttgttcctcattctgacaaatgcctaagggggcaaaagatggaagtctaaacctaaaaaacaaaagaaaacaaactaataataatgaaatctattggcaaaattatttgaatatcagcccctgtggtcatttcttgagacctaacaggcaagcgtagtacagattgagcaaccctaatctgaaaacgcgaaattcaaaatgctccaaaatctgaaaccttttgagtgctgg

SEQ ID NO: 77742 - DNA, 2771 bp, Homo sapiens
gctgggtaattggatttgatagttgtatttgtgaagtttcttttttccccctctgaaaacctcactgttccttaatattcacttggatgtgtctgtcctagtgagctgggtaggaacctagattagtttgaaaatgttcagccatgaactggcagaaccacgattactctaagtttagtcattcatgttattctaaagaagtattctgtgtatacaaaaataatgcttaaagaaagggtaaatgccatttcaacacgtatttacacaatacagctgtatatagcaggcattttattcctctgagttattctcgtataaagacgtagactgtggggttttttttgtaaatttattggaggacgattttagagaatagtgaaatttcctgatttaaaataaaatccaattttataaattttgtacttaggtaagaagtgcataacttttttttcaccatgtttctaggttgaactgcttgaagcagctctggatcataataccatcgtctgtttaaacactggctcagggaagacatttattgcagtactactcactaaagagctgtcctatcagatcaggggagacttcagcagaaatggaaaaaggacggtgttcttggtcaactctggtaataaaaaattattttatcaagttgtgcaggggaaattggatgggattttatgtttaaacagattttctgtgtttcttaagttaaattattgaagaaagtttgacagataatgtactcatttaatctcttctggcagaaattgttttgtcctatttctttttgctgtttctcttaaatgttctgcttctgtatttcttttgaatggattgcttttggaacataagtattggaacatatgtacattagaacataatctaagttgttacatttatttttttcttgatgttttagcttcaccaagtatgtcaaaaggtgcttaattatggataattaacgtttgtacttatgattttgctaatcagttgtattaataaagttacatgctgcttagaaattagatattcagttaagagtttaaaatactgatttttatatgcttggattatatataaaaataaaaaatataaaatgtgaacctaagctggtagggcactaatatattcatgtcactgctctttttttaggttgtctcagtataactatctgctttaaatacatgttagactgtcttgtttccatctgattttattgaagaaaacaggagggtggcttagaggaaatcagctatgaagaagaaaggtggtgtagggttctctgaagcgagtgacaaaaagtgaggtggcaagtctagtaggtgccatttttttggaggataaccttggaactgtggttttaaagaggctatcaaaaacattgttggttaggtctaatataataataaggatttctgtagactgttaatcattagtagtccagagagccaactaggcaagatttctcatatttacatggagtattatatttgtaattagcaaaccaggttgctcaacaagtgtcagctgtcagaactcattcagatctcaaggttggggaatactcaaacctagaagtaaatgcatcttggacaaaagagagatggaaccaagagtttactaagcaccaggtaagacttgtagagaaatttcactttataaatccctacaagttcttgacttggtttgtaagatgatctgtagccttggttgtctgatttaggtttgaaaactaatttcctatacttaatcagcctagaagctagtcctgatgtactatatcttactgtaagtcttaccttaaaaccaaataaaggccggatgcagtggctgacgtctgtaatcccagcactttgggaggctgaggtgggtggatcacctgaggtcaggagttcaagaccagcctgaccaatatggtgaaaccctgtctctactaacaataaaaaaattagccgggcgtggtggcgtagtagtcctaggtactcgggaggctgagacaggagaattgcttgaatccagaaggtggagtttgcagtgagctgagatcgcgccactgcactccagcccgggtgacagcgagactccatctcagaaaaaaacccaaaaaacaaataaattactaatttttattgctcttaactttgtagaaaagaaataggtttcagtatgatctgcttgcttgaaaaacacaaattcctatgacctatttccaacttgctgataatgcgctttcaaaaaatttagtcttgagttaaatgtcttgaaactggaaaaatttcttgcttgagctgtttaggtctttgacggagacttcctctaactgaatgtttccatgcagccagcatgtgctggaggctcctctaacttacatgtttccatgtagccagcatgtactggggcttttggtgtgttggtcattgggggatacacagtgattaagaggcgcttcctcactgaactgaaacagcccagcctactagtgtgcttcacatactgggataagtcctcattaataaagcacttaaatatccacataatgataggctacaaaaataacatttagtctgagttttcttccagaaaaccatgtcagttcaacagaaaaaaataaaaagtgtgaattgttttgtgatttgcctaaattgacagatctcatcagtcataatatggctgtggggatctaagaacctgaagtaaatttagatttgtcgtcaagacatgctttccattatcaagatattttttctctactcttttcccatgctttc

SEQ ID NO: 77743 - DNA, 1734 bp, Homo sapiens
cattgacatttttgaagaataccctccccagctttaaaaaataaaacattcctaatttatttttagactatttttctaaagttatttattgttattactaatgttatctatatgagaagaaatggtgacagttgtagggaggagggggtgctgctggttcctggacatacctggtttctggaagtaggagaagatgtgttgggtatttacatcacggccctcttttctcctttgttttatattttcatccatcatcagaacttagacttgtttcttggtaccttctaccatgtcttcaataagtctaggattagcatttgggttgggtgaaagtgaagggtcaggcttaagggtgaatagtgctagacagtatgcagtctgtagtcatgaaggagaattgtggaggtatcacgagagtggattccaggtgagaaggtcagtgatgggacccgcagatcttagccttgggccttcagagtggcctcctgatctcagacattttggtaaaatagacttccacatagggttcttggcagttgtattaagaaaaaagtttaactgatgagcctgcaagtcctgagggcttgctgaatttgggaaagtgggtactaggcttgggtactagggtaaaaggaatggctgttggggctttgattcagagagaattagcacattatttttcgtgaagaacatagttctctttgatccagggaaattatgggttaatattatctcataaagtactctgtggtacttcgcttgttcccttctggaaagatgatgagcgtgattgtgctgtcaggcccgcagacgtgctgtcttaccgggctctcagctccggcagtggggtgcccctgcactgcttacttgagatagtactttatggtagctgaatgttgaattcttgtcaacagaattaatttctcaaatcagaattcagtattgtgttgtataagagaccctacacttgagacttcttgttgaaatagttgcaacaacttaagtcatgtgttgtacttaacatgtcaggagattcaaaagttttggttgttaagtaacagagttgaattatctcttccagtttcatagagtaatagcaatgaacactccaaagcagtgcaagagaggaaattcccttctgtggggcgaggaaatcctgctgacagtaaagccagtggtaggctttcacacagatatttgaatccctgaccctctgtttgaagggtaggaattttaaagtttcagtttttatcattttacataatcaaatttatctgtgggaaaaactatatgaaatatagaaagtgcttagataccatgaaaaaatttttatttcacagagtggtgtcatttgttttaatttatctaggatatgtataattttaaagatacatatttaaatagttgtgcatttataataggttgtcaattgagaaaaaggcctgtgttcgtgagctgttgataaagtgacaattttagcaggtgtctaaatctttcgtggtgcaggcacagtgctaagtgccttccatacattatcattttatcagtaacgtcatagaatatacaaagaatgttcaaaatttatttatgtgtatatttacatattttatatatgtacatatatttaacaaggcatcatgctgtacatattttcttttaaaggtttattatggacattgttctgtgtcaggaactacagatatgtgctataatcttaatggattcaaagtattc

SEQ ID NO: 77744 - DNA, 1034 bp, Homo sapiens
tggatttgttttccctaaatagaaagtgcattactggggccagttattgtccactaaatgaatgaaaattaatttaaacattgtaaccttatggaaaatataattggaagggttaaattgttgttctttatgtccttgtacatcctctctcctgcactcatctctcagggctggtaggagtgggatagatgtgtgtttccaaaccgaatagaaatatatcttgatccatccatgattctgttctgtatattattgtgtggacattcatgagtctctaattcagtttgtcaaatatttacttaaatgtatatacagaacattgtagcaggaaatttaagaggtgcaaagaatgagactcatgtcttgttcttatggagctgtgctccagtaaaagaataacatgtatgttgtgtatgtgtgtctatgaatagctctaaaaatctgtgatagaaattatgaaaggcaaatagaagctgtttgaggttttaatgtcactcaggtggacattgttttcattctaacaacctgcagtttttgtttaccatgtcctggatgtggttctgtacagtgggtaatacaggtaagggtaagatatgcagctcctatatccaaggaaattctagtctaattggtcatattttagtgagaacagagttttaagagaaattttctaaataagaattcatataaaattacagaagtacattttatggattaagactataccccaagcctctgtagtataactgctaggatcacttggattgagcacataggattgaaatacaggattaaacactttcagttggtcagtcagggaggatgcataatatgctataggctttcagccaacagggattactcttctgttgtggaaattgctggtgaatggtgatgaggcagcaataggatagcattcttttttttttttttttatttttttatttatttttattttttttattatactctaagttttagggtacatgtgcacattgtgcaggttagttacatatgtatacatgtgccatgct

SEQ ID NO: 77745 - DNA, 1181 bp, Homo sapiens
ttaacctccatgagaatgtcttttaaaggactggaagtagtaaaaagaggccactgccaatttgtttttcctgagcttatggtagtggaggcattgcagaaggctcagacctgagcgcaaaccaagtctgatgtcagatctaacaaaatcagtatttgttgatcaaattaaactttttatatctacattttatgctttcttagtttttgatttataatctcttttagagagccaccccaaatttaaatttatgcccgacattaacattaacagtgttcttgaattattttatttataaactaattctataaaaatgtatagtgtagatgtaactgtccttttgtgtttttaatttcattttgggaaattggaattgctgatggatttcatacctgtgttaaagagttactactgggttatttggatttctcagccaagtacgtcttctggtgaccttctttatttctttcgtttatgtgaatttaggaaataatagctatttttttcatttttctataaaataccatctttagactttatttactttgatttccttatattagctttgaaatctttttttgaactttgctctagctctttatttctcccagatctctgggaattaggcatgctattgtagcttattctcttgttctttgttttagggtaagccttggtatcctaaaataatctaaatgccttttgtttaaaatttaattcaaaataatggccttttattcaactcttcatatcagtagggctctcttgtagatgtgtttctgttcagtttacaggaatcttaaacttggctatttttgcatttatttttagagcagaagcttgggcatgctgtgattttccaataaactgctatcacaatgtcaaaatgcagttcagacaagagcaacacagagatctcaaacattaaaacggtaaatctgtgattcatcatgtggaaagaggaagagagtttattcttgtctttcttgtcttttgctaaattacagtcatgcattgcttaatgactggatatcttctgagaaatgcattgttaggcgattttgtcattgtgtgaacatcatagagtgtacttaattaacataaacctacatggtatagcctattatacacctaggctatatggtatgaccttttgttcctaggctactaacctgtacacc

SEQ ID NO: 77746 - DNA, 1016 bp, Homo sapiens
tgtagctggtgaaattgacattttcagttatgtaataaagcctttgttaaaataattctgagtgcaaaatggcttcctcatctaaaattgtcaatgaattgttggtactcctttaacatgcagttacctcaatatgcattttaaataagtgactaagaagatgctacaaaacattctctgaggatgtcagtaagactgttactagaagtaagacatgacaggcttaagtttggccttagagttttttctttttgttttttaggcttataacagcattacatgttcttggttgtgttaaggtttatggaatagtaaggattagattcttcatgcatgttcattaccagacatggtgcttgacatataggagacactccgatttgttgagtgagtaagttaatttataatactttttgaagtatttagaagctaacacagttttgtggggaagaatattgcttgcatattaaggcttttaaaaagattattactattctgcttttggacaaatcatgctacttggtcctttttgctttgtgaggtacgtatgattatgtgcacagaaacattgcagactgagggaagtgttaagaatcgtgggagaaaatcgccgtcaaaattggagtttaactgtattgcagactttctccttgttggcacagactaactctgttgtgcttgttcgttctttgacagctcaatgtatgccataaagcaggggttttaacaacacatttgaacaattcttgaggattagaaaatgaggtctgttaaccagttcagaattttaagaaaacaaaccggttgtacttagagaacttgaataatgagagaagactcttagtttaaaaactgatctttgacatgatgtaggaaggttctttgattaagaagttaaatgaccctgtttgaagggaaaaagaaaggtagtagtcgtatttagtcgtatttagtcctctgagatgtttcgagattgcaggatttctgtctttcctcttttggtaacatcctgggag

SEQ ID NO: 77747 - DNA, 1505 bp, Homo sapiens
gcgcctgtccactccccggcctggcgaggcctggggctcttgacaggtcccgtcacgcgcgctaaggtggcgcgggagcagcggaggtggagacgcgcgcctgacctgccggagcaccctggggccctcctctgatggggccgctgtgccgcgcccggaggggacgaagctgggctctcggtccctcccgggagggtcctgtgtgattactgtcaggggaccagattggggccctggggggcgggcaggggccgaggccattcttttgcctctcccctcagatgtttttgtgccaaaatgcctagaccctgcggaggaccctttcttcagggtttttgattttggggaaatcagtgtatgttttaagttagcacatcagatttctgtagattgtccagaaaagctgagttgccctgatggctctgcctggaggtcagagccagcaaaccactgagtgtgtccttaggaacctgaagatccgcggaaacgtggagatgagttggagggtcctatttgtgtagtgttaactccgtgcttttgtggagagagttgtggttaaagggacacgttactggtctacacgataagtaagtgttcttaggactttcaggttttaaaaacattcatctgatgaaagaggatcacttggacgcctatgcttctgtcttcgaatattctgaatctttacaatcctgattgtcaggtgtcttcgtggtgcttgttttcaaacagtggaaaaggactcaggttaggatttaagcaactcggaaaatattgttaaaaatgtgctgttaaaacaggttagctatattgaatatgtattggtgtaaacgttaagttttctaaataaaaatatacatcctcaccaaaaaactcagtttattaaaagatgggttcgggataagccaggtcctagagaatagtaattttcaatattattgatatctttggaaattaggttctggaatagccagtttattttgcaaagtctactttaaagctacctgtggcacgtgtgtattatatgtaatatgtgctgtgtacatgcacatacatacacaattatttcaaaacttcattttagggcatattccataaaactcaatagataaaaaaacaaaaaactaaagattgcttttaacatggtcactataaacattgatcatggtaacataggtttatagatttactcacggcaccaaaatgctgttttaagaagagaacagttagtccattttaatttggggagaaaagacattttcctacaatcctttttagtaagggcctgctttactttttatgcttccatctcatgtttgaagggtaagccctgactgctctgctgtattttgcccgtggctcaatgtgtgagttgggtagctaggttgttttgctattattgagctttattgtcttggttttagaagacattgtcttttgatgtggctcatgattcttatttgacagtgattttgtcatatagtgggttgtacagtacttgtagt

SEQ ID NO: 77748 - DNA, 1762 bp, Homo sapiens
aagcctctcctggaggccacagggcatctctgctgaccactctgtggcctcccctctgcaggcatgtggttttaggatccccctccctgctcacttttccatcagttccattcctgcataaataggttgctagctcttgcttactgttctcttctgtattctgtgttcatggttgtattaatataactttcattcctctgctcctattttcatggggtttcatgagggaagaaacaggctcatgtgttcagtataccatcttgatccataaaccccatttgagttatctcacaggttgcttagggggcttgctgctctgactggtttgtgaacgtgccctgagtccagctgggactgcagcaacatccatcctgttgagctgtggtctgctaagtgattttgtgtaatgctgtgccaagtgcaggagagggatacatagcatggctaagctctgcttgaatgccatgattagttattaccttccttccttccccctggttttgctgcctattgtcagtaaatgatcttagatctcctgcctccccaaagatatagtctatgtggtggtctgggttctaggttttctttaccacccttgcttcacttaagaaacagaaaactggctaggcacagtagtggctcacacctataatcccagccctttgggaggccaaggcaggaggatcgcttgaggccaggaattcaagaccagcctgcacaacatagcaagactccatctctacaaaaagttaaatttaaattagtggtggcatacacttatagtcccagctactcaggaggatgaggcaggagaattgtttgagcccatgactttgaggttactgtgagctatgatcctgctattttactccacctgagtgacagagcgagacgctgtctcaaaaataaagaaacaagtagtccacacaggtgtttgccagcaaacaaacagcgcggattctctgttgaacgtggccaacattgcctcgtcgaagtttgtatcttgccatagttgatgatcaggtggtcggggcttcctggtcagacctgacctttgtggggagatgttctcccaccaaggctcagaagcaggacactcttgctgcccctcgggcagccacccagaacatgggcgtctccatttctgaggttcagcatagttccccccaccctcttcccatgcagtgcatgcctgctctttatcaggatggaacagagggaaggcagaggcactgggggcagcctgtgttgttgatctctgtaagtcacagactgttcgaaaacctcaggaattatgtaagcgttcagtgcctcatttaagagatgaaaaactgaagattagaaagaggaaacgactagtcgccctgctagttgatgacctccagatagccatcttcattcccagttaagtttactacaaaaccacagcctcagctgctgaagctaacctccctacccaccatcgctagggactcagaacaccatggagctcatctctccaacaaaagtcagaattagcaagtacagatgtgtcttacgaaaatgtcagaatccatcatggctgctttggtgaggagctgttctccttccgtggtcatgccattggaaggcagttgtatgacaagaatgctttcacatgagctccgattttcttaactctccagaaggacttcagaagcctctggagttttgagacacggcctctctctcccttctgcttggagacaccttcctgggggtctccactgcattccccgccggt

SEQ ID NO: 77749 - DNA, 1053 bp, Homo sapiens
agatagttctgggacaagtggttttagcctctcgtaatctccattacaccgcacgaaaccaccctaagaggcttacactgcaggcttctctacatgcagctccaagcagaggccccagccccaggcaaaaccttctgggcttccctatgatccgccaggcaaaactgaaatgacattttaacactaccacctataaaataaaagcaggaaggtaaatctgactgaaatcaaatctagtaattattttaaaggtaatattccaaagccaaaacaaaactgtggggaatgggagaggtctttgtttctttctgatagatgatttaaaatgatctgctattagggacacttcatcccttagatgacctatggggtcccctgcgttactaacaaacagcagcaagcgatcagtatctaactccgtgtcactctctgagagcactgtggcatcaagaaaggtgtcccaggagacctggcctaggcgccctctctgtcgccaagttaattgcatggccttgggcaagtcactccaccccgaaagcctcagtgtgtccatctgcagaatggggctgccacctcctctcacctgatgttatggagatgaacggagtacgtgcaaaagctcgaggggctgcctggatggcccgacgcactgccttgggccagtacacacagtgtggggcctacctggacatggtgctggggagccttcgggtcttcaggcggggagtgggggccggggagagacgggtagcactgggtggggtccactttcctgggaacctgcttggtaactgcgtttcctctgtgtttcttctgtaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctgaccaggggcggggttacttcattttattt

SEQ ID NO: 77750 - DNA, 1061 bp, Homo sapiens
agcatgagcacaaacaaggtctggagacaatagttcctgttctgagtgaaccatgaacttaaaaaaaaaaaaatactgtctctctcagagcctcagtttccatgtctgtgaaatgggagcagtggtcataataggtggtgagcatcaaaagaagccatgtgggctgggcacagtggctcacgcatataatcccagaactttgggaggccatggcggcagggtcgcttgagcccaggagttccaacatcagccctggaaacagagcaagaccccatctctacaaaaaacaaacaaaattagccaggcatggtggtgtgtgcctgtaatcccagcaacttggaaggctgagtttggaggattacttgaacctgagagttcaaggctatagtgagacatgatcatgccactgcactccagcctgggcaacagaatgagatcctgtctcaaaaaaaaaaaaaaaaaaaaaaagcagcagcagccaccatgtgttatacatatgcttcaattactgctacctgttattaaacttcctcagagattctggaaacatcccgaagatgtggtaaaagtcaagaccttaaatccaccaccgtagggcttcatttatttatttaacaaatgtctattgagtttctccaagatgccaggtgctgaaagtaaaaggccctgccctcatgaccctttaggatcacagacaagtcaatcctatatggtagaaggtgatgcaagagctccaagcaggggcagctagctcagatgggggagtgcagtaaggaaaacttcctggaagaagtgacaccagagctgggttttgaaggatgagtaggagtgcgctagacctcctactcatctttcaaactaagttagacgtaacctactgtgtgtgtgaattgcctgagggtggtattgaaacagattctgattccagtagctctggggtagagcctagggttctgcatatcttacagaagtcctcatgagaggagttcactgatggagggaagggacatcgaggcagcaagggcaggatgagcagaagcaatggggcttgaaagagctca

SEQ ID NO: 77751 - DNA, 2202 bp, Homo sapiens
gtaagatgagatttgaatgtggggacatggggagagacttgaccagcactagatcaaggaccaggtggtgctagagaggacaattgacttacttggaacccagaaagaaaactggatcccagctaaaggatgttgggcaagatgtcagccagctttgctgctgagccttatcacagtctgttcagtggcccagctggttctgtttagagtcatttacacaccaggttttccttgaactaacaaagtaaaggctgacttcttgactgaagatttctgcctggtgattccccggggtggatctcaaaagagtggggatctgaagaaattgaggagatgaaattctcataaccttgaatgatggcagaagtgagcagaggcagccatgggaaccaccctcttgtccctgtgttgtgttatggtgatggcagatgataaagcggagccatccccattatgtcatttaaggctgacgtaaacctctggggcccctacttcacagatgcagactccgaggtcagaggggctccgtggctttgccctgttctcagcgagtgagcagcagatgtgaggtttcacagcacactgtgatatctccaggaatttgctgcagccccctagactcaccaggcctttctggaggccggtctacaaaggctgcttcctcttctttcatgtacacaagcgtggagctctctcttggagagctggctctctccaagagagagctggcctggcctgtgagtttaactctgatctaaaacaaaccaaacgtgttacctcccgattcaaagccaagggccttgggtgccgaaagcaggaggttgccccgggcaatggcctgtattgagttcccaggagtaccttgggcaagggccatgaagtggcacgtgattgctgacccgtaggggacagagacatcgcaatgccatgaggtcagtgagggattgtggagtgggtgaggaaaggaagaggaacagcaggaatcagataagtgctgcagtcctaggttgaggctgtgtagggtaggcactgctacacttggatttgttgttaatgatggcttgtttactgtgggtttgcccaggtagaccagaagtcctactgggtcaggtgctggagtctgccctggccacccctgtgacccaggcttagagagtgctcagtttatattgttgaatgcatgaatgtggaatcaaagggagagtgtggatgctgggtttggcagagttggatttgagcctgtttttagtattgactggctgtgggtagctgtgagcccgaccatgtctttttggtggaaagggatgataaccccaacttctcctggttgctagaacattcagtgaggtcatatgtcttcatcaatgcctgtttccccattcccttgccttttctttaaggtttgtatggaaaacagtgagaccccagcccctttccctggaggatatggcttgcattgttttttaagctgatgattttagtattttcttccatgtctctaaataacatgcatgtattgtttcatcttgattttttggttctaagctctggtttcttactgtagaaggtgaggatgtaggacccctctttacctcctttaacctcaaatctgcctcctctcaacttccccatatgttttcatcataattttgataagatccgtaactggggtttacagtgtcactagtaggtcagtgctcttcagagcttagctgtgtagtaaatgatggtcacttttccttacctgatctgctttttgttttctttggaattaaatatcgtctgctgttgctgttggtcgtggggtatgcgcttattaattcatctgaaactctcttactattctagatacctccttaagttgtttgggtgcatcaggtaaagtgtctctcttatctcttcttttttttttgtttgagatggagtctagctctgtcacccaggtgtggtcactgtctctgtgcagtggtatgatctcggctcactgcaacctctgccttttgggttcaagcaattctcctgcctcagccgccgcttcccgagtagctgggattacagacgtgcaccaccatgcccagctaatttttttgtgttttcagagagatggggtttcaccgtgtaggccaggctggtctcgaactcctgactttaagtaatctgcccacctcagcttcccaaagtgctgagattacaggcatgagc

SEQ ID NO: 77752 - DNA, 1047 bp, Homo sapiens
aagcttcatgacaatgccagaagactctggggactggtatttccaaagtaattagtcacatctaacataggagagacttaggatcaagcaccaaagatctgccacctattttgggcatgtgagtagcccaaggaatgttctagaaggaatacctggtgagagaaatcatgtttcccaaagatggccacaacagtagctcccatcccacatgctgtacctgtagtaggactgtctcattctctcattaggatgtggggtctaatttgcctcccctggaatctgggctggccttacagacttgcttgacaaatataaagtggtcattagtggtattctgggacttctagggctaggtcataagaagccttgcagtgtccactggggtctctggggttgatcttggagcactctgtgttgtaaaattctttacacagagaggccatatatggatgttcccagggacagccttagccatgctcccagttgacgaccagcaggtcatcatgctgtgtgagccatcttggacgtcctgcaacgtcaagccctcagataattccaaccccagctgaatccaactacaaacagcataagagaacctacgcaagaactggctgagtccagtcaaatcccagaaccacaggagacaataatgcatccatattttaagccatacagctgtggatggtatattataaagcaatgaataactggaatacctggagtggtttacagggctcttcatttaaagagaaactgaggctaagaaattaatcaaggcccttcctctgggctctcagaacgctcagtgtaattgctataagggtatctgagcccaaatcattggtttacttgtctgtcctacgagactgtgagctcttgggggatagagaatatattagggctctggagttgctagtaacggaaataaaactggcttacttaagcaaagcaaaattgattgggaggatttgggagagctcaaagaattagaataaaaaccagactgggttcagagaacagcagtgatccagggcaggggcacatgga

SEQ ID NO: 77753 - DNA, 1057 bp, Homo sapiens
tttcaaaaagcctgtgctatggagtcatgatcagaaaccagagtgtggagagggtcagcagcctgcctcagagcagccagctaggcggggagtggtaaatttgggacttgtacccaggcatgactggctccgagcccagtgctccactctatggaatgttccctgggcctcagttgctttcctttcctttgcaggccgcgggctgctgccactctggcagctggtgagttagctggagggcaacattccaaagcaggggcagcatgctgctttcctcctgtgcccactcctgcggggaagtccgttgactcccaccgctgaagggagctggcaacaccaggatgaggtcccaggggacgggagcaggtacccactgtctgtctaccttcccactggaaaagcacggacaggccagcccttgcgggggcaggcagaggacagagttggctttgcgcggtctctgcctgctgagcagttccaattcctctcatgggagaaacaaggaggcagtcgcttgtgcatgttccagaagttttactggggaggaggaagcggacagaggaagctgtgtgtgcatgtgaaggggtgggcagggtgggagggatgcacgcgtatgtgagcatagcatgtgtgagtactacacacatctccatgcagaagcacaactgggcagccctggcttccagctctgggcttcagcacaacagacaccagcctgtggtctctcagaagccagggagaccacatcgggctcaggacgttttacccaaagtccagagtttttatgcctctccctggcattctccataaagaagggaaggtcagatgaccccttagatctgtgtcatctgggaatttccttgggctggtttagacacgatgccctctttttctcaggatagcagataacctgctttgaaagagggcttaattctgtgggtcctaaattttctcctttctctctctctttctgtgtgtgtgtgttgggaaaatggcaagtttccaataccagctttggaggaacgattacgttttccctccaatttcaagtccgaaa

SEQ ID NO: 77754 - DNA, 1032 bp, Homo sapiens
cttgccaggtgtccactttcctatgtcacaggtgagaaagctgaggcccagaatggggaagaaactgatccatggccacacagtgagaggcagcaaggccagagcccaactggccaccatggccctcaggtggtaccctgctcattgtggtatgatccgctcatgtcagcaactacatgaaaaaaacagccactgggcatgtatgcagcctgtcacatataccacatgttggggaaggagaagctggaacatgcgggcgggggtgggaatatctacctatattttttaaattttgataatgatgccatcaagtctgtttgtttgcataactgttttttaaaaaagaattgatattttcagtattttcatataaatatacttgtaatataacgtaacagcccagttactggtgcttccaagcacaagtgcaatctcctttgcttaaaggagagccaggcaattattcttatgactttagtttccagcctctttaacagccatgcagagctttaaggtgctacttgagaaaggtggcgctgtggcgtgtgtgtgtgtgtgtgtgtgtgtgtgtgtgtgtgtgtgtgtgtgtcagagagagagagaggagggaaggagaggagggagaaaggaccaccagtgggtcggttgatgaattagttatccctgcttacctgtccctcccacccctttctttcttagcccgttctctgcatgtggaaaggcacatgcagcacccagagggtgtttaaaaagaaaagctgggagcgggagggatgggcaggtactgacagcagacgaggcgaggagaccctgggaggtgcccagtggtggcgggacagagggaacaccgacaagggagacaaagaatgtgctcgtttggtgctcgtgggtgcttgagccccttgggcggcactttgcagccttgctttatgtaattcccacatcgacacctgcccccagggtttgatactgttttacccccatgtttgagatggaaccctgaggcttaaagatataaagacccttgctcat

SEQ ID NO: 77755 - DNA, 1174 bp, Homo sapiens
ggcccccgccggccttggccacggcctttccagacagaatcccagctgggcctgaagtgtgttaaaaagctcattaaatcgaatcatctgctggctcaggctgtccagatgaccagaagttttaaagaaacactcccctgacaaaacgaatattccattacaggctctgttgggatttaagtttcactcacttaacttatttttttccccccttttcctctccttccctaaaataacagacacaaagttctccaggggagccgactggattccaaaaggtacagtgtctgccatctgctccacacggctagcaggcagggtgcctggagggttggtgggcccgtgacactggggcaagactcgtgggctttctggaaggttccaggaagaccaaagaacatttatgggggatcaactctgggctgcgctgtgctgggccccaggattcttgatttcaagaagccccaggcttggggggaggctggcagggtgtgcagagtcctccgctgggacaggcacatagcagagaggggatcttggagttcaccctcctaaatcaggacacgctggggagtggacaaagatgctaccaatgattatgctgtgacagcaggtgtgaaccgggactgtcccaggaaacctgggttgttgcgggcaaactggacggtgtggccaccctggtgatggagagtctatggggctcggtagggacaggagagggagggattgtgcctttgagttctactaggcaggtgtttccacttaccctactgagccgtgctcagagtcactcccagggtctttgcaggctgaagcaataacaataacagcagtaataacgacaacaatgagtaataggtatgattattactcgagatgctatgtattggccatccactgtgtgtgccaggaactgtgctaagttgtggttagggcctctcctgtaactctcccagtgacacctaggaggcagtataatctcaactttcagcgcgaggaaacagaaggggcaagcctgaagtgacttgttcaaggaaggcctcagcccctcagtggtctctggcctctgaatccaaaactcatgttgttaaacttccacgttgtgacttggagaagacttccctggggcctggggtgtctccccatttctggaaaagccaagtgtaaatcggtg

SEQ ID NO: 77756 - DNA, 1052 bp, Homo sapiens
cggattgaatcttggcactttcctagctgggtgaccttgggcaagtcactttacctctctgtatcttggtgtcctcatctgtcacactgggactgtaatggtacccccttatggagtggtcaggagacttcactgagctcatatatgtcaagctcttagagcagtgcccagcaccttggcgagtgctcagaatgacagtgtgatgtagtagtagtcgtgctaatgttgttgctgttgccgcacctcagtcttgaatgccattcctaggatgtggcaaacaagaaagccagctgcatagtgacagggcccagtgccaacatgctctggtctccaaagccaactctcttggcatattgtttgtaaggcagaacagagtatctgagagctctttgtgtctagagaaagggctagaggttggttgcaccccctgctaacacacacacacacacacacacacacccaggcaggctacgggctttctggcctttgggctgtctgggctggggaccctcatggctggtgattctcctcctcccacagaagcgtgtagatctgctggagcaggtggcccgggagcatgaggagtaccaggcaggtgtggacgagttccaactgtggctgaaggcggtggtggagaaggtgaatggctgcctggggcggaactgcaagctgcccatcacgcagcgcctctccacactgcaggtaatccccagctgtgtctcaaccagagggaccctagggacagtcacagagggtgggttctatgtcatagttccttttttttttttttttttgagatggagtcttgctctgttgctcaggctggagtgcagtggcgcgatctcagctcactgcaagctccacctcctgggttcacaccattctcctgcctcagcctcctgagtagctgggactacaggcacccgccaccatgcccagctaatttttttgtatttttagtagagacagggtttcaccatgttagccaggatggtctcgatctcctgaccttgtgatctgccagcctcgggctcccaaagtgctgcgattac

SEQ ID NO: 77757 - DNA, 1060 bp, Homo sapiens
agaagagttttgcctggactaactgggattttaagaaagtcacaggagaaaatctgaggctttgcagccatagcccaggggaagtcaaatggacagtccagcaaaaggggtctctggtgggtgacctatgccagcaggcaggtgttacctagggccggcatagcaagcgggttgcatctcgagcattatgttcgttttcagtggttgcgaggagtgctgcgcagaggtcagaggggagtggctcagtgggtaactttagcaggacctgcccatggacccaggttggtggagtggtggggatggcatgaacctaacacgaccatccccagcctgagaagttcatctcagggagagctcagggctggtgtcagcttggcccatgcccagaacagtgttccttaggttgaggcctctttgatccattcaaatcaagatcattatgggtccagacgtttcggactgcaggttttgacgtcctcttttggagagcgtgcaatctgaatagacagacgagaattgcctccgggcctcaagcttcgagaagaggaagcagggaacctgagaggccaaagacaaagcagttttgccaggccagagccctaggccagttttcccagaggccagacctgttttcattccctgcctaattccattcctgacaaacgtgctcacctctggccatattgcccaactgggagcaccaggggagggttggtggtgggagtgggcctgtcccaggtgtcctgccgggggtctttttgcagccccctacattcctgcctgttggccttatctgtggccctttcttcagcccctgcaggtgccatgactcagcagccccaggacgactttgacaggagcgtggaggatgcccaggcatggatgaaggctgtgcaggaccagctgcaggtcaatgacaacacgcagggaccccgcgcggccctggaggccaggctgtgggagaccgaggtatgcagaggcgtggcctcagatggccctgtggtcttggccccatcccaccccgccctcagacctcaggtttcctatctgtgaaaggcaa

SEQ ID NO: 77758 - DNA, 1068 bp, Homo sapiens
tctgggaacactgcgaaggggcaatctagtctgagggtgcactaaggctcaggggagagatgattccacctttactccttctaccaatgacttgaccgcccagtgccatggtcaaagtagcatgactttgacctaggatgaccaatttatcctgatttgacgcacaccatccaggttttaaccttgaaagtcccaaaccccaggaaacctcttagtcttgggcaaaccagggacagttggtcacaccaactttcaccctcatatccccttccaagactcccagactgtcccccactctactgaccccccacccccacccccaccttccagccactcacaggggctgggttcccagagcctgtgtcctcagagctagccagagtcacgagcagcctttcctctgggatggagagggagacttgctctgggttatggacgggacagccgcctacagcctgtgtgtcctgcctttgaggccccatcttccccggctggctcctaatcacagctgccacaggctctcagatccagtcactgtcttccttatctgagctttatctcctgaagcctccacaatccaaggacaggcttcctcccgggcctgtctttgtgcattcaggagatccactgtgggtgccccgcaagcccacgtgccaaactgaagcaacaagcaactaattacgacaccaccatctccattttgcagaaggaaaaccagcacgtacaaccggtcaggaactcacctctggcattcgtttcacaaggccctgaggattccattattccaaagcagctactcacaatcttgacatccagaaccttctagagccctttccgctagccccgcagagactcagaaaccacaggactcagaaaaacttaaagtcttccccagatgcttgtttctaggtttctaaagtagagctccatgtcgagcagcgagtttccaccaaagacattcacagaaaacagtcagagtggtgccactccaagctgctggaggtcggactcccagcttggaggccccccaaacaatgctggtctccccaagaatctaaggcacgggga

SEQ ID NO: 77759 - DNA, 1252 bp, Homo sapiens
attacaggcgtgagccaccgcccccggccgcctctgagtttccagcctcgttggccctccagccttttaacctgttgggcctaggatcaggaaaggtttgttgaatggggaactaagaagtgaattcgttcgttcgacaaacgtttcctgagcagccgctgggtgctaggcgcagtgccagcgcggaatgtccagggagacctggtgcccaaagcttggacccatcgtgagaaatgagaagcagatacaaagcagtgtgggagtgcagaggagacaaagcaagcctcatcaggcccattgcttgctctgctctcccttgtacttaccagtgcttgacaatatacagttatttactagcttggttattgacttcctacccagcactcagttttattcactgctgtatcctcagtgcctaggacgatgcttggaacgtggtaagtgctcctattggcgggaagaataaatccggaagagcaggaccagtggacttgctacataatctgtagtcttggagccgcacagggttggtggtaccctcgagcacaccagacttgcagaaaaagcatactccagaggaagctgaggcatgcctgctcgagagccagctgttccatgtgcaattttcctctgatagtttctggtcactgttgccacggtgataatgactgggctatgtcattatctatccgccaacagtaagagaagctttgcagtcgagatattgtttagcagatggagtgttttctgttgaacactaagtactgccacaagttacttttttttttttaaactttgagtatttttttacaatgttgctggaggtgatctgtttatgctttgagagtgttcgaatttaaaatcagaaaatcatgtcagtgagtgagtctttcaaataatccttcggcatgaaacctgagcctagtaaactatgaaagtaaactcggcacattacccgaaagtctcaatgtcatattttcacccccatcaatattattgatgattgctcattttctaatgtgggacctgaaatttaccaggtgcttaaagaatctttttgtttttcagattcattgattccaggtaaatcagaggaacaagcaacatgaacagaaatatgtagaaaaagctattatgcagaagcataattgttgtttcagaagtccagcatctggtgcacttaacaatagagaatatattaaactctttccaaaataacctgttgttcctacctgtgttgtaagtgttttgt

SEQ ID NO: 77760 - DNA, 1026 bp, Homo sapiens
cggcttgcgtgcggagatgagcgggtccctcggccgagctgcggcggctctgctccgctgggggcgcggcgcgggcggcggtggcctttggggtccgggcgtgcgggcggcgggctcgggcgcgggcggcggcggctcggcggagcagttggacgcgctggtgaagaaggacaaggtggtggtcttcctcaaggggacgccggagcagccccagtgcggcttcagcaacgccgtggtgcagatcctgcggctgcacggcgtccgcgattacgcggcctacaacgtgctggacgacccggagctccgacaaggtcaggccagtgtgccgggcaggcgccctccgccccgggcccaggagcatcgctgcacgaggccgaggggttccgccgcgccgggctggggagcggggctccatccgccggggtctgtctgaaggttcgagccgggttagggcgaggagtactgccctggagtagagtctgggctgagggtgtagttgatttcactgggtcttgaggatctggggctctgtactgttgccaacttgagcagtaggtaaagtcctaaaggttcacttatcctcacttcgagctaatataggcgtttcggggcgatttgtcaatgactgactcggaggagggtggcccgctgcctgactgctctgcacggttaggaaactcatagtaaggacccactgtgagataggtactttcgcggacactttggggaggttggaagccattggcctactcgtgggtaaggtctagggctgtcgatggtggggagagggctgaggttgcccttgaggctagtgaggtcggaggctgatctcgcttggctcacggctcagggtgtcaagcatcatcctctgtggttgctacaagcaaagggttgggacagctgtcggctgaccttagtcgggatctatgttgtcggggaagagtcatgacatttggctttagatactcaagcacagggctgaatttatgtgggccagggcttggagaggtttgtggggaaaagaag

SEQ ID NO: 77761 - DNA, 1035 bp, Homo sapiens
ccaaagtaaaaattatagaaagtgtgtattattttacctggcacagaaagcacccggtaaatggtagctggcttcgtattagcacttgatggttttcaaatgtattttttcccagattatctagtccttaaagactcttggggataactgatcctccatttgctgtaggtgatagtggtggtgggtgggacctagaaagcatgttgagttgaggagtcgagagggcaggttcaaattaccacgtatatgtaatattaccatgtgttattctcatgacccttttgtcttccttgtcaactagtatgccaccagttactgggctcagttttatcatgtgcaaggcaagggacctgcagtcttccttcgaagacagcttctctgcttaaaagaggagtaactattttgcagtcttttgacagagaccttgcagggagtcccctgcaaattgccaatatggcactagtaaaaaagtggtgttgttatctcgcttagtatcatgtttcgagggtctttggtttgtgaatttattttctcttgtttaatataactggaaatgagatatgctggaatatagctagtaaacggaaaataggagcaaaaatacgaatatgtactgataacattttatttttctgtcttttatccacgtctggtgtctggtttctgagcttactttcttaagttttcaaacagcagcgacaggaatttaacccttacattccttgaccactgagtttcatcagattgctattttggttaataaacgcgttgcatatatattgaatataacatacctcttttattgattagaaaagtaaagattagtaagtattaacatttggactgggcagggtggtaaaagcacgttccccaaatggggattagttcagccaggttattaagactcttcccctcttccctatacagctttatttaccaagagcaactaacgggctgtccgatgcttgcttttgccagccgaaactatgtttgtacaccagatccaaggtcatttctagtaataggaacggagct

SEQ ID NO: 77762 - DNA, 1192 bp, Homo sapiens
ctcttagtggcaagcacagtgttctcaagattgggggaagccagggagggacagtgggttgtctgctactagtgggtcaaaattacatatttagtcatgaatggttcagcttttaccatttaaataacaaataaatgttctttctccataggcattaaagactattccaactggcccaccatcccgcaagtgtacctcaatggcgagtttgtagggggctgtgacattcttctgcagatgcaccagaatggggacttggtggaagaactgaaaaagctggggatccactccgcccttttagatgaaaagaaagaccaagactccaagtgagggcggccaagtcctcgctgagcagagagggagccgttcatgtcagagactcactgccagaaaagccttacccattttggttttcactattgagaccgcaactgcttgcactgatcattttggttcgtgagcagttggtgattttagttggtctggtgttcgggctaagaatattttattgtggacttaattacaaccactgcactgtaatgattcaatgctgtattatgatattgctgtaaacaaaattcattcttatattgtcacttattctttgcctgattcagaagttaaataggagctttggaatcattattcatgacccctctgcaaatgtgtcagtctccaaagagagtatctccccccaaattttgtgtagcttcttttgttatggaaaatggtgaacaaaaaaagaaactgtgataactggggcgttgttttttaaaataaactccagcacagggatgctgtgcatgcctgagttgattccgaagtgcatatgtctgtaaggatttggagtgcctgcagtgttttatgtgtgggaagtaagggtgagtctcatattcttctattaaatttgccacaagaattgccgtcgagccctggtctactttctgggggaagcagctgtttggatggtgagtcaactgtgcagctggaggcgtgggtgggctggagggagcagaggtgggtgaggccggaggaggcggccccacctgcctatctctggagccctgtgcttggcacactgctacagttagatagggagacatcgtcaacagtccaccgagctaggggatttaatgagtattttacttcttaaaaagtggggactttctaaaagaggacataatttggaatt

SEQ ID NO: 77763 - DNA, 1065 bp, Homo sapiens
gcgcctggcctttaagttgttttttaacttttttccatgattccttagtaaagtctccttaaaatgattcttgggagagcagagggcaaggggcagtgtcagttacacctgactaagttacttcagttcaggtgcacttcgtacaaagtgtggtgggatgtccatgtcctaatccctggaatgtgtgactgtgttacctggggtaagtttaagctgtgtttaagttcaggatcttgagatagagagattgtcttggatcacctgggtgggcttaatgtaatcacaggtgtcctgggcaggagggaagcagaggttggagtgatgtactctgaagagggcggaaggggccacaggccaaagatcgcaggcagtctctagagctggaaaagccaaggaaacggattctcccctggagtctccagaaagaacacaggccatgattttagcccagtgaaagtcattttagacttctgacctcctgccctgtaagattaaaaattggtgttaagccactaagcttgtcatttgttacagcggcaaaaggagactaatacacctggctgcctggattttatggtggatgcttacttggtataagcagacagggggaagggtcaaacaattattgagcatttagatccgtaatttgtttctcaccaaagatctgcaaatgtgggatattctctcttcctttcagatgatgacacagagactgggagggggtcaggttacttgtccaaggtcactacctggtggaatttgagctgtgatcagatccatattgtagcacccttcggagggccggctcagtgagtgcagccgcttagtgcagctctggctgtggtgtccagagtgttcgccctgcagccctgagaagaactgaatttgagcttcagttgcctgttgaaagagccagggaggccaggaattttggaagttgcccctggccatccactatcaagtatgtgaaggaagcagagggtcccacctctgaggtcagacaaatggaaggtgaatgcaaatgatgcctccttgcaaatgatgccagggaaagcctcctgggcc

SEQ ID NO: 77764 - DNA, 1414 bp, Homo sapiens
ggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatctaacttcgtgcggaatcagcttctatccttgacttagattctggtggagagaagtgagaataggcagcccccaaataaaaaatattcatggatttatttattttcctttggagataagggactacaattttttccccgtgtaatccaatgcttaaaaccccagtgttcttggaggcatacgttgagaaccattggagtaagcaacctcaaaaatgttgttggcaatgcccggtattccagagccccccctgcctccatctggtcctgccctccttaccctcctcattcccatgtgccctcggccccagccagctctgcctcctccttacctgggcattcaccaggctctgtccttgcacagataacttctatcctctctgctcacaatcccagcagaagcccctcctgcctgaagctgtccctgaccactcaggccccaagcagactcccttccccacctcccatgacctgcagtcacagcagatcccaccctgtgccctgtcctcttgctcccttctcaagaccctgctgcccctcctgtacctctatagacagtagctggacctcagatattaccaggggatgccttccagagaagggaatccatcctgtgtcgaatcctggccttcccacttccctgtgtctctagt

SEQ ID NO: 77765 - DNA, 1092 bp, Homo sapiens
tcattggtctttttaagatgtggattaatgaacctcttaaagtgttgccgaatcccaaatgaaacgggcatgtcccacctttttcccagaaactcggctctcagcgggttttgtgactgtttgaaattcacaaaaccagagcaaagctttcatttttgacaggctcatagggatctgcaaaggaaaaataatgcatcttatgtagggatattaatctcccagcattgtgtgttttagcttctcatgattaactggtaaggttttgaataaaaatgaatgcagagaaacaatcttcattaagttgcttttgaaaatgctgaggtaattatgaaataacgatttttgtgtcatagatcatactactcatagccaaagctggattacatcacaaaacattactcttgttactgatatttattttttaattcattagttttctcatattttttgccttttttctccccgtgtgaaaataagccatcgagaataaattcttccttttcagtttttctttgtcttaaatccagtttttttttttctgtaagatctctaagctgaactcttccacaccatacatataatggcctcatgttaaaatatgttttaagtgccttggatttcttttgggagaacaagagggttatgtatcgtaagtaaataacagtgatgagacatttcccttgtttgcttactcttctaagtcagggcttgagaccatgccctcatgattgcagctgccacacttagcatcatggggacacagcctgagtgctgtggcatttctgcatcagtgaggatgcacacctggactgatcggagtgtgaggaaaacaacagcttccgtaggccaggaaacctggggtttattcccgactcagttgttcattggctttgtggccttgggcaaattatttccatttgctgggtctgggtttacatatatgcaatgggtgtgtacgtttgcatgtatatgtgtgtgtattggtaccagatattgccctccaaactctaagtttgaagaatcctcaaaatttgggtatagctggttattaatacctccagaatgctctgtactttaaggttacataacgtt

SEQ ID NO: 77766 - DNA, 1101 bp, Homo sapiens
tgactcaggatttgcattaaaaagatagctggtagccctgttcatgaccccctgtaccctctatattataggatagtgaagatgtgtaaaacgttcaagaagaaatactgtgtgggaatgagcatggttgtcccgggtgtaacctcaggcaccatttctctgattgcagtgtctctgcttgtctgtatctgttgtctgatcctctgggccctgctgcccagaccccaactccaccagccctgctggggctcggaaggaaagcaaggtagccgctggcttcagcaattgctgcccagccatcgtggactctagccaacaggaaatggagcgggcagtgtcccagcctgattcaccgagccatgggtctccctgtgcctctgcaaatgcattcaggctgctcctggcctaaaaacaatgctcccagacctacatccacagctgagagaatccagggcacacatttgcccgccagcttccctgagcttcccccagcagtgggctcagtgggtaggagagggggacatggtctggaatcaaggcgtgtgccactcagtgaccatttgctttgaaatcaatgtgctcagcagggccagtgacttttgcagagctggctggacaaagggaacatgaagaagggaagagtgtctcagggtcacgggtggttatactacccttgaacttcaccttcctattgctaaggaagagagagagacagaaaagcatgttccacaagccagtgggcaaattcttagctgttttctgtggagtctgggcctggcagagagccctcttcacgactggctgactgccagatggtgccaagggcacggcatcccgggcagtcagcctcctagtgaagattgccatcctctggagggttccctgccccaggacatgggcctgggaagggaatgcaattccaccctccatgggtcccatttacaggtcaacaaattgaggccaagagaagagaagtggaattgtggccgagtagcacatgaaatcactctggagtcggtcatgatccctgaggccggccaatgcccagtgcccattgctggcagcagtccacctggaaatggacagtttgtcctcacactg

SEQ ID NO: 77767 - DNA, 1047 bp, Homo sapiens
atattgttagaatctccctgtttctgaacttcccacataagtgggaacatcctttctgtggtcttttgcaacgcgcttttgcactcgatattgtatttgcaattcatccatgcgatggcacgttccagcatttcattttttcctcgacgctgtgtgtttttccagcatgagaactcacaacggtagatccaggccaccgctgatggccattgatgctgggtccagcattttgcttatgctgacattgctgtctttaaatgctcttatccatgtaccctgctgctcatttgcaggtgtactcggtgtgtatctcaaggtggcatggctgggtcactgaggtgtgagtatgtttggctttataagataatgccatcctgttttccaaagtgacagtatccactgatactcctgccataggtatctgagagtccctgctaccgtacagactctgtcagtgttcagtggtcttgtcagatgttttagttcttgccaatctgatggctgtttgatggtagctcactgtgtttcaatgggcatttctctggtactgaggtttagcttctttacggctgtttactcttttgtaaaccatgcctggacatggttttgcccagttttctactggatatttatcattttcctactcatttgagactagaatgatgtatagtgtatatcccagtttgtggcttaacttttcacttttgatgatattttatttttttgataaacagatattgaatttaaggtcatcgaatttcataattttccttatagtttgagcttttatgtcttgttaagatatccttctctaccccaaggtcatacagatattcctttatattgccttataaaagtttcgaagtgttctttttctattcttatctataattcatctggaactgatgaactactgatttgatttcatttattttttcatacagatactcaggtattccaacactgctcatcaaagacccgtttacccctgtggatcagcagtgtccatgtgtgtgtaactttgtttttgtttctttggcctatttg

SEQ ID NO: 77768 - DNA, 1002 bp, Homo sapiens
tgtttatttttaattttttaaattttattttttaagttttaatttttgtggctacatagtgggtgtatatatttatggggtacttgagatgttttgatacaggcacacagtgtgaaataacacatcatgaagaatggggtatccatcccctcaagcatctatccactgagttgcaaacattcccgttacactctctaatccattttaaaatgtgctgttattattatacttgttgcttattgtttctgttttcctttcccatctctgttattgttctggtttctaggctaatctcctggattctatgagtctcctccatcactgttcatcctccagaccctggccagacaactttttccaaagaaaacaatattctaacttctccatttaaggaagccctcagtaactcccctgggaatcaagccacactcccaacgtgttgtctacaggggaattgaagtttccaagttgatgacttaagcaacttggaaacaaacacccgaggtgcaactcttctgtgagtcggagaaggtctcttctaggtctttgtttgcttcagagtcctcggaaagtaaacacagctgacctgattattcccctccacttcctcctgagtcagagttatctcgagttaattcagggaagaggctaaattaagccttgaaaccaagcagcctccatgacaggcgctttgttttgcttgagtgactgtgatgatgggtctttggttataaaggcagcactaattgtatcttcttataccaatcctggccatctattccctggcctgtagagactgggagatgccaggttgccccagagcacccactcattcattcagcacaattttcttaagtgcctgctccatgcccggcatcacgcttggaggtggggattcaaaagtccttcctccaagggcttgcagtctttctaagacgacggatgataaaccagagactccattagagacatgactagtgcttggatagacatctgtccagg

SEQ ID NO: 77769 - DNA, 1048 bp, Homo sapiens
tggtatctcatgggtggaggccagggatgccaccgaacatcctacaatgcacagggcagccccccacaaataagaattatccagccccaaaatgccaatagtgccgaggtcaggggaccctgtgctggccatcctatctctgattctgaaactatgcatgctttccacttttccccatttgtgagtcattgagtaaattaaagctcttctgagcagcagcagtgatcatggtcactgccctgcgttcaaataatgcgagctgaggacagtgatctgcaactcccagcatgtcatgtggtctcttagaaatccatgtgactgtttccaccatcttgggcatttgtggggacccccagactggagggagaaagccctacaaagtggatgggagtgtggggctgaacttttccctacccttaactttgtgtctctgggacctccagggacctggcccctcaccaatgcatatgaagagtatgcttggggaagagcttaggaatggggtgggcatgggagtgctgggtagcagcctttgagcaaatctgcatcttctcttatttctgacctttttccacgtgcccagtcctatttctgccagttgaaggcatactaatattctttatactatttaatcttttgcagaaaccttactattataacttgctactctccagataccaattcttcatgccgagagcatcggaaatgtttttgtgtcttactgatgttttcatgatcaacttgtaaatgtaagcagttgacttcataaaaggtattttaactattcttggagtcctttgctacccaagcacctggtttcaccatgcgatcactgacttctctacagtgaagactctttcttaataaaggatttcgctgtgctcttttgattaaaaatatctaaccttaaaagacgtaaaaatgtatctgtgaaatctcactttgttagcgttgctgctgttgtcattttctattatgataactgaaaagagaaaagaagaaaacatgaactcctctgtgtctggttctcatctgtgctttatgcaaa

SEQ ID NO: 77770 - DNA, 1715 bp, Homo sapiens
cagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacagagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgcca

SEQ ID NO: 77771 - DNA, 1025 bp, Homo sapiens
tagttatcctatccctgcaataaggacttgcagcaaacacacctcctagtttgatatcacgaaactgataactatttggaggagtatttttacttatgaagggaatatttaaaagacatacttatttttattttatttatttattttttcagacggagctttgctcttgttgcccaggctggagtacaatggagcaatcttagctcactgcagcctccacctcctgggttcaagcgattctcttgcctcagcctcctgagtagttgggattacaggcacctgccaccacgccccacaaattttttgtttttttagtagagacgaggtttcaccgtgttggccaggttaacctcagcctggtctcgaactcttgacctcagcctccaaaaatgctgggattacaggcatgagccaccgtgcctggccagacatacttatttttaagggcaatttactttaaaagattttgttgtgacagatgtgactatataacatccactttgaacaattagggaaaaaatgacaagtcacacttcacccatggctcttgttgaaaaaagggatggggacaattgtgagatgcttactgtgtgccaagtatcctactgtctttttataatttcacagcccccactcagaggcagttactagagtccctgttttccagatgaggagacaggttcagagaggtcaagaaacttgctcaccgtcacatggtttgacttccagacctcatgctcttcccaggacttcatttaagaaaagcttggagcagttacctaacttagcaaaaagtcttcactaattgggaaaccacagaattttgctagaagattgagattaaaggctcttagaatatttgagcaagaaaatgtgcttgatctcttcctggcgtctccagcccctctcccctcttctggctgtgcttagccaccccagcggttcagttctgcatgcccgtgagtaggggttagcaccacctggaagatttctttctataaatgctgcaccacaggccacagtca

SEQ ID NO: 77772 - DNA, 1060 bp, Homo sapiens
atagttgatacttgcctatagaaatgtttggtggctggtgtcaaaggtccttaaagcatttgctgccaagttagtggaaggctcacttttgttaagatgactgtaattctccttgttaccgacgagagatcattggaagctgccttctaacactttgtgtagctctgtggagttggattttcttaaggtttaaaaagaatcacagcttcggaacttttaactgaaaatgagagacagaagccacaggggaagcaaagcaaataggattttcaatataaatatcagtgtggaaaaataacctattctgttgaatttagtgttcatgcacttgagaacaacattatttccatttactccgaaaatccttctgtgggggtttgagaaagtgaatgttgcagacatgttctgttgtgttgcactttatcctgtgtttatgtgtatgtgtttttagattaattcaagttgtgtgctatatttcttgtataatttacaaagttacacaaaatataaagagcagtaaacttgtctgaaagtttttggcaaaggaaggtaacttcaatgtaatagcttcctttaagagtacaggaaaatgcattctgtaatgaagtggggcccatgtaattgtttatattttcagttttaagcaggtatagtgcaggcttgttaggaatgtgtggaagggaagattggaagtgatttttcctcttttaaaagtaaacaaaattcttcaaatatgccctagttaactatttcagcataccatttttacttggttaacagtgtacattttgataacctatcaggaatgaataaagtatttttatttaaaggtgatattgttttatgcttccatgaatattttgcttttcttagagcatattcatagatgcagtactgtgatttaccacaagataattgggaacactttctcaaaatcgattttggttaatatcaggtaaatcattacctaggagtaagagggaaattgttgtcaattcctgactttagattgatccagcagaaagaaaaggtggaactttgtatatatccactgttgaaa

SEQ ID NO: 77773 - DNA, 1055 bp, Homo sapiens
ctctctgcaagctctgcctcctggttcacgccattctcctgcctcagcctcccaagtagctgggactacaggcgcctgccaccacgcccggctagttttgtgtatttttagtagagacggggtttcactgtgttagccaggatggtcttgatctcctgacctcgtgatccgcctgcctcggcctcctaaagtgctgagattacaggtgtgagccaccgcgcccggccttctggacatcttttttattgctctgtggtattacgtttttgccagatatactgggtagataggacgctcttgttaacttgccaaaatgatggctagattctgggttagttcaaggtccttgatttccctggagaactcaaagttcctttatgctgtccccatcactgaagctgtcacaataatataataatataataataataatggaatgttgctttgagttccctagggatttctgagttagataaatggtaaagattcagaagtcatgtgaagttttaccacattggtttgacctacatgtttgtatattcagcttcaaagctcagaagtcattactagcatagagactgaataaatgaaaaagaaagcttagcaatcatcattattttattatgttgtgagaaagatggaaaatgctactaaagttttgttgagaattattaaacatgttcctgctttttgttctcagaattctctaatccaataaaatgttctattgagctttttatcttaattgaattttccatttttttcctaatacatagccagtaatttaaaacaaattaagtaatttcccagagcttagtagaattaggttgaatcaaagggaactatcaccatatttctttagtgaatatattcaagaagctttgtttgccaagtttgatttaactggagtgattaatagtaccagcaaagcccgtatttctgtcttcccaatgcgaaattttagtttacctacattttccacgcactagtgtcacaacaaaatactaagtcataattgcctctttcccttatagttagaattctgtcattaaaaa

SEQ ID NO: 77774 - DNA, 1200 bp, Homo sapiens
ttttttttttagcccagaggaagtagggttacccatttatttacgtttaaaaagtacacaagccctatacttacttaggtaaatgtttattttttccattagactatttaaaatattgagaatagcttatagattttcatttgtactctcaaaggctcctaatcagtgccatagtctaaattacacaccttacaaatgaggaaatgaatgcccagagagattagttgacttgctcaagaccacagttcgtggccaaggcacaactagaacacagattttcttatctctaatccagaaaatccagtacagtttttagtaatgtcatgagagcccccttcctccaaacatttattcattttacaaatatttactgagcacttaactgtatgccaggttttgatctaggcacaaatgaacaaagtagagaaaatatttaattgagtttacaaattgagattacaaataattaaaataaatggtttgtcctattaatatgtgccatggagaaaaaaaaagtgagaaaggagagtattggagggcactggcccgacagccaagtggagctgagtattcaggggatgggcgtgacctggggtctgaggcttctggtagtgattggtgtaaatatagcatctccattttgttgtaggcgcagtggactttggtgagatggcttaggatgtaaccaccaacattaattctgtgggaaaactgtgtttcaagttccaaacattgtttgcagccaacttttggaagccagatcattttgttagatgtgtaccatcagtgtacaaccagccctctatatctggaattctacatctgagattcaaccaaaatattaattaaaaaaggcaataaaaataatacaaattaaaaatacaaaaatgatttgcacagcatttacattgtattaatactataagtaatctagaaatgatttagagtatatgaaaggatatgtgtggcatatatgcaaatactatcccattttatataagggacttgaacatcaaggggtttggtatccataaaggccctggaagcaatccacttcagaaaccaagggacaactgtataattataatttcattctcacaccgttccctatatttgtttgtcgataattctgtttacttagaatcattagtttcaaggattctcacaaaatttaacaatgtaggtggcattttaacaatt

SEQ ID NO: 77775 - DNA, 1081 bp, Homo sapiens
tgaatatcatgttcaatgatgaaatgtattaaggcaatataatgtatgaaaagcagaagttaagtcatttggaactttgaagacacttaaaagtgtccacatggtgaaacccggtctctactgaaaataccaaaaattagctgggcatggtggcgggcgcctgtagtcccagccacttgggaggctgaggcaggagaatggcgtgaacccaggaggcagagcttgcagtgagccgagattgtgccactgcactccagcctggcgacagagcgagactccgtctcaaaaaaaaaagtgtccagcacatgattgttggtaatatcaccacaatgcagaatgagagccagggccaagagtgagagtgctccatttctaagaaaactcaaatgtactttgatttagtcctttttacttttgtaatctttaacttctgtctctcagttttcatacctataaattaatttcctcataaagttatgagaattaaaagggaagtgtgtatctgtgtgtgtgtgtgtgtgtgtgtgtggtggggggaagaataggaataatgactagcatggagaaagaattcaataaattgtagctatatttgaacaatgagtaaaatatatgagtttaagatactttgtttcatagttttagaaataggtgattcttttcttccttagttaaaattacatctcttaattttaggatgctttgttcttcctgaaggatttcttcacaagtctttctgcagaagtagagcttcaaatgactccagatccagaaggtattaaatatgtatagttgaaaagactataccaagtacttggattgattttaattgttatgaggcttttttgagaatgtacttacaatatttattcccacttacataaatgtgttctgtgtttatttttgttgattcgcgaatactgtttatataaaagtaataatttaaaaggtgaaagcaaattttctctgtaacaagaatcgtattttgattaaataaaatgtagaaaaacaaattagatcaagattgatttaaatgtttgctaagaagaagcatatctaatttttcaaacatgcacattac

SEQ ID NO: 77776 - DNA, 1813 bp, Homo sapiens
atctccaagccttagttccttcactgataaaatgggagaaatagtaatatgtgtatcataatgctttttaaaatgaagattaaataaatcagtgtgtgaaaaacattaactgggtgcctgacacactaggttagggatcagtaatgttaactgttgttatttaataataacataacatatgataattgcagaacataaatggagtttttaactaatctgctgtgaaataacaaaaccttcttgacagaaattgtgttgatatgagctcaggtttggaagtagagtatttatttgtggggtggacgttattaatttgcttaaatagtactggttgaataatgttcattagttgtttaaataaaacttgaataactaaaagctggtaacaaatatttcaagactgagcttaaataatatttataaacaaaaaataggcgctgtcttagagaaaatgtactgtgaagtacagaagcttagcatagctctacattaatgcttatagcctctgacctaggttagacttgccaatcagtactttaagtttatgttttatcattatgaaaagaagatattttgatatccatactttaactaaatttatccatatattgattggcctagtggaaatacaatgaaatatttgtgggaaaattgatctgtggcgatcaccagtgtgaacaagactttgagtaagatacatctttctggcatgactttacgaaacttagcaagcccaattttctttctttttttcttcccccgccacagtgtctcactctgtcacccaggctggagtgtagatcatggctcactgcagccttgacctcctgggctcaaactatcctcccgcctcagactcctgaacagctgggattataggcgcataccaccatgtccagctaattttctatttttatttttttgtagagacgtggtcccattatgttgcccagactggtcttgaactcctgggctcaagtaatcctcccaccttggcctcccaaagtgctgggatgataggcataagccactgtgcccaccctaattttctttaatagacttttaaatttaatattgaacacaatttcttatttagaactataaagcattatgattttaaagtggagagttattaatcttagaaccatcagggaaataaattttatgactaccttgaggaagaatgagaaataattcattaagacataaaagctaggaaaacaaagccacaccacaaatatgtaagcgttaatgaggtatatcacctgacacaaaaattcttttcagttcgcctcttttaagattgctataccatattttgggatagtaaatggtcgtctgagtagaaaatcaaatatttttgtttattttttcttgtgaaaacaaatcagttggtgaatgataatgctttgagtattatttttctaaccgagcacatccccacttattcttcttaattgaatcatgttaagtatgaaagcaacacattattctttcatgtttttgaaaaagctgcattgccattgaaggtaagtgcaactgcttccaaagctcagtgttcccttagggcaggcagtaagcattgcagatggaatgagttccatctggtggataagtggatgatggaggtcatacagctaggcagtttgagattcaaaataggaagggggccggatttcctgactctgctagcctattatccattttagttttgtactgcctggaactctgccgggaaagcgtatcaattcattcaagaccatttggtgaatgcctgccttgtcccaagttttatattaggatgctggggata

SEQ ID NO: 77777 - DNA, 1042 bp, Homo sapiens
cctatacatacatacctatgataaagtttaatttctaagttaggcatagtaagagattaacaataatgaataataaaatagaataattataacactatactaaaataaaagttatatggaaggtatttctcttggtttcaaaatactgaaatatttttggacctcagttgaccatgggtaactgaaactgtggaaagcaaaaccttggacaagcagggagcactgtagattaataaatgagtgaacaagtgaaggaatgtcatgttgttgagttttttgaaggtggaattgtaagctgaggtagaattcagaggaaaaatgagtgatattttgcattttaaagagaaaatacaatttaataaaaggaatgtaaagaactgttccgcgttcttcctccttacccgttaaggtgaagtttcagcatgaagtctacccgccatgcaaacctgattgtgattccagcctctcagaacacccagtctcccggcaggtgttcattgttcaggatcttgagattcgagatcgtttggcaacatcacaaatgaataaatttttatacctgtattgcagtaaagaaatgcctcgaaaagctcactccaacatggtaagagttaacctcatcgttgtgttatgttagttttggaaacgtgtttttattatatctaacttcaggagagttaaagtagggaaaattactagatatcttttctcattttaatgtgaaaagtcccttttgaatgtattgcttaaagttttatgtttaaaaaattattttgcatgtcacttctagggtccattaactctaattgctaataaattgatatctgaggaaaagtagaagtccctagtgatcagtacaaaataggtagtattgctgaaggtgttccagatttctaacactctttacattttagtaaggtagaaatgattctttcaggactttggaggtccctcacagaatttgattttggcatatggacctatggttagcttcagggtttcagtaaactgttactaagtacaacattatccatttgcaatt

SEQ ID NO: 77778 - DNA, 1167 bp, Homo sapiens
aaaaatcatggttgatgatgcaattgtgataagagacaattatttcagtctgcccgttaataagaccgatacgagcaaagcccccttacactttcccattcctgtgattcgctatgtggtgaaggaggtctctcttgtctggcatctttatggaggaaaggattttggaatagtccctcccacttctccggctaaaagttatatgtaagttaatttctatataagtttatttgggaggccaatatattcttttcttagaaaaatagaattttccatttcccctttagagagaaaaaagaaaaataggatttatcattttaagaattattaataaagtagtattaaaaactgtaatttaaatgttactctcacagttttccaattgtgaacttatttgtattatttgtatttttactaaaatgttgactctcatcattttcattcagcagaaattttcaggtatctaccatgtacctatttcacaaaaatgagtaggtcctgtgagtcatgtgagtgacagagggcagtgaaacgcaggaagtgtgtcaggaggtggggtcgggcatgccctgtccccagcattcagcagggcactgagcagagagcctgtggtcattgagcgcctgtgagacgagtgcagtgtgccggtcgctgggagaatcaggtggacagaatccctgtagggggcagacttccttattgaggtggggcatggcatggaggctgcgtggagcagtaacatttgacactatagttcagcagctttttctacttaaaagcgactttaaaacacgtccaactttactataattattttgtgtattagttgggattcctaggacttgtgttctgactataaagggtttccaaagtaacaagaagcttataaggaggtctcatttctaagtgtatcctgtgatacggatcccagcatcataattagcttttcctgtagttttgagtatttagcaagcaggtgattactctaatggcaataatgaaacgcgtgtttcagtgtctacagagtaaagaagatacggttttggtttctagtaatttgtggcagcgttctgatagctctgtactcttactttgtctttcatcttatcattttccttaatgtcattcattgactttctttgaatattcctttaacaaaagggtttt

SEQ ID NO: 77779 - DNA, 1033 bp, Homo sapiens
tccagagctccgcctataggacagaattgtcaaaggtgaaattctgggtaaagcaaaactccactcaacactaaccagcaactgctgagcttccccaacgccaactaactgggaggaaactgtctttgtgacattgccatttcgaatttatcatttgtctttttattagttgttgttttttgtttgtttgtttgtttttttgacaggttcttggtctgtcacgcaggctggagtgcagtggtgtgatgtcagctcactgcaacctccacctcccggcttcaaacaattctcctacctcggcctcccaggtagctgggactcaggtgtgtgccaccatgcccagctgatttttgtatttttagtagagacagggtttcatcatgttggccaggctggtctgtaactcctgacctcaggtgatccacccatctcggccttctaaagtgctgggattacaggcatgagccaccatgcctggcctattagtggtttttgatgtatttctgactcttgctgaggtgttttggtgcatgttacttagctctctttaagcctcagattcatagacttattttaggaaataaatgagatattgcaggtaaaagcacacaacatatatctgacacatggttaaaatgcttgttgttgttgatatttcaaagtgtgccaaaatgttgtaatctttttatctaggtgttttggatgaaaaatctcaaattcaggagccatgttgttcagacctcttcctgtttcctgacgagagtgggaatgtatcccaggagtccggccccacctatgcctcattctctcaccatttcatcagtgatgcaatgacaggtgtgcccactgagaatgatgacttttgcattctttttgcaccaaaagcagccatgcaggtaataaattaataacattattgaagccttgaatggtgttacaaatgaattgaccaaagggtacctggagaaaattctgttgattttgtaaattctttatagttcagagttacttttttttttttaatatactattg

SEQ ID NO: 77780 - DNA, 1008 bp, Homo sapiens
ttaaagacgcatatgagtttttatggatatctgttaatcattcagcttgtgtctactcagtgtctagtaaataggtaactctggccaggctggtgtcgggaatgcagagtgagtagaagacagtgcttatgttttctggtagcttgtagcctagtaaaacaaatgggcacaaaactggtgccagtacttagactgattgataaatgatgtaagaaaatacttcaactgtggtatatcctctactgtttggaaaggattgggataattttattagactttagtaaagtaagatggcttggctttttaaaagtggttgggatttaggtatgtaaagagggaggagaaggtaatcttggcaaggtcattaacatcaacagagcacagacaaaggcatgcatgagcctcagttatttagccatgacattcgggttcttactgaaacaaaagttctcttattgaaaagaattagataataaagttgggtaagcaaagagggacccaggtgattcaagatccttgaaagccaaagggaagcaggtaaacattttaaagcctctatttcaacagtattttcttctaattgaatggtcatagctatatctatatattgggaaatcttaattaaaaattatttcatggagttgtaaaagtctagtgttaactgttgctgtcttgctaatttaggataaattagaactaaggaagcaaactggggcttttagtgttctatgtactacattatttgtaataaatgttagcagctaggctgggcacagtggctcatgcctgtaatctagcactttgggaagctgaggcaggtggatcacttgaactcaggagtttgagaccagcctcggcaacatggtgaaaccccatctctccaattaaaaaaaaaaaaaaaaaaagctagatgtgggatgtgttggcaggcgcctatagtcccagatacttgggaggcttaggtggggtgggaggatcacctgagcccaggagacggaggttgcagtg

SEQ ID NO: 77781 - DNA, 3213 bp, Homo sapiens
ctatagacgtgtgcctctatccctggctgattaaaaaaaaagttttgtttttgtagagaaggggtcttgctgtgttgcccaggctagttgagaactcctggcctcaggtggtcctcctgccttgtcctcccaaacggctgggattacaggtgtgagccactacatctggcccactctatctttatactatagtttaaaccttgtgaatttgggcatctctttaaaaactgccaaaaatttagaattaatttgagtagatgatttaatctaattctttacaccatttaaatattcctagcattcataaacagtttttaaaaaatgttagatgacagttataagttagaaactgcttatgatttcaacaatgttcataccagaaagaatgatgcaattaagcatatagtgattatggggtatgatactcaaagcttagtttttcagatgttggttttatctttcttgcctcagaataatcttggatgaagctgctttacatctatctgacaaatgcaatactgtcactataaatctgagtagaggtaagagttaaaaaacaaatggagtagataaattctgctttatttttgtgcgtaaataattttaaagcattttaactctgggataatgctagtgaactaagaatcttattaaagatccttaaagattaaagggtctttaagtatatagtgatcatgtggtatatattcacagcttcatttttcagatactggtttttcagtttgaaattgtaatgttcttataatgctagttaagtacatcaaattactatatatactacaaatttttatttaagataatttttgtttctaacaaaaaataaagtgaattttaggacttctatgggatgaaactattttcattgcattataattatttgtagtgctctctgcaatgaattttaaaggaatgctagttgtattgggtgttggttggatacacatttttgaaagctgtactgaagagattttcttaattttaaaaattttagattatgttcgtgtgatggatatggggcttttggagttaaccataactgcagtgaagtctgattctgatggagagcaagtgagttattaaaataaatgaaaattttaagttctattttttaagagattaaaaaaattgagtttaacatttttccgtgtacctaattttggtcagaaatagagtaagtatattaaaaatggatttatttaaatactttttttatgtagcgagacagattatcatgaatcttatttaatgtaaatctatgcaaaaaaagaaacttttgtctcatttggaaaacattttcatccctttttctgtgtcttgtccagactgagccccgctttgagttacactgttccagcgatgttgtccatatcagaacgtgctcagactcttgtgctgcgttaatgaatctcattcagtacattgcaagctatggtgacttgcagacacctaacaaggcagatatgaagcctggagcctttcaaagaaggtctaaggtacagtcagcaatgtgattcctccagtccctgccatgtcgtgacatgtttacattattgaggtcttcatgacagtcataaggtagaaaagaaactttgaaagtcattcatctgttctttaccttcagaataatggggtctgaaacggtggtttcatgggcctttttggaaaaccattctgctgttttgatattctttgtttccattaatcttcctagcaaacatcatacttttttttttctagacttgttattttcatctgtcctaagggaagaaagaaaacatttatcatgcaaaagcttgttctatgcaagttgtatgtaaaaatgctatgaaaagatagatggcaggtgttagtattgttaccagaagacttacttatatcatcatattttccctatttttttatctctaagacaatccagttttcagtgtactttgtcatatatgacttccttttcctttcatgatgacctggtgagatagagaggttaaaaattaataagacccagagaatttagatgattgctctaaagagtagcagaaacagcaacaaacccagatattttggtgtccagttcaatgcacttttctgccccaagtgtcacctttctaacttctcttatgtccaaattgaagaatgtccagtttgtttagcattttttctttttcattgttattctttgtggtctctcttatgaacagaaatctcagtccccttaggttctagagcctctgttatgtactctagtaaaggcctgactggcatcgtgtttgttgtcttttgttcaggattattttacactttatttgtgttaatttctgtttgtgactccttgttcctgctgtattctcacgataaggtgatttatgacaccccgcctactatttattcccttttaaaaaacattcttcttattttaaattatccctttcagcttggaacttgctattttagagtcatgctcacatataaaaagcacgatctgggtttaatgaatctacagttcaccaaccattggtgaagtatttggttaagtatttggtgctggaactgagctctgaatcaccgtttagtatatttcccctgctgtgtgtgccccctactgttgttaggtgtccaagaaatgaggcctcgtcctacaggggctttatgtcaaagggatgaaagtcattgcaaccatcagagttgaggagatcaaacttatttagttatcccttctttcccagctttattgcagtttgttcaacttccctgttttcaaatgcattgcctcttcaagatcccagttcactgtgcttgctttgaggtggtgacacatttattgctctttgccagtatttgttagggtgataatactaaaaacttgaaatataacagctgctgggcatagaaaaatgagtaggtttctatttctgatgtttttgtacaatgtaatgtatttttgggataaaataaatgtaagtagtttggtttttaagagcattttcagttatttttaattaggttttttggctataggtagattccagtggtcgatcatcctcacgtggtccagtacttcctgaagcagatcaacaaatgttacgagatctgatgagtgatgctatggaggagatcgacatgcaacaaggcacctcgtcagtaaaaccacaggctaatggtaagaccaggactcttctcagggagcactgatgt

SEQ ID NO: 77782 - DNA, 2209 bp, Homo sapiens
agtccctctcttgggcggcttgcagtctaaaaaggggaaacgagaaaattcaggagggtgctgtaggtgctgtgatttaagtgggtctgtgtgaagcatatgctgtgggtccagatcttacgatgggtttactagaagacgtggtgaagtttgagttttcttgaaaacttcgaggatggatgaggggaggaggctaggacaggggcatctgagcagtgacaggtagttctttgaaaaagtaggatgtggtgacagcctaggtatgacatatgccttcccattggttgccagtattgattgggctagtctcgctagtcataagggtttttctctccttattttttgctccatatgcattcttcatctcatgaagtcttcccagtgaagctgtgctttctgttgctgatgagagaaaaatcaggtatttctagggaaagaactgaattgatcccacagataaatacttgccttaaaaaaagaactgaattgggagctggatgtaatctacataatctggactttcatccccatttttccactaattagccatgtgactttgggaaggtcacataacctttatgagacagtttcttcaggtgtaaagtgagaataatgattctgccctggacaccccacaggactgaggggagggtcagtgagatgatgcaggatcagttccagtttacaaagtgctctcatataggtgagccgtcctccttttctgttctttgtgggtttttatttttcatgagcttctgtttctaaggtatattttgaaatgtaatatgaatttgtaatttgatgtatataacataggtaaaattaggcaagtatctatttaggtatctaattgtgcagattcttttgtcactgccctgcattatagccatatcagttattttttcattgaaagaatgcagttgttatttttgttgtttttccaaattcttgtaggatctaatttccattttgccgtttaaaaaattattgttcatacgatcttttaaaaggatttttttttaagtttgccttctgttgaactaggagttaagtacttatttttcaacttttgtctttataggatctttaatgacttgctactgtgggaaccaacagctccttcaccagtggagacattcgagaatatttcctatggcattgggctttcagtagccagtcagctcattaatactttcaacaaagatagttttagtgcatttaaatctgcagttcactatggtaatatatttttaatttgttttgatttaaaatgcctagtttatcaattaacaaagtactaacctttgaattgtggatttaaaaatctttatgtttcattgtaactatattttgcaatttcttttagtaatttataagaatatttccttatttctatctgtatattgagaatatcattatcacttaaatatgttctctttagaatgatagtgtgcacattgtttgaagttcaaagctaaagagaaaaacagtatgtatttctgtgttcacaccatattctttgtaaaactaagcaggttatataaaatattttcatgatcatttttatgttgctgttttaatatgctatcagaatgtaattgtatgtttatttctcatagatgaggaaagtggatctgaggaggagactttgcagtatttttccactgttgatcccaactatcgttctcgcaggaaaaaaaaattagactctcagaacaagaactctcagagttttctctcagttcttctgaatattaatcatggattaatagcagtgttcacagatgtgaaggtgaggtttacaaatccgaagtgttttttcaaatgtatcttactttaaataaatctgctaggatacatatctagtgattgaagtatttgatattttgaagttgtttcagggactgatgaagaccagtgtcctggggcaaaccatgatgatagcaactttggggatttagctttcgttgcagatcaaactttgtggggctctccctttggaaaacaggtgctaattctgcttctggggtgacaacaaagtacagagattcatctgatagaagaggttccacatagcatttaagttatccagttttattttataccatgatattgaatagttcaaggattagactgctttgctgcagtatgggagattttcctaagctgaatcaacaaagagcatctcaaggaacatgcttacttttct

SEQ ID NO: 77783 - DNA, 2287 bp, Homo sapiens
catttttcatttgtaaaatggattgaaaaaacacgtatagaatttttgttgttgttgtttttgtttttcagacagagtcttgctttgttgcccaggctggagtgcagtggcatgatcttggctcactgcaatcttcatctcctggcttcaagcgattctcgtgcctcagttggatgtcaccacacccagctaatttttgtattttttagtagagacgggttttttccatgttggagaggctggtctcttaactcctgacctcaggtgatccgcctgcctcagcctcccaaatgctgggattacaggtgtgagtcaccgcgcccagcccgtgtagaattattttgaacagaggtgtttcttacagtgtttggtacaaaatacatatttaagaaatgtagttatttttctagtggtagattatatagactttatgaagaaataatcactaatagcacttagtaagtggtaagtgcttgctctatttactatgtcattatgtactttatgcagtgtaccttggtacttaagaatttgagtttgaacacaaaacagaatctttaatttattggctcattctgtctaccacacgtgcacatgaaaccagaacaactgaaaaatgctgtagaacttaaggttgcattatgttcctgattgagaggatctttgctcctccatctcttcttttagtacttgagaagaagcacatttcagtaaatcagtctttttttttaggatcgttccaggaagagaaaggagatccatctattaagtttttccatgtgtctagtggagtagatggagatacaacatcgtcagatgactttgactggccacggtgagtaagcaaatgcataggtttaataggattttccttttaaaaataaaatattcttttaaaccaacattttgtctattaaatataagctaaacatgtccatccttgattcttttgtggttcataagcgtgatgattgggtgttcacatgaatgtgtgagatgtgtcaccctcaaaccttgttgtgctatttttctgcctgccttgctttactcctcctctccactgtctattagaccgattagattcttaggacagatgttgctcatacacacctggtaataagcatgagtttagagcacaagtttcataaggactggatctacttcggttaaataattcagaagcacaatttatattaggatatgtatcaattaggaaaaaagcctgtgatcatttacaaaccaaataacaccactacctagggaataagagttgcagttgcagcacagctattctctttgagggttccatgcctccttataacaatgggtggatgtggtaatcaaaggagaatgaaaagtctgtgctagagatgttctgtagaagcttaggaaagggattactctggagtaaaaagctcattagtttttgtagtcataggctgcattaactcagtgatctttaggttttgtggttataaaacagaaacagcaccagccctttattattgaaattactagatgaaaacataactttgttgttagagttttgaaactgtttcctaatcagcttctcccttttccctttgaacaactgatataatatgaggttgatataacatgaggtttcttaggtagacaagtaatttattatagcagaacagactatatgtgagaagatttggtttaatgataactagaatccttaggtaaagtttgctgacttttaatgaaatttaaaaataacctttttgcccccttcagttacccaagtataaaatgtttatgtctttctgttacttacttgtttcagttccacacttgtaagtttacaacatgttcataagtgggttaccttagacataattagactttgtagagaagtttaattctatcattaagatttaaccagtggtgtgtgtattaatttgcacaaaagttaaagttttgctgtttacacttagatcttggtctttttaaaattgtctttgctatcagaattgtactgaaaataaatccaccagccatgcattccattttggagagaattgcagctgaagaagaagaggagaatgatggtcactaccaggaggaagaggaaggaggtgctcattccttgaaagatgtttgtgatctaagaagaccagccccatctcctttttcttctcgtagagtaatgtttgaaaatgaacaggtaaaagtgtgagcaagctacaaaggaataatactattattctctgtcatagagcaatgcttttgattttttatttttaaaaaaatgccttgtgta

SEQ ID NO: 77784 - DNA, 1971 bp, Homo sapiens
atttttagaaaatactttgggcgtttatttaatctttttaacttttttaaagtatgaaaattgatatgaaaagtagttttacacctaatacaagaaaaactctacaggttaggattatagtatttatactcaaactgtaaaaacattttgttttcttccacccccctttttttttcttgtatttttaagagagatggggtttcaccatactggccaggctggtctcgaagtcctgacctcaggtgatccgcccaccttgtcctcctcaagtgctgggattacaggcatgagccactgtgcctggacttttttttttttttttcccatttttgacaaagtttcaaacatctgccagtaggaaaatagaacaaaagcggcagaaaatataggtagacctcatttgggcttcaccgactaaagtttttgaaatattgcataatgtttttagataattttaagagactatttcatatattttacagatctgaaagattttgcctttgcaatgtaaatttttaaatgtggaagacgaagggcagtgttgggaaataaacagatcctggaaaatttcccatcaacagaactgattttttatcttaaggaaagggaaatttgaagcaatctttctggttaatttccttaggagtattaattattgataacttgaacttgtcagactaggtggataattgttacattttaacactaataatcttaaatggtgcattttttataatagatttataggtactggcattaaagtatcctatgaacaaagacaaagatcagcttcccgatattttagtactgatatgtccattgggcaaatggaatttttggagtgcctatttccaactgattttcattctgttcctcctcactatacagaggtaaatattgaatactttttctttaagattattttttaaatctaccttgctttttaatgattgtatgaggcaatgattttctttaaaaatgtatagaaagccataggaggaatattgtcattttctttttgcacttgtgttctatagaaatatatttaagaatgtcactcaacatcgttataaggatctgttagaattttaaattagagttgacttgtttaggagtgacaggtgggttatgagagaaatgacttcatttcactcatgttcaaagcactcttcatttcagaagaatttgattattgaacaaataattatcgaatgcctgctgtgtgctaagcattgtttaagacaagttaaatgtcttgtgttcattcaccatttttctgatatttttcctaatgtaaaagtgtgacctaaagaaactttagaaaactgtcaaagttatgttcattgctgttactttgaccctttatagtgttttatttcaaaaacactttcttggaaatgaatttatttgaatcctcgcctacattttacagatgagatatcacatgagttaactaacttgtctaaggttcacattgctagtaagtgacaaaaatgaaacttaaaaccagatttctgacttcagaaagcctttctcattattgtatgggcacctctgtaaattcttgtgattaatacatttaatttatcttcatctttacttttaagcttttaacgttccattccaaagaagaaactggttcccattcccctgtgtgtcttcagcttcattataagcattctgagaatagagggccccaggtaagagatctttttctataattgccacctgtaaattttaatctgatatatattttgtcacaattataaggttttaacccaattatatagtagtttttagtgattgtattaatgccttttcttttttttttttaaaagggtaatcaagcaagacttagttcagttcctcacaaggcagaattgcaaattaaattaaatccagtgtgttgtgagctggatatcagtattgtggacaggttaaattccttgcttcaaccacagaaacttgcca

SEQ ID NO: 77785 - DNA, 1042 bp, Homo sapiens
ccctcagtcaatcatgtgatttttgtttcactatttacattttccttggaagagaacctcaggtttcttttctgcaaaatttaattgatatagacccaaggcttaaaggaaaatttggtgagcagtttttggttaatcttgagttttccagtatgtttttattaatataaaagcttggtttgtacatttactgttgtcacgtactcttgtactttagtacaaaaatcttggatgtaagatgcagcaagatagcagttgattttacttaaattaattgtttaatatcattcaaactgttgtatgatcatctgttttttaaagctaataaatgagtaaatgttttataattttaatagttttatgtgtcaaattttatgtatataattttaatacttgtattttagctctcccatctagatctgtttcagtggatgaatcaaggcctgaacttatttttagactagctgtgggaactttttcaatctctgtgcttcacattgatcctttatctccacctgaaacgtcacagaaccttaatccattgacacctatggcagtagctttctttacttgtatagaaaagattgatccagcaagattttcaacagaagattttaagtctttccgagcagtgtttgcagaagcttgctcacacgatcaccttaggtaaactctcacatatgtattaatgatcctttaaacttccacatatgctaatgatccttgaaaaagaaccacatgtggacttttgtatctgcctatctgcatttgtttttctaattcacattttatttgtaaatgaatggaatgagtgaagttttcttgcagtgctgcaaaggtgtttagaatctttcattcaggttatttggcatgcagaataacagatctagataataggagttttcaaagtgatctctttagttccctgcccagctcttgtcaagtttctttaaccacattttgccttcatccctattgacaccactgcagtcgtgaaaacagttcttattgtcactggcattagcagagatgacagtggtga

SEQ ID NO: 77786 - DNA, 1139 bp, Homo sapiens
acccagcttactttacatttataggtgtttcacaatgtataaatgctaataacataaataatatggatcaatttaagtatggaatgttggacaaaataagaaatcaaaccctactcaaaaaattttggccataataaacttcatttgcatgagagtaaaacaattccgaaagaaggaactgaaatgtaaatggaattccaaataatgtttttggctctgaataaaagaaataactgtatccagatgaaactagaggttgcaatatatttatactattttaatatctgattttaattcctaaactggcatatcacattaaaaatataccaggtaatactacatttatatatttaaaacaaaagaaaacatgttcatcagtagggtagcttcattttttattaatttatattgagtttttactatgccattaatattttggactcataaattacaccactgtaagtaacataaaatttggggcatcgctgtatctcatataatctgaaggaagaggattgtattaacgtatattaacttacttaaaagacttgaattggtgggattataatacaagtgacatagtttaattctctctagaagaagaagtattcttctccatggctgatatggacatgtctcatagtctctcttctcttccaccccttggggaccccccaaacatggaccttgagttatcattaactagtacatatacaaataccccagcaggatctccattaagtgctactgtggtaaagtattacttaatttttcttctagactgaaaagttgcttctaaaattctacacttcattcatgtgcttaaaaaaaatcttttatagcttcagcccacttggggagagttccttgatcatcataaagaacagccagtaagagggtcaacatttccatccaacctagttcacccaacacctttacagaagacatgtaagtaaaaataagacatttgttgttagtttccgctggaatttttaaaatgccattctactggtgcttttctttcttttttttttttttctggtcttggccatttacaaagttcagaaagcaaaatgaaccattgttaaacaattcactgtgaagtgttttagaatagttgctcatttattgtattcttt

SEQ ID NO: 77787 - DNA, 1023 bp, Homo sapiens
gtctgtaaggaggaagcatagcaataacttttatagttctgttttggttaattatatgtagtcctcaacatttgtatgcttttatatttatgtaaacccaaacttttgtacatgatgtgttgatttgtacaaatgtcttttataataaaacattatgtatacatttgtacaaatgtataaatatatgttacttttagagttctgtatattagtgacaaatgaacatgtggaaaaactgcgtagtggcattgtgtgccagccaatatttaatatttagaagtactacccttgcctatagagtaatttttgtgtaatgacttgagtatttgagtataatttgtttttatttaatgcaaatgatgctaaatggaaaaagacaagttctggattttagtattgagaaacatagatctcataaaatatagtgtagataaagatggcattaattaggggtgctgaaaatgtcagatctttaatctctttctgatgtacattagccttaactctttcaactgtggattcaaaatgttatgaaagatttcatgttttttttttttttttaagttctctgaatagtattcccttgagtagtgtgtaagtctgtgtttcatgtattcagttttagcctatgtttttaggaatgcattttattgaaaattggagactgcccgtattgaatttagagatgttttgtttcagttaccatgttacattgagttgaaatttgttttttagttatgttcttttatattttcaaaagaaagtagtaagtactttgttctttttatgccaaacttagaatgtacaaataatgaaatatttctatgaaaattttaatttcaatgaattagaaatgaaactcttgattggccattctaatgaaagtcagagattgtgctttcagtacaacaattgtgaaattataaaacaatttttaaatttggcatgtagttagaaacacattttctctctcctctcagccttaggttggctcatggcttgggatgtcagtagtcaggaagg

SEQ ID NO: 77788 - DNA, 1043 bp, Homo sapiens
taagaatgtttcgattgctgcttatattctcttggtgtttaataaaattatcttcagttcaagaaacattgattactgattatttgtcaaaggtcacctggagactagagtgttaccttcactttttctgtttatatgcgtgaaactcattgatgataattgaaagcaaaatacccttaaacagaagaataaaaagctctaaaggactctatggtggggcatttatttgctgagtagttcaggtgtctccacttttagtttaagagttattttctcgttagcatagtggtgactaaaaaaaaaaaaatacttgataggactggtgaggaaacacttcataggactggtgtggaaaatgttgcttgagccaagtaggttgagaatttttactactcatatactatagtagccttggattttcccagaatgactgaatttcaaggtaccttatgctacaagatatatgggattttgctcaagtggttataagactgggcataaatataacctatttaaacatcttatacttagggaaattattttgtagcttagtggtgcaatgtaaattctggaactgttgactctccaaaactgttaacatttatcagtttttttctttttttccttttctttctttagagacagtctctgttacctaggctggagtacagtggtgtgatcagctcactgcagcctcaaactcatgggttcaagcgatcctccaatccagcctcctgagtaggtggggactactgatgtacaccaccacacccagttaatttcttttaatttttgtagagaccggatttcactatgttgcccaggctgatcttgacctcctgggctcaagtgatcctcccacctcagccccccccagtttctggaattacaggcatgagccaccgtaccaggcccctttaatattactcttcactgctgtaataaacctttttgtatttagaggtttaactttatttcaacttctctgccacaaaattgggacgaaaacttggtgtttactgagaagagagttccatcaagtc

SEQ ID NO: 77789 - DNA, 1553 bp, Homo sapiens
actgaaaaaaaggtaccttcggagattcacagatcctaatggaaaaactgatgctaattgaagaattgctgtactcctactgtttcaattctaaatgatcaattatgcaaagaattttgttgaactcagcaatgacattcctttcattcctgatctcaattagtttttctattatggctaattgacattgcatatatacacacaattaggtttaaaattcagtttttcaagctctttgttcagaagacttagattggttggaatagtcttttcatgtttttaaacattttgtaaactatatagataatgacttaaaaaataagcaatgtttttaatagacattgttttcagcaacaaaatcatggaacaatggaaacatttccaaatacagtttttcaaatgttctcctcatagtacaagtagtctttgaaaagtggttgctttcttactcattattaaagtgctatctttattttgaaaagacagattaagtatgttttgttttttggaaaatatctgctaggtagcatgtactactgatagtcattgtcataaatacataaatagtcagtggagaattcttctctgtgtaaaaggaaaatgcttatctttaaatccaacccttaaacacttggccataggagaaaccaggaaaccagaaggtaattgccattcactttctctttacaaagattctactgtttaaaggtctggttttattctatagaatgtatgtggaaatgtttcagtgtgcagaagtggaaggaacatccaactgagggcaccactcttaatccttctctgttgtggaactactagttttctctttgtaccagtttgatatgtggcttgaaggaaggtgccagtgcccatttgtatattaaatataagtacaacttttcaatctaaatttggaaaatttaatatagaatgtctcattttcctctcacatccttatgaatcatctgataatactttaggatatatgcatccagttttggagattactaccttaaacgtggcatgaagtggagggagaaatagaggcaaggggtttgggattgttccatcattggaatagactgtctaaaaatttcataaactccttgtccctagaagtggttgaaatggcaaaatgttgaaaggaggaaattctatttggggtgggaagttggatttaatgactcattcctttttaactctatgactgtgcctttatttttgatttttaaatggaatttctttcattaatcgattcagtacatttattgagctcttagcatgtgccactgtgaggggctgggggatatagcagtgaactaaacaaagacccttttcttacaggagctcaagaagatacacattaacaatttattacactgaggccttttattttattttttttttgagacagggtctcactctgtcacccagactggagtgcagtggcgtgatctaggcttactgcagcctcaacctgctaggctcaagcgatcctcctacctctcctcccctccctgcagtagctgggactacaggtgcatgccaccaca

SEQ ID NO: 77790 - DNA, 1033 bp, Homo sapiens
taacccattaaactattaatccataaatggattaatccactctttgggtagagcactcatgacccagtcacctcttaaggcttcactttttggtgctgccacgttgcattggaaattgaatttcaacatgagttttggaggggacaagtattcatactaatagcacaccccaattaaaagaggttgccagatggatgaaaaagcaggaccacactacatactgccagtaagaaacccatattaaataaaaagatatttgtatttccattccgaagaccttaaaacagcctattatatcaaaatcaaattcctctctctaggtgtcagcatgctgtcagattgggccatccctgcatatccttgtattttagcccgactagttcctgccacaccctgtgctgacctttgcttatgctttgttccctacacagaatttttcacaactctcaagacctttttgcttatttataactctttattcatgctcattccaaaccaattttgactgacctgtacccttagtcaagccccatcataactaaccattacgtcatagattatagaatgtcaaagctcttagaacagtaaagaattttctgcctatttaccttattttgtagatgagacctccgtaagaccaatgagattatgtgcccaactcaggttcatacaagtttagtgataagagtttgtagtaggacgaagacatatcattgttttctgtaattatctgccactcacaattaagtacatttggggagaataattatgatgtgtgtgtatggcattaatatttgtgcaaatatttcatgtgcctgttttctttcccaaagtagactgcaagctaccagtagatatcttttattagtattctagtgcttaaaaaaaagtcggctatgtaggtaccgagtggattatgatatttgattaataaacttagaatccaagtagacaagattataaaacataggataatgattcattagtttttactatttgaaacaatgatgattgattcctttacatacagtaa

SEQ ID NO: 77791 - DNA, 1051 bp, Homo sapiens
ttttcaaattctttctctgcatttccttgagcttctaagtaaaaccttttaaatgttgaaaattctatagggagcattttagtggtgtttctgtgttatacattataagttgctgaagtattaaaggttgtatttaaaatgtgtatactctgactttgagaaatagtttcactcagttacccatgtatctggtggtctagtggctaggaaaagaaataatttatttttttgaaaggatgattactcacataaacacttggattttgctttctgtaccaacatgaaaactaatgaattcactgttgcatttctcttgtaggtggtaggctatgcttttgaccaggtagatgatcatttacagactccctaccatgaaacagtctactccttgttggatacactcagccccgcctaccgagaagcatttggaaacgcactgcttcaaagactggaagctttgaaaagagatggacagtcatgactacactttttcctttcagaggggctggtgctggtacagaatgttgatataaagcttaaaattcttgcatatggtcatagaaaatgcatctttggttttgtgtttttatcacttgcttccaacttaggcttttggctcagaagattattgaataatgatttgtcttagtttctgtttcagtaagggaattctgaggccgttgctatgataccatcattaagacattcacatgtcttcatataatatctcttcatttcaaatcctaatcactatttcatactattacagggctttgatgctgccagcactgtcttttacataggaaattctagatttgcacagtaatagaggaattagaagtacctaactatacactttgattcagcctgctaaatcaggggttcaatactagcttggacaaactttgtagtaattaattgctaccagccttattggaaacaaattatcaactagtttcccctgcacaaattttgaaattcactgcttcacttaatctatttatattactaataatggattaataaagatgaattaattatatattactta

SEQ ID NO: 77792 - DNA, 1050 bp, Homo sapiens
aaaccagcctaggcaacatagcaagaccacatctttaacaataaaataaaataacctatgtggctcctattacatttctatatttctgttggacaacacaaacatcatcactgtgacccagctctgcctgctgctagaggagtgcagtatccggaaacaagttaattaagctctctgaccctgagttcctcatctgtaaaatggggaattataacagtacccactcctccaggaatgcaatcaacttaaatgagatgacagtgtgcaaagcatttgctttgccttggtggcacccagcaagcactcgggaaaggtaagtttctagaatcatcattcactggccccctgactctaattttctcttaccatttgggaaatttctgtttccttgcagtttctatctaactgtgtagttggggcttcgcttgaagaaattacagaggaagaggaagaggaagatgaaaataagtcagctatgctggaagcttcctcaaccaaagtgaaggaaggcacattccagattgtgggcacgctgtccaagcctgacagcccgcggcctgactttgcggtggagacgtactctgtaagtcccggaggctctggccaggagtagacagagggaagagtcaccttccgctccaacgccttgacaacttgttttactgtttgcctcccctcccctctcttccacagacatggccaggttgagggaatggctttctcctgtaatggagatttacctcacagaccccacttttaattttcggccaaagcaaagagtttaaattagatagtgttggaaaggatggatctaagttggactttcagactcatacagttctcctcttcagcatattctgccttgcattatccaagacgagtctgtgccatgatgggtgccatctgtgaaggagaaataggccaggcgcggtggcttacgcctgtaatcccagcactttgggaggctgaggagggaggatcgcttaaggccaggggttcgagaccagcctgggcaacatagcaagatcctgtctcttatatttatgaaaa

SEQ ID NO: 77793 - DNA, 2234 bp, Homo sapiens
agtaaccggttccaacccaaggcagcgactcatgcgagtcgttctaagcgccgcgctggggggtacatacggtgcacgcgtgggtgcctcaccccctggcagcgcctccagggacgctgctccgggaaagagcagccgccgcgacctcaggcggcgggaaaggtgggacctcacaatgcgccggaagcggtgcctcgtggcttgggatctctccgggttcttccttgcgccgtccacgccgcactgcccacgagggcgtccccgcccgagggacaactcaccgcccggggcctccctgagcgttcccttccaccatctgacacccactgctaagtgtgagaggacccagggggtaattgccgggccgcaggcggccttaggaactccgcttcccgtgaggcttcgcggcggacggcgctggtgcgcaggcgcacgcacggcgtgcgtggtggcgtcagcagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgttgtaagtaatttgtattctgttttctttcgctcgccggctgggccttggggggcgtccgggaaggggaagaggtaggcggagagggtggcacgcgagcccgaccctccccgctggtaggaggcaggcaggactggggaccttcctgtttcctcgctcgctcgccgccgcacttccccccgtgtgctgggttcccgcgtcccccgacccttcctggctgggtcagctgccgtcgggccgggggccttccccttccggaattgctggcggaacctctaactcgcccggccactccagcttctccgccccgtccacaaagaaaatcaaaacaacccgaaaacaaaacattgcctggtggtggggaaccacgaccctgctgcacgcgggatcagcacttggggttcgggctcgctctcggcgcccctcgggcccattcgatgttgcttttctgttcctggtctgtctcagtttgctcactctcttcctcccatttccagatgcctgtcttgtgcgccggagttagcccctttccactgaccttgtctgaatgtaggagcacgagttaaaagcccagctttgagcgttgagtccgcctgcctccacctccgcctccctagcattcacaggcggtcggagaagggggcacttcacagggtgccctcctccaaaacgacttatgtattgctttccctgttttgttttgatggggtaaccaggtttcattctgtttccttctttctctatctctggtgatactttttttttcctggttgtaaggcttgaagctagtctctttatgctttctaatgccactgcgcctttttcttttcttggtgggtttttaaaaagtttttttctcccctccccctttctgataatgagatataatttggcagctcattgccagtagattacggattttttttttcctgcaaatatacagcattgtagaggcctaaatagtgagactgcatttcttccatttttgaatattgaagcgtaagagtgcctctttgagaccagggaccgagttttcttcatcttagtagcctcaaaacgcaacatgtaattgacactcaaagttttggttaaattcaggataaagatttttgtggtttctagacatcgaatgtagtaactcaggtctattttttttttgtaagtaaggataatttctttagcacataatcaccgattgtagttttacaattatatatgtgtgtgaatgtgtttctttacaggtgagactctaactttggcacagaccttaatgacttctatcgcaatttatgtattttaaaaggattttccatggctcccacccacccccttaggttattaagaagtctatcacattacttctgtgatgaaaacgtttgttagacttaactaactatacaggtctaaaatcttggaatctgcatggtttctgtttattgatttttccctttcatagaataagagaccctaggagaactgagtctaagcaagattgttgtggtgtttctcagttcaataggagataaatgtttgcagtgatgtcgtgatgactg

SEQ ID NO: 77794 - DNA, 1389 bp, Homo sapiens
gcgagttagttcaagtgtgtaaaatggaagacggggccaggcgcggtggttcacgcctgtaatcccagcactttgggaggcccaggcaggtaaatcgcttgaggccaggagtttgagatcagcctgggcaacatggcgaaacttcatctcaacaaaaaacacaagttagctgggcgtggtggctcatgcctgtaatcccagctacttgggaggttgaggtgggaggactgcttgagcccaggaggctgaggctgcagtgagccttgatcatgccactgcgttccagcctgggtgacagagcgagactcaaaaagtaagtatacgataattactgtagtaaacaatagagagaccaaagaatgcctagttaaagaaaaatagggcttcttcctcattaagttgctttgtttttcatgtactgctgtcacactgtcataaatgttgtttttttgatgtgttggattgtgatttcccggctatattgtgtttggctttcatttttggtatacctgtcctaatgttaaatttggatgggtgagtggcattggggcatggaccctaggtgagttgtcggaatgaatttaaatcaaaattatcgaaatttaggatattacagaacattttgatcaagtgtccatattttgtctaaatttcatatgtagctacaaacatacttttggaaagattatagtctgatttaagagtcatggtggtgaagcttctgaaagttttgatagtctttggatccattaaacagtttctcacctagtcattattgacatttatgccagattcattccttgcaggtgcctgtcctgtgtattgtagtttaacagcagccttagcttccacctactggattccgggagctccacccctccatttccccagtaatgacaatcaaaaatgtctccagatattaccagatgtgccctggggtgcaaaatctggttgagaaccacggcattaacgaaaagtgtgatgcccttatggaaactagatgtatttctgccctactctgtgttggtcagatatttttggcatcagctcagttctgagtatcacacatatgataaaaaggtgtgaaggagagtaaccagtatcagtagcatttatgccacatgcatagaatgttgtcaaagttaccaaaaagagttactgcaaggtttaggcgagacaatagcaaaaatgttttcgggggctgcacaaaaaagagggaattgtagtagttttacatcgccataacaagcagaactggtacctgctggtggatggtctgtgcttcccagagcgggatctgtggatgcttggggagggggaccactgagatctttcagagggtacataatgttcaaactattttcatgttattgagatgttttgtctttc

SEQ ID NO: 77795 - DNA, 2856 bp, Homo sapiens
tttttcccaatacttaaaagatgtttctgctgacattggtggtaatattaatgcatatagttttaatgctgtataatgtgtgcttaaaaaaagaatgttttttaatatttggtagacctgtataattcagtgaacccatattttccaaatgaccatttgtgatgtaataaaatcatatgtgcattcaagggtacattcagagtgcaaggtaaaccagattttaatgcaacagagtaccaagggcttattaatagggttttaactttcatattgtaactaatctttgcaaaactgccacttgtggagttctggtgtagtatcaaagaagactactcatattaattgaaaatactaaatactcctcttttccagttataatgttgctcccagcactatgggaggccgaggtgggaggattatttgagcttacaagttcaagaccagcctgggtgacatagccatctccacaaaacaaaaagaaacagttataatgttggtttgatgccaggttttcttcatatgcttcaactagaacaatttattgcaacagattgaatgcagaagcagctatgagaatccagccatctttggtttagccagaattaaagagatttacagaaatgcaaaagcatgccattcttactaaattttttgttttggaaaatagtttttttttttttttttttttttttgagacggagtctcgttctgtcgcccaggcgggagtgctgtggcgcgatctccgctcactgcaagctccgtcttccgggttcacgccattctcctgcctcagcctcccgagtagctgggactacaggcgcccgccactgcgcccggctaattttttgtatttttagtagagacggggtttcaccgtggtctcgatctcctgacctcgtgatccgcctgcctcggcctcccaaagtgctgggattacaggcgtgagccaccgcgcctggccgaaaatagttttttaaagctatgttaacatgtaatgagtttcttgttatttaaatgaataaatactttaaaagttcttcagttataatttccaatgtagtggatattggtaagcataatgcatgtaagaaagagctctttggagtgctcaatacattttaagagttttacaactcgtaaaggggtcctgagaccaaaatgtttgaaaacttgagaaatcctgcttgagaacagctgccccaagatgaagtagacttttcagtggtggtatgagctgtccatgcagcacctctggtgtttttttgtttttcgtttttcttgagatggagtcttgctctgttgcccaggctggagtgtagtggtgctagctcggctcactgcaacccctgcatcccaggttcaagtgattctcctgcctcagcctaccgagtagctgagattataggcccgtgccaccacgtccagctaatttttgtatttttagtagagacagagtttccctgtattggccaggttggtctcgaactcctgacctcaggtgatctgcctgccttggcctcccaaagtgctgggattacaggcccaccacgcctggcctctggtggttttctgaacactgtctggtggttttctgaacactgcacctcagcccaccccaaccgtctgtgatttaaataaaatttttttgttgttgtcagtgaaaaacaatatagtagataacctttaggaaagataacagaactgtgggagattttgattctcagattttaaaatttggagtttttgtagtgaattgctgctcagtaaatgttgattatggttttgagatgtggtgttctgccttaaacatgttttcagtccatattttttggtagagaagttggaaggcaaggtattggagttgagtaaatttatgagcctactcagttcctatccctgattgttttcctcaccttcttaaggcagaagccagttctggcttgataacaactttgaaaatgttttggctcatcagaacattctattcttgggtaactaagtcaactttaggttaacattacaattaaatttcatcttcagttttatctaggcaagtttataaagctagcttctttcaggtaaaatgagaccatttggcttcttagctagttctcattttgggagggtgtgtgtgtctcttttattctgtatgttcagggttctaattacctagcagcttttaaataattggacaatgccagtttatgatttacaaagcagcaacattataggaggtaattggttcccctaaaagttggttaaagttgaggctcaaaagaatacctgaccaaggtcataaaggtactaaattgtagattggggcttaaatcagctctggattctgtgttgcattgtcattccagtacactataccatctcctgtggacactgtagggaaccatgtgtggttagctcagttggagtctttatttatttttgagacaggaactcactgttgcccaggctggaatgcagtggtgtgatcatgggtcactgcaggcttgacctcccaggctcaagggatcctcccacctcagcctcccaagtatctgggactacaggcacgcaccaccatacgtggccaatttttgtattttttactgtgacagggttttgccacgttgcccaggctgctctcaaactcccgggctcaagcaatcccaccttggcctcccaaattgccgagattacaggtggctcatgccaccatgcctggccagttggaatctctgtatagtttcaagtagaattaattttcaagctcaattttttttgtgtgtataacatgtaaatctcaaagtatttacataataaaaatgtatacaaaagtatataaacaaaagtaacatatagtgt

SEQ ID NO: 77796 - DNA, 1740 bp, Homo sapiens
gtctgtaatactatgacttactataatcttgactattttctgatacattttcacactctttcgtactttttcaggtcctgtttcatactttattaaatttacatttctttcattttcaagttgtacttggcaagttgatgtagcagtgtacaatttggcttttttttttttttttaagtttctcctagccatatgagagagagggacacaacacacacgcgcgcgtgcgcttgtgcgcaaaggggcagttggaagtaccctttggaagtgaggaaaaataacttggccattgtagtaattgaacagcaagtaccctttctctgcataagcaaccttgaattttcagtttggccttgggctttatcatacatactttattccccttgagcataaacaaactattaacatcatctttgagcctctgctgctgctttactaaatattggctggatggcccacctgcagtacgtttttaagaatatagtgggatctaaatatttttagtaccacttacacagaacaccttacggtgggccagttaaccatcgttttaatttcttagcaaatagattattttggcgataatcttgcctgtaagctactatcatgccgtataccttgtgaaaaaggagattgtattattttggctaataattaatatttaatgcacattgagatactttagagagatcccttgtatcttttctgttcatgtcctttgaatgagcacattaaggttaagacctttaaacagcaaattctactgtgatgaattgttactttaaataagttaactgtagtttatctgattggtttcaaagaagaatatttagcaagtttggctttcagttttaactctatcatgcaaataataaagtgttttctgttaagtagtagctataaattggggcagttgactctgttaatatcatgggccacaacttgttccaaatgcctaatatcactaggtggggattaatcagtagtgcctgatgagttttgtataaattgagacacaggcgggctgtggtggctcatgcccgtaatcccagcactttgggaggtcaaggtgggaggattgcttgagcccaggcgttcgacaccagcctgggcaacatagtgagatcctgactctattaaaaaaaattaaattgagatgcaaagtacttaaacattaactatttaaggaaaacaccaatggaaatatgatgttctgtccttttgtgtgttagtcgtctgcctagattacgcctctcctttccgatcatttactgtgtacaccttctggcatagtcatgattttatctttgtttctttaatggtttttttcccaaacttctactttgcacttgttgtttaaggatctgaatcccagactaaatttgagattgtcattgaaaacagagactaccttaagcatctttgtatttctgattttatttagcattgtcttttatgcatatttaggaatttggtacatttcaacctcataaatactgtactttctgacaaaaggtagatgagaaaaaagtgcttttaggaaaattgagttgatgtttaataacttggccgccctagcagcttcctggagcaataaataaagcaatatttgctttggatttactatttctagccacagagtattgcactaaaaagctattttaaaaatctttgtttatttcacaaaatagtgttttaattagcataaactgagtttttagctaataaccaaaagctaat

SEQ ID NO: 77797 - DNA, 1227 bp, Homo sapiens
tgtaaatttcagagtatgcatttgtttctttttatttggtaggtctatgttaacgtagtttttccttttctttctttctttccttccctttccttcccctccctccctcattctctccctctctttcttccttcctccctccctccctccctcctgggctcctatctcaaactcctgggctcaagccatcctcctgcctcagcctcctgagtagctaggactacgggcatgtgccaccaagcccagctaatttttatttttcatagagatgggtgtcttgctgtgttgcccaggctggtctcaaattcctgacctcaagtgattttcccctgctgtgcctccctaagcattgggattatatgcatgagccatggtgcctggctcatatatattctttcttgaattagatggaacacatgtggttttatcttgacagaaagtaatactgaggctagatgatgtgcctacatttggaataaagtaaataaaaatttccagcttgcgtctgatttatttccccatcaaaatgttagtgtaatcaatattttttcaaattaggctgaacaagtcttgtgcgcgtttagaaatcagggcctgtattctaatgttctagtgagaaagttaaagtagacaggagctttccaagcattgtttattgtgacaatgaaagcctaaagatttgagtaagaaaaaaatgggaagatttaggaatcttacagtggatactctttgtttttttaatgatccaaactgaactggtaatgaatttaattccttgagaatggaaaagaatgcagagaaacatattactcgcacaaaacaaaaatagaagtttattgcttgaagctacaaaagtataatttcagcttatacttgacttaaaagctctccttgcttgaaccagatctagcctagacaaaataaagtttttacactttttctggctttacttgcgttaaagtcatttataaaagcattcataatcccaggataattgtgaaggactgtagtttattcagaaaaactcatgaagcaatgaataacacaagataatacaattacgttaggatatgtggtaagcgtactttgtattgtgcacttgaaaatttaagagtagatctcaggttgcgtgctcttatggcagaaaaccagaggggtacacagggaaacttttggaggtaatggatgcgtttattaccttgattatgctaatggaactacaagtgt

SEQ ID NO: 77798 - DNA, 2472 bp, Homo sapiens
tttttttttttggtagagacagggtttcagcatgttatccaggctggcctcaactcctgggctcaagccattctcccacttcagcctcctgaagtgctgggattacaggggtgagcccacacctggcctataaacacttaatttcttaaggaatggaatttgggagaaataaccgatccagattttgggtctttccttattgtgtacttggttttgtatgttattcaactgttagtttaaaattattatgttgacttcttaatttaatgaaaaaatatttatgaaaaaagattgagtcagatttatttcctaagcatttaaagcatgctatgcctttttacaaatttggaacttatcttaaaatggataaaatagctgtgtgtgtgtaaaataaaccttttagactagcatcattatcgaagtgtaaatctcttaaaaagatcattaacaagcttaaggtatattcaccctaagggaaagaactatattcagttctttcccttcaaattttgtttaagtttttgctatttgcttcattatctatgaacttcgttcattgtaagccagatgccaggtttcatttggggaatgtcttatattggtaaagtagcatttctgtagcgtgtttatcaatgtttaagaaacagattttggcttcttttcaagaggtgaaatttctcagaagtttactatattctgaattagtgttttctctagcaatgtatttggtctggattctaacttagatgtttaagtagtgacagttaaaatccttggggcaggattttctctttggtcacttgcttttggtcactttttgtcaaaaattttgggggtattgcagggaaccaatcatgtttagaaatgtgtgttactaaattagtttttctggtcttactgatttgtttcaaattgtagaattcttttggcagtaattgtatccaattttgtttatagtccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggtaaatagatattctatatttttttaactcggaaacttttattaatgttgacataaactaattttgaggcattctctacttacttagaagaccagggttatttgcccagatctatatatctgttttggagaagagggatacttaagagagaaaactttttgtttttgagacggagtcttgctcgttacccaggctggagtgcaatggtgtgatcttggctcaccacagcctccgcctcctgggttcaagcgattctcctgcctcagcctctcgagtagctgggattataggtacccgccaccacgcccggctaattttttgtatttttagtagaggtggggtttcaccatgttgggcaggctggtctcgaactcctgagccttggtctcccaaagtgttgggattacaggcgtgagccaccgtacctggctgaaaacttttattttctacatagagttctcttcccttaattttgatgttatttatttttttttctgaagaattaattttgattttttatgcttttggttattatagtactgaattgtctggagaaaaaggaatgccttactcagtgtaacagtgcctgtatatatatatagaaagagagagagagagaaagcgagagagagagcgagcgagcgtgcactaactacaatatactgtgcttctgattgcttaaaaactcataatttaggaagaacgcctatttaaaactttaagaaatttaatcagtaatgatctggaatacttgattgataattgttttatcaacaggattttaattttgggaaaactaaataacctggtaaaagagtggatacgagaaatcagtgaaagcaaggtaaggcaacttttttgtatatgaaataatttcatatatagccaactgaacacagcaagtgtcttatataacctgttcttatttgagtggatttggagtctttaatgtggagtcaattttagactattgataacagattttacattatttttctagttaatttggaagcaggaaaaactgaactgagttaagcgatttttaaaaataagtatagtactctttgtttggaacatttgaaaactgaaactcagtaattgtaaagtacttacactcttcacagaaataatggatgtttctctaaaaaggtgctttaaacatatttgagactcttcttaccttttaagaaattctgccacagttagtttttaaaaaagattttcaggtattattcaaactgaatatttatttatttatttattttttatttattttttttgagacagggtctcgctctgtcattcaggcggagtgtagtgacaccattatagtgcactgta

SEQ ID NO: 77799 - DNA, 1093 bp, Homo sapiens
acctcggcctttcaaagtgctgggattacaggcgtgaggtactgttctgtcctctttttttttttgagacagggtctccctcttgcccagactggagtgcagtggcatgatcttagctaactgtatcctccacctcccgggctcaggcaatcctcccaccccagcctcctgagtagctgggactatataggtgggcaccaccaagcctggctaattttttgtagcgatggcttttcaccatgttgcctaggctagtctcgaactcctgggcttaagatatctgcttgccttggcttcccaaagtgccaggattacaggggtgagccactgccccagcccctttgagtttctaacacttcattatgaatactcatacatacaactcataaatacatggctgggcttcttctggtagagaaaatgtatttgtagagttgtgtgtggagttcatttgacccatttaaaaaaataacataaatagtggtaatttttccagggtagtacaaaatccgtgtttaatctataatataactgaaaggttgaaaagagaaccaagggtaaaggaaaaatttcatagagcagggagacagggtgtcaacttaaaagttgtagtcttttggttttaatgaaatttatagtactgtttacttatgcagtgtatatgtatatttcaaaatacaaattaaacttcagcaaatgtagtattctaaattatggactttacgtaccatgtgtttcttactgattttagtttctgatagaaaataagattttttttttggtttgtttgacatctaatactcttcacttaaaaatgaaaaaaagattttgcaagtgaaaatgtttttccatgacctgaattaagaaatcttaatttctgggttacaatgatgataataagtataaacatactaatatctaaaaatgtagtttataatatactagtcactagtcaccagccaggtatttaaataaaaattaaaattaaacattcagattcttgactacactagcaacatttcaggtgctcaacaaaagtgataacagtgacagaatatttacatccttgcagaaagtaccattggagagtatt

SEQ ID NO: 77800 - DNA, 1042 bp, Homo sapiens
ataaaaaaaatactctaatatgttgtgggatatttggtaaaaatcgttgaatataatctttttctttaaagcaatcagaatatgtttttattatactctaaattggtgattcattttatatacagcatctttgtcatgaataaagtccccgattctaacgtgctcctgtgggattacatgatcttctcaatcacagtcttctttatagtagtttctagaaatagggcaagaatctaacaataaagaataaacctctttaaaagttgaaaatggtttgaatttcaaatatgattgatctgaggggctggtattttttaagaacttttatagactttgaataccctttatataaatttacactgtaatctttcttggatccactccctcaccccagtatagtatcatttgaatagtttcccttgtgctccactggcaaaataaccattttttgtttcaacagaatcttccacaatctgtaattgaaaatgttggaggaaaaatttttacatttggatcttacagattaggagtgcatacaaaaggtaagtattatttcatttttcttagaaagggaccctttagttcttaaaaattatgacatacccgtctcagttacttgtgtatcatatagcttaggcttgcatggaagagagagtgctttgaggagtctaaatttttcagtaagaaagatgtaaaataatgctgacttctatatcgccactgtccaaaagtattattaagattaaatgaaattagcttagtgtggtgactcatatctgtaatcctagaactttgggaggccgaggcaggtggattgcttgagcccagggaggtcaaggctgcagtgagctgtgattgcattgctacacttcagcctgggtgacagaacaagaccccgtctcaagaaaaagtaaataaataaattaaaaactcagagtttcagtagaggtagccacattttatctgttcagtagccacatatggctagtcgttactgcattggaaagtacagatacagagtagtttttctgttggagagctc

SEQ ID NO: 77801 - DNA, 1851 bp, Homo sapiens
tggcctcttatcaagcactgaattaatgacaaatattttaccattgtctacttctttggattcttctgcttgaagtttattttgtaggtcccatttaggggcctggtagagaacctataagcaccaaatacgtagtacatagaggaaaactatttttgttttaccaatgaacatggctatgactaatgacatcaagatgttgggtgtatgtttgaataattccctctccaccatgaaagtacttgctgagccatctttctttgggctcccagtttacttgggccactataaatagaggatgctgcaggatcaaaatataccacatcaattaaaatcatgtttgtcctccattgactggtaattttaagtaaggggtggaacatttttagaagctcaccagtatgttaaacagattctcaacatcaaatactaccatgataggatgcaaaataattttcttgtaatattaattagtggttgatgggcttaattttttttaggtgctgatattgatgcgttgtgtgttgcaccaagacatgttgatcgaagtgactttttcacctcattctatgataagttgaaattacaggaagaagtaaaagatttaagagtgcgtaaatgttcggggtgaaatgggatgagttatgaacattcatttagtcagttgagtgaattttatgatatagccatcatttattgagttcttgcaatttgccaaacctttctaaacacttggcatatgtgtttgtgttttattctttacagcaagcctaaaattataaactcatttacagattaggaaattgaggcaaacaaaataaatatgaaataatctggccacaatcatacatctgatgagtgggtgaagtaaaatatttgaaccttgatttctgatctgtctgatcgaacagcccagtcttaaagctagctatttttgtgtcaggtgttttgctaaagtactaaaactagtagaggcttaaaatgtagtttcagagaccctgaacttgtttactttccttataggctgttgaagaggcattcgtaccagttattaaactctgttttgatgggatagaggtaaggtatagttcaaattgacagttcttgctatgtgctgtcactaattttgattgatataggttaaaaacttggtttaaagtttataattagtgagttggttgtgatattaataacaattaaggcttttaaatggaagtgactgcctattcttgtagaatataccattttaaatctttttaaaaataccaagtgaaatttggagctaaaacagaagtaatgaaaccttaagattgaaatgctattacaaaaaagtttttttggtagcttttccatatgccagttttgtgtgcttttagtctcattaaggcagtagcataatgtgtttttgcaagtaatgctttgctttgacttcatttaaaaattgggagaaaagtgtgagtgctgaaatatcttccgataggggaggatttatggactcaaattcttgagatgatgttcatttctccttgctgctttcggtgtgtgtaattaaagtgatgagaataaagttgacagtgaagcaactttagtaattcattacttttgctgtacagaatggtactggaaagtcacagataataaagtgaagattgtaacattttggaaactgtaagagaaataatttattgaagctgggcacagtgatgtgcacctatcaggaagctgctacaggaggatctcttgagcccaggagcttaaatctagcctggcaatgtagcgagacttaatctctttaaaaaataaaaaagataattcactgttgtactattttgcaaaaaaatggctgcatct

SEQ ID NO: 77802 - DNA, 1056 bp, Homo sapiens
tggaaccatgaaatcataccctcagggataactaccaaagctgtgctgtttctttgcactctcacctttcctttagaaaagaaacaattttgtcagcggaattctatgtcttcaaaattagccttaactgtggttgttttaggctgtactttccccagtgtttttgttttacttaaaactcagttggaaaaacatactgtagtattacagacataaaagttctcagatataatggaatctctttattgagaattatttttggctaaatgtaaggatgtttgccttatatttgagtactattaagttctcatgtataatgagatctccccttattgagaggtatttttggctgaatataaggctatttgcctaaatttgggtactttttagtatgtaatcaatttataattcatatagatgaagagctaaacagttaactttaattcagcatatgtatttactagacttactatatccagtagatgcatttaacaaacttaatacatcaaacttgataattgtgattaaactgacaaccaggtatttgtacatttccatttctgttttaaaaatattgccatgtttgtttgtttttttttttcttttttttttttctgaggcagggtcttactttacccaggctagaggcagtgttgcaatcacagttcactgtagcctcaacctcctgggctcaagggatcctcctacctcagcccccccaagtaggtgggactacaggcgcttgtcaccatgcctggctaatttttaattttttttgtagagatggagtctcactatgttgtccaggctgatctcgaagacagcctcaagcagtcttcctgccttggctcccaaagtgctgggactaccggcgggagccactacccccagcctatattgccatgttttaaaattatctaattaaaatacctatgatacgaaataatatagtttggacttttggagggacattgtcgtgttcatagataatgaaaggatcctggctttaaggaaaattaggtttttgttttgctgttttgagtcagggttttactc

SEQ ID NO: 77803 - DNA, 6458 bp, Homo sapiens
atttttttgtagtttttgtttttgagacggagtgttgctctgtcacccaggctgtagtgcagtggtgcggtctcggctcactgcagttctgcctcctgggttcacaccattctcctgcctcagcctccccagtaactgggactacaggtgcccaccaccatgcccggctaatttttttgtatttttaatagagacggggttcaccgtgttagccaggatggtctcgatctcctgacctcgtgatccgcctgcccaggcctcccaaagtgctgggattacaggtgcgagccactgtgccagacctgtattttttttatagagacagggtttcgccatgttgcccaggctggtcttgctcaagtgttccacctgcctcagcctcccagagtgctgggattttttgtttgtttgttttttcatagaaatgccttaaaagtagtttgacagatatggaatgttgttttgtttgtgtttcagattgatattttgtttgcaagattagcactgcagacaattcctgaagatttggatctacgagatgacagtctgctaaaaaatttagatataagatgtataagaagtcttaacggtatgagaaagcctacttccttttgtgtacttcagtttttgtcagatattagttgtttttacacaagttttgtattgaagctttttatagctatattgttaacacagtagtgagttaaataaaatgaactttgcctaataaactacagaagagtatgtagtagtttatttcactctacagtattttatacactgtatttcttctgtcattaatggtatactcaggacacttaaaaagaccatctgacttttgtactctgttgctagtgatttaggtttcatggcctaacccaaattaattttgatcctgttattctttagtaatgctttcagcattgctgagatcagaaggactactttggtacaattttatattagcatagcttgttactgtgctcttgaagagcagttcttggaaactttagtggattaagtcttccgcagtatatgtgggaagttttaattgtgaatctgaagttcaaattggggcaggttacagtttactttggtttctttggtcagtgcttacaataggagataaatgctttagattttttccccctctttattgaattagctttactggttctaccaaataaaaatttatgtttacttttaacttcaatctcagaaaatttggaagcattaccattaaacttttgatgatttaatgttgtttttttttgttttgttttgttttgtgtgtgtgtgtgtgtgtgtgtttttttttacccctattaattaggttgcagggtaaccgatgaaattttacatctagtaccaaacattgacaacttcaggttaactctgagagctatcaaactatgggccaaacgtgagttcagaatttgttggctagcttattaaaaatgttcaaacttttgttcaacactaacttatctttttgcttttcccttatcaacaggccacaacatctattccaatatattaggtttcctcggtggtgtttcctgggctatgctagtagcaagaacttgccagctttatccaaatgcaatagcatcaactcttgtacataaatttttcttggtattttctaaatggtatgtgtttagattatattaaaataaaattgattgtagacactgaagtttagtcttatttctatgacatttctcagcttggtttcagattcaaattttagttcatgatgtagtcatgtaggcagccttggagatcacattgtgtataaaatggcaaactgaaactattttttttccctagtttggccaggatagtaaggcagattctatttgtacttccttgcataaacttaccctctgaataaactctgaattttagcagctaagatccaatttattgataggttgggaaatcagttactatacttttggataaaacttgtacacactacctctttcactcttttaattctctatctataggccattagtttcttgtgattgttttttttttctttttgctttcagcatttatttggcctaatattaaagatacgaattttcataagaagcttttaaagaataaattaacattaagtgcttcgggacaaaaaaggaatttgagattagtcattaacccagatttttttaagtttcttcgtttcatttccacatatgtcaactatgatttaagaaaaagtagaataaaagattactgccattttatattaattgccttggcccaaaaggtgagggttcttggtttttaatcaaattaagataaatcgtccattcctgttcttatgaactcctgctcctccctctgcaaaagagatgttcttttctagtaattttataaaaattagttatttgagacaatttagagctgtgttcaactggaggaaaaataaaaaaaatttagaaccatgccacacttttcagtacacattctggctgttttgggatttagtagcacttataatcaggtgtgataagattaaagaatgtcagaatttcttttttttttttttttttttttgtttgagacggagtctcactctgtcacccaggctggagtgcagtggcacgatcttggctcactgcaagctctgcctcctggattcatgctattctcctgccttagtctcctgagtagctgggactacaagcgcctgccaccacgcctggctaatttttgtatttttagtagagacgaggtttcactgtgttagccaggatggtctcgatctcctgacctcataatccgcccgcctcggcctcccatagtgctgggattacaggcgtgagccaccgcgtccggctgtcagaatttcttttaatgctacacatatataagcaaataatgtttttaagaagctaaccttgatgttaagagtggcaggtgttctccagtttttacctctttcatatgggaccaaagtagctagtttatggaacacatatgaaaatgtggttatgccaccaagttttactactacacttgtcttaccacttttaagtcatgaattctataattattcatacccctttgcctgtgatcagaagtaacttttaaaattatcacttgactttggatggaactagtataaaggcaggaattttgtctttcagtggagatttattctgttcaaggttgaagtggacacatcattatcttgggatggtacttctttatttaaatagtcctttaaagttctttgagtggcagagaacgtttttggtttcagtctgagaaggctaccaaatggtttaagttcatttcatagttaggagaaaaagattttgagtagtctaatgtcgtcagaaaggattaaaacgttgtatgtaccaagaaggcagaatgaagaaggatcacgttcacaaatgctgtatgtttaacaaaatacgtttagatggtaatatccaatagtcttatcaagtgctacaatctttttaaacagggaatggccaaatccagtgctattgaaacagcctgaagaatgcaatcttaatttgcctgtatgggacccaagggttagtgtattattttttcccctaccaattcacactgtgcaataacaagtaaaaatcatctgcataaactccagggagacttccagccttttacttatgaatggtcatgtccgtattacactttcttttagataacctcaactataattgtcctcaactataattgatgtgagaagcataattatgtaccctgtaaaccacatttaattgtacatagtttttaatacagattttactaacattttaatttattctatatagaactaccttgtaagtcaaagttgtgtgggcatttgtgctttaaaaaaaataaaaggatactaaaaatccctgtattttttattttatctaagtattatgctaaagttgggttgttataggaaagctgttacttaatgtttacatgtggcatataacttctaagcattttcactttaattaccatgatgtaattgtaaaaaaaattggtttagatattttagagattataaaaacatggttgggctaaagaagaccttccattctgtttcttgggaagttacaacatttaccgcttactcattttaaatgttaacaacatgcactttataaactgataaaagaaatttaggtttgaataagatttcctaagtttatgaaatcctttttttctaaattattacaatatcaaaaattttaaattctgttgaattacatcaagctatgcattttcaggttttccgaacctcaaggcatttacttttagaggatgtgaatttacaacttactttgtggaaatgtgccacttactgatatacagatttaaaattaacagtatatcatttcattatctcctaacatatcaacatggataatgtagtttcaccgcgtgttaataagcttgaactccttaatagtttcagggtatattaagaacttaagtttctatcttgttgaaaattagcttacaaaacattgtagcatgacatgtctctaaaggtaattgtatgtgcatccccatttctgttgttgaataaagaaaaactaaacatcaatagattcccaagcagaacttttttgttgttgttcagcaggcacactttctagtaaggttgccaaaatccaaattgaagcagatcattagtttagatgaaatctttgattctataaaaaattcctataaaaacaatgtctctctacatggtttttctttctcaactccagctatgaatgaaataaaaaatagaatcattggttcagtttaacaaggggtaaaaagcccaagtatctgttgcatatgtacttgaagaaactgattggctgttgttgtatgtaggtaaaccccagtgataggtaccatcttatgcctataattacaccagcatacccacaacagaactccacgtacaatgtgtccgtttcaacacggatggtcatggttgaggagtttaaacaaggtaagtgtttatccttatgctctgatttatacaggaaggatttacgtaccattgtagacccagtagtcagctgtgcaacttaaattgaagaaggattcactgaagtggattttggtgttcatttatttattacagtatatatttgagaactgacttcaaaaaattaattccttttaggcaatttgttttttataacaagttggaagattaaccaacagttaaaaccagtaagctggtttagttgcatactattgccttgtaaaattataaatgataacagtttgtctacactggttgaaatgagagatgtttagcaggctgtatactcctgggaaagaactttgagcaggaatggggccaaaccacccaattacattccattattttggaggaaccttttaacttttgaaccctagttgtactgttaatttgaaggtatagctactaccaaatagtctttgagagaaataactggaacagattggtttgactgaaaacagtaaaggaaatagaatcagttgtctgactactagctttaaatttagacgtttaaaattcctgaatattttacactttagtttcatctttagtctaaagaggcccatcaagggaagatgcctctatccctttagaaacaacagggaaacttggttttagaaaggcaagaaacaaagtatattggaaagttttccttctcgggtaactggagtgtttaagaaagaaggtcattctatgagcatggcattttagaataattgtactttaccagaaacctggttctcaaaaaatcttccagctttttaaaaaaaaaatgtgtatatatataagagtatgctctaaaatcataagctaaaactatatatgttaaaattctggttttaggattatagtgagtgcatgtagtatgattaagattatttaaaattctagattgtagactgaagtatgcaaacattttaatatgtttttaatttaggtcttgctatcacagatgaaattttgctgagtaaggcagagtggtccaaactttttgaagctccaaacttctttcaaaagtacaagtatgtattttaaggcatgtcggacatgttgctctcttaagtaatggtttaatggtagcacattatgacatttcttcttgctggactaatgttattggaagaattttctttcctgtcacaaggacatactgttttagtgaactccttagttttttttggttgaggtaatgaatgtgaagcccctttgatttttctgcccgatctaactgaactcctgctacatttgtagcaacataagttctgtaggcatacatcagtcatgacaaaaacagtacatctgtatacagtggcaagtggatgcaccctgaaaaatctgtagttaataattctctgctaagaaacagtatttttatctaattctggaaactcattaattgctaggaatctttaaaaca

SEQ ID NO: 77804 - DNA, 1124 bp, Homo sapiens
taaatgttttcaatagttacagcacattattggcctgccattttcccccaatgttatagccccttcaaatatttctacagctagctttcatgaatctaagtgggtgttaatcattttaattaatggtttaaatataatggtttaataccttagtacaggttaaaagcttcattaattgtgttagttttgatgaaaaatgtaagttataatcttatttaaaaaacagacaaaccacagacttgcacttttatttgccctgggctgaaaatgtgccaaagtcccacttaaaattttttttttaatgcttgaagcttttctgaccatttgatcttgtgttggattgtgttttgtaataatctaagcaagattgctttatgctcttccccaattaaaaacaagaatgatgaccttcatgatgtctctgtgttttgtttctgtatcttttgcatgagaaagcaataacggagccagtaattgtgttctcgaagcactacgttgtcagtaaaaattaaaatagcataatcattaaatactcttattttactacgaatccccccataaattgtgatttctgtttgacagataatttttctttgtttttattttaaccagtgtagaggaagtaccttggaacatttaaactaataaacatgtatgtagatacttttaaaactatgatataaaagagacacagttacatgtaaggagaagaataaaggaattggttttacaggaaagtgctagtaccccttaattcctggaatcaatgatgaaactagattcaaactttgttctattcactttcgtataggactgtgacggggcttctttcactttaagaaagattaatgtttacactgaacaaaccttaataatgtcattttatttgaacaaattcacatcattagaactttggtgctttttctaaagcttgcttaatgtttcttttaaaagttttaaactatgcttcagtccttgctggatagtacctgtaagttctttgactggttaaaagatatattactaatcttcactgaagtttttgtgaaataatcaaatttttttaggttgtaaaaaaagcagcaacaaatagaggaaattacatcaggaaaatttgcatttca

SEQ ID NO: 77805 - DNA, 2848 bp, Homo sapiens
tacttaatatttctacctatatgtgaatgtgtgcatttgtgtgtaagatatatacagagtaggtactctttcccttttggatttcagtaagaagttatgttgaactctaggattcaaaactttgaattgccagcaaaaccgtgtccaaatggattgtatgttttccctttataaataaagaacattgtatatcatttaaggttttgttgaagactaaggtggttattaagaatttccattttaataatgtgttgtaagagtgatttagagactgcgggagttttgtccctgcccttagatggacccagacagctttgtgtttttgtgtacatgcctgatttctatacttcattgtctcctgttacaagtcactgtactttcgtgagagagctctttctgcatgttctttacctttttttttttttttaaccagttagccatttttaatgttttagggacctagaaatcaggttactgagcttgttaggattttgtttgatttaagagcatttggaactccgagtatgggtttttctacacataaaatacatgattttttaatgcttttatatgacttttgttgatttatttgggccatctgtgcttgctcatgtatttgacatattccaaataatgctgagcaaattaaactggtaaaggaagtattggtttgtaggagtttggactgcatattcacatatccctatataccttgttttttatatatctatctctgttaccttgagtttatagacttcaagttaactccattgaactttacaatacctctgccagtaaaatgtgtactattatcccattttacagatgatgtacacaagacttagaattgcctaggattacatagctgtgaagaattaaaaccatttttcttttttttgttttgagacggagtctcgctctgttgcccaggctggaatgcagtggtgcgatgatctcggctcactgcaagctccgcctcctgggttcatgccattctcctgcctcagcctcctgaatagctgggactataggtgctcaccaccatgcccggctaattttttgtatttttagtagagacggagtttcactgtgttagccaggatggtctcatctcctgaccttgtgatccgcccgcctcggcctcacagagtgctgggattacaggcgtgagccaccacacccggctgaaaccatgtttcaaatacatttttttaaaataagtttggtagtttttctctgggtctaggtcagatttttgctcttggttagaaactatacttataaaatgtgttagaaagtattaggaaggttttagacttttcaaagagtaaaataattttaaaattgtggttatactgctacttttgaaactagtgtcagtactagatgatgtcagtttgctttttggggtagagattctggtgtgaaatttggcccccagcacttctaaaatgggtactgtagaagagtatattggattgaacttttttagtcgtaggaaactgaatcattgtagttacattttagttgtaaatagtttgttttaaaaagacttcattatttatttgatcatgatgctattttctgaagtgaaaacttggcttttgtctaatatgaatgggattgagttttggataaaaatcagatttctttgttgctgtcatgttagtgattttttttttcttttttgattatagaaatgtatactcttaaaattgggaaaaaaatcacagggcctaactgcagtattcagtttaattttcactactatttcatttgaatttaaaagcatgatgtgtttgatactgtttttgaagttactgttgtagtatgtgtatttagtgataagtttttgtgtctaaagcaatggtgttttgattctattgaaacatttttgttataagtagattatattttagtgaacagctctttaattttataggcagagcactcaatcggtgtcattgagcaaaattattaatgcttatttatgcttcttgaattaagctgctttttggtaattattcataaagtcactgcctttttcagaagaattaaactcactagtagttagaaacatggaatttagcatatatgattttatgtgcatattgagattgtagtcccccttgctaaattgatgtggatctataactgtaaggaagcttattactttatggtttaatatccagcacaaagcgtgtaaataaaataaatagcatgttgtctttatcttcaaaggcattatattgtacttctagcaagtgcaccaacagaaaaacaacgcctggaatggtgagtataagaatagactttacagaaaaagcaaacttcaaaatgaatcacatagccactgaacacagtaggagatgggaggaagtccttaaaacttctagtttggtttgatttgttcacaaatggagctttactgtgtgtagtggaagtacagaaatcaggagatccatatgcaacttatttttttgtttgctttatggagatccgtgcataatttcttaattgtatatttaaagtgcacttatagcttgtttttcttaaaatttttgtgtggataacttttgtaaccttgctggtgtgaatggagtgtttcttggctcttttttccccgttgtttggcaattttgggtagaacataaggcttctggttttatctgtgggagttcagctagttgaaatgccctggtatgtgcattttatttatttatttttaagttaaccaaaactttttgttaatactaagtgacatttgttcagggtgggcttggtggaatcaaaaatccgaatcctggttggaagcttggagaagaatgaatttattacactggctcat

SEQ ID NO: 77806 - DNA, 1202 bp, Homo sapiens
ttacattttgtggtaattctaatcttaattataacaagaccgtttgatgttccattcagtagataaactgttaaatgttcaaaagtagctaaatcactaattactcctgttatgcttctgttcatgtggccttttaaattgaatttttgaagtttaagaaatatctattaagttctagttaaatttctgtatttagaaaaatcctttttttcccagatttttctaaaaagattattctttttccttcattagtttaaagataatttttctttgatttcagtggctttggttctttagaatcatcattaaggacattgactatcaatgcacagttagtaagagtatatttctcctggatctctgtttatgttgtagtaggaatatagaggacaggtgtgggtgaggactttgcgttttcatggagcttgggcttagaacttttagtttgctcatacatttgtattgtaagtttttccatgtctctgattgtcagccacactgatagctacattttcatgaaatccagataaactatggtaatgctcttctttgcagggaagaatttcgcacgatgtgggtgattgggttagtgtttaaaaaaacagaaaactctgaaaacctcagtgttgatctcacctatgatattcagtctttcacagatacaggtatgtctttacttggataatcaaaacacttcagttcttgcatatttcaaattgtcttgatgcataccatagtgatatttacaataattgttgaaattacttgcgaatattgaactatcatcagaataatggttttgtattagtctaatacagattgagtattccttatccacaatgcttgggaccagaagtgtttaggattttttcagattttggaatatttacattacacttaccagttgagcatccctagtctgaaaatatgaaatttgaaatacttcagtgagcatttcctttaagtatcatgttggcactcacaaatttttgcattttgtagcagtttcagtgtcagatttttggattagggatactcaacctgtgtatacacgatttttctctattgtggtgaccttaaagttaagtagaaccattccaaacttgacttgcgcataatttcttgagaaatgggaaacaacttgaatatatggttgtctagactgaatctgtgtctaactgccttcatcatcttgaacctga

SEQ ID NO: 77807 - DNA, 1969 bp, Homo sapiens
atcatatcttgcctccttaaaacctttgagtatttgtctcactcaaaataaaagtccaagtctttactgtggtttgcaagcctctgcctgatctgcctttttcattatgtctgtgaccttacctcctgttataagttcacagtcctttatctgtaagttttggagccagaagggtaataaagttagtaagtaatatacccagtgaggcctggagcagcatttggtactgaaagacagtatcatttctgcagggaaccattggtactcacatggagcaaaaggtaaagaccatatagccatagccacaaatagttcagaacagggtttgttactagatgaattttgtttcctatcttagaaaaacttgtgtgttgagagtttttgggattttggagttgcacataagggattatggatttctacttttcatcttcttcattggcatttttcttgtttctcaaatgttccaggcattttctgctgcttagggcattttgttcttgatgtttgctttctctggaatgctatttcaccaggtactctcagcttacatcctcatgttcatttaaatcttcagtcagatgtcaactcagtttccaggctgagcttcctatcctactccctacgtggtttttctcagtaatacttatcatcatctgacacggactatagtttatgttttatttttttgtgtttattctattctccctactgtaatgtagaccctttgaggctacgttggtctttgttcactgcttatctccagtgtctaggacaatatgaatcaagtataggtgtttcataaatatgttttgtatgaccgacttttttactttttggggccctctggatctaaataatttgaatttatttaattgtagcattttctttttgtacctgtgacctctgttatttaaattattactatattagaaagtatgtcattagttagttttatcttgcagattcttgtaaagatacctttaggtatagtttaataagtttgacttattttacagcatgtgttacatacttgggtaaagttttaaagaatagtactggtagcataaaagggtatgggtgtaagaaacccttttcccctcatttctgccatttcttaaagagttactctttagagttactactttaagagctatttaaagggttactacactggaagaattaatacattttgtgcttttattcagctcatcttgtggtaaaaggagtttgctcaggcaatgaattatgtcagattaggaataggtcttgaccgatctacagatatgcagtattgatggaaaaaggatccctacttagaatagtttctctggagtgagtataactgcctttattaaaatgtttctatttcttgtaacaatttcctaattgtatagtttataggcaagcaataaacagcaagatgtttgaggtggatatgaaaattgctgcaatgcatgtaaaaagaaagcaactccatcaactactacctaatcatgtgcttcagaaaaagaaaaaggtaaatttagaaagtacttacaaaagcattactaacataatgttttatgcatctggactatcattatttcagaatttaggctcagttaataagtcattttaaatagatgacagctttttaaaaatctgtttcatggagcagtttcattatgtgaaatctgactctaatcagttttcttgcacacagttgctttagattttagaaggattagtggtgatgcttcatatccttactttgtatatacccgtattctcttttaggactttttattcttattcacttaaaaatcccacaccagtatttaattttctttcctttaaaaagtaaactaaattaaattagtaaggaaatatgtgggtcaagtaaattatgtgagacttttaaaaaatgaaagtcgctttttttggtgaatgtaaaaaatataacgtatattaaaaactaaaagttgct

SEQ ID NO: 77808 - DNA, 1060 bp, Homo sapiens
ggcaataagttacactttttgaaattaaaaaaattttatatttattgtaggataattagaaatctatatgtaaacaaaatcacttctagtcccactttccagagtcattgtagtcccatgtttattgttgagacatttctttcttgtgtgtgtatatttttagagttctctgatttgagattcttgtgtttttatattatagtgtttttaatttgtgttgtatcttacagtcagtatgtacatttaatacggcatttctttctccctttttctcccacataagaactatatttaatgttgatgccttcttagaagaaagtacttgactcccaaatcgttgccttttagagtcagcatggcacatctaactttcgtagatttagtgatctgtgcttttcagtaaaaatcatatatgttaagtaaaaggtttccatgtttcaacatttggatgaaataaagatatatttgataaaatgttttattgtttgcagcattcaacagaaggtgtcaaattgacagctctcaatgacagcagcctcgacttgtctatggacagtgataacagcatgtctgtgccttcacctactagtgctacgaagaccagtccattgaacagttctggcagctctcaggggtaaggaaaaagagggaaatagaagtggaggggctgtttgctaaatcaatcagatacattctctttttgctattaaagtcatctatttagaatgttattttcattccatctactaatttttttttaaatagcaatttaattcccaggtttggggatagtactttttggttttgtcttgtcatacttaacattttatttttgagactgataatgtcttcagtcagatgtgaatgaatgttagcacataacccctccaaattcatgtatttagatagctactgctacagtgcactgtatggtgtgctgatgagaacagacaaaaggaacaaaaccacctttctgtcccagagctgcttatacctttgtaacagggaatgtgtctatgatagttagggaaacctgttttagaagagctagatatctgtc

SEQ ID NO: 77809 - DNA, 1030 bp, Homo sapiens
aatttttttttttttagcagaaacagtcctgctccagctgtaacagcagcatctgtgaccaacatacaggctactgaagtttctgtgccacaagtaaattccagtgaaagctcagggggtaaggagattgggtttgtcaggtttgagaattcttacattatatttggtttagccttcattttgaaaagtgggtttgttaagtagttgaaattcagttttttaaatgccagtttattttttgcatgtaaagttattcatgaaatcaaattcagagaaacaaaaacttacaacttgatactgatttggttattttaatttgtatatactcatatatttgctgcttaggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggtatatatatgaaaaacatattagttagccatggcaacaccaactgcctatttttaaatccagtggaagaaaagtttatgaaccaaaatagagaaggatcaaggaacaaagcttttagaaaattttaggtgtgtctgtagtgctttagtgctgtagtttctcttcacctttcccattcttctcagtaactacctctgctataaagctatgccctctcatttaaacttctttagtgtgtgtagttagcaggtattgtctacaacagaatttaacatgaaattacatgtattcttaacttattattctctaatgactaccttttatttgtactgattttttgatggtcctttggacagttttttgcttctgtgatccaaaaggagttttggagtttctctactgtacttggtgttataggaccatcaaataccagaggttctcaggga

SEQ ID NO: 77810 - DNA, 3613 bp, Homo sapiens
acatacccacatcacttccttccccattgttttgaagcaaaccccaggcataacaaccaaaaacatttctttgtatatctaaaaataaggacttctataaaatataagtaccgtatatttgtcacacaaatattaataatccatagttttacatatcagtcagtattcagatttggccaattgtgacacattactatttttaaagtttgcatatttgcagggtacaaataaagtccttattggaattgatcgatactgtattaaatctcttctaagctataagcctgtggtttttctatgcctgttttaaaagtcacatttaaaattaaattttaattctgctgagaaaatagtgtcaaaatagttattaagacccaagcaaggcatttctcaagtcttgtattctgtaggatgttagtaggtcgtaccaagagcaaggattctctggttaagcttgggaaaattaaagtggagttctttcttgatagaatttattagaaccttttatgtgccactctgtgtgaatctcccagaatgggggtgatactatgccaagttcctaaagttgtatgatcaggaactcttttttttttttcttttccttacaaaatatatttctatgaactcttagtggttttggaaatgtactttaggtggtgatctgcagtaacagttttcctaatgctctttttaattttattagctactgaagccaaatttaatctgataaaaacattttaaaagagggaccagttatctattttaaggctgtagttgatcttacaggtttaattattttatagttttaaagtttataaagtaaagcattgattggcaaataatctaaatttttcattttagagaataaagcttttttttttaaaaacaggatgaaacaagtgaagatgctaactgtcttgctttgagtggacatgataaaacagaagcaaaggtatactaatttagcctttagaatacatacacaattaagagtacagaagatgtaatagaaatgtctctaaaatattgtatttttgtgctataggttttagatttttttagtattgtttattactgttaattatgtaatgctgaacactgaagggaatattgtgatgagtgaaacacattctgtgcctttaaaggagcttataattaagtagacaagataagtcatgaatgtaattaattacattatcaaagaaaaagtaattgagggctgggggccacggggcaagaaaagtaagatgttatttctgactgcagaaatagcagtacatgtcttcattgaagaaagaagtagcatttgaagtggtcctcaaaggatacataggatttttgatagtccgggctgagatcatgatctgtctctttgggttgagaatttgttatgattatagaagcagtttttggcgtaaggttttggctagaacctggggtacatggggcttgaatgaggtgtagatggggtggaagaaatttttttttccccaaaatgtaaaagactcattttttttccctagaaattgaaatctattgaaggcttttaactttctttccttgtggaaaaattggaaattctcccccttctcccaaattatccagatttctatgatggatattttaacaaaactctcttaggttttgtgtgtgccctcataatgcccttgctttataattttgattcactttgtaaaccaagaaaaaagtatgtgtatcattatgtaatctacaaaattattaatggcttcatagaatgctgtcttaaggctatgattatttttatccaaccaatttcctatccatagcaattatttccatttaaaaaagaaagttgtgctttcctgctgtaatattggttacagctaaataccatatctgccattcattcatgtttatttacttagcataaattaatggaagaagaattattgaggaaaatagtatgctttatcttaaagtttggtatacatcaccaagttgtcctccaggaaggctgcatgtcttccattcctacttcttacatcttatttaccttttttaatttcataggagaaaacaatatttcgttttttttttttttggtatagtttcattgaaattgaagtttttatatttttcttttcttctttgtcctttttttggttttttttgagatggagtcttgctctgtcgcccaggctggagtgcagtgggacaatctcggctcactgcaacctctgcctcctaggttcaagcaattcttctgcctcagcctcccgagtagtggggattacaggcacccgccaccatgcctggctaattttgtatttttagtagagatggggtttcaccatgttggccaggctggtcttgaactcctgatgtcatgatctccccacctcggcctcccaaagtgctaggattacaggtgtgagccaccacgtctggcctatatttttattttcatttatttgtgtagatattattttcttttgtgtactgcttttaaaaagtttagagtgatggcatgacatactttaccctgtgttttctgatgagtagaatcagtgcactgattactagagaggggtgaagagaccataaggagggagaaatcttttttagacatattttctacttttaattaaaggtgtgaggttattttatttagtagtattgaataagtttttttttttttttttcctcccacaaagctaagaactgtccttgggtttatgctctgttattgtctgggcaacatttcatgatgtgcctatgtgtgtttttaattattgtttgcttaaaatgtcccaagttggagctggttggaaagtcatgagctagtttgacccatgccttataagatttaagtaggcaaatagaaatttattaatatctgaaatggtgaaataacctacaacatctactgactagatgtttttgtaatgtagtcacatctttctcttgatccctcctgtcttccagtttgtcttctttattagccaccaaacccagttatgttcttttattcttttttaagtctcttttcccccttccccatcctctttgtctcacaggaacaacttgatacagagacaagtacaactcaatcagaaactattcagacagcggcttctctgttggcctctcaggtactaagtgcaaaaagcaaggagaattttgtaaatgtccttaagattagtgtggtatattgaattaaagtgagagttcatagaagactattaaaattaatctttctgaaagtaattacttgctagcctataaacgtatttattgtagttttaaggcagggccctggatttgacggaaccgttctctgggactgtttcgatgttaacccatccccttatattaatatattatttgatactgcaaatcatttaaattctcactagtcatttacacagggttcatatgtaggttttatttgtaggtcaaaagtgaaattaaaactaggaatgaactaaaaaacattcttcgtggatttcttttgcaaaggctaatatatttttattttaaaaatgtatttctgccttatttttccactactgatttcagttagttatttaatatagcccatagctcttcagaattatgttttcatttgtcc

SEQ ID NO: 77811 - DNA, 4939 bp, Homo sapiens
ataaaactttagggggagtaactaacatcaggaagtatgcttaatattgatacgtggacaaacttgtttatcagtcttaaactgtcctgtgattgtgattgcatgttttttggtttgccacatactctcgggacttattttcatagttttgtcttactgaatttatccctatagtaattagtacccatgggtatttgccttttagatatttttatgagtgagtagaattttctttctaatgaaaggattcatagagccatagagagaaaaatcacccagttatgtaagaagaatgattatgttgatttaaaaaaaaattcattcctatctttggtaatgttaggggcgtacttatttctggggaggtgataatattgtggctatacctaataaagagttcttattgttttgagataaatctggaaatatttatagatgaaatgataagatctctaggatttgcttcagaataacacaaggtgaattgaaagtgggaggacagtggctttgatttgataattgatgaagctgggtaatgaatacatggggatgcattatacagtgctctctactttgtgtatgtttggaattttccataataaaacttttaaagatccatctctgtatttttttagtgttaaagaacgcttgtgatttaatctaattaatatgaaaataatctacctaaaatttaggatgattaaattattgcttagctgtatatatttgtttaatttacagtgtcagaaaataataaatttactgctgcttctgtatataaaatgagctttgagtattctcccacttgggggtgctccaatactagttaatattacagctattagtgttgtaataagtgaatacagtttagcagtaacttaagcattatatgataggtgattcttagaggaacaattttaaaaactatttgaaattacttaggagtttttaaaatattattaaaatatacctatttgaaaattcctttgttgaacacattatttgttgaacaaataatgtgataggcatatttacattccattttgacaacattatagagtttttaaatttgtaatacttttcttcttagaaggtttcttaggaagtaaagcaatggaaaatacatctcattgttaaattatggtgctttgaacaatgttgtgttctttgctttcattctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaaacagcacaatctcacagttgcctgatttcttttgactactacttttttccagtaatcataagtttatagtatgattctaagtgaggatttgcaaaagaatttggttacattagaaaagatttgtttctggttaacttcagccattggcagcagccttgtatttatagctcagataataattaggtgtttgtttttcatataattgatctttagggaggaaaacattaatatagttactattaattcaattttagctcttccgtcctctaaagtgttctgtgtctgtagacaccatacgttatctgtatatttattctatgcctgtggacagtgtactgtccttttcaaagcatttagcactttaatgtcagcaggtggcactgttgtttttcagtgaatttagaattacagaccacaaccaacaggattctatgtttcttattttactaaatgcaaatcagatattgcttttcttaaccccccagatgctcagcattgatacttaactcatggtgcaggagcgagctgctctgtgtattttgtgatggtcagctcttgggtatggttatcttgtgttttgggtggagggatggactctttgtgtcaaagccattattctgagggacatgcagttgttcatatatcatttctaaaattctaatgtaaccttccctatatatgaaaatgggaatgtggctgcattgtgggataactttttagtaaaagcaaaatttaacttctgagactgttcagtaaaagggaaaatattgtaggaattacccttatctcccttgttaacactaaaagaattgaactggctgtacttcctctactttgatagtcatctagatgcagtttgtatatcacagtttctgagttttatcatccacgtggcctcttggcattttcatgcatcttgctgaattagtaaaattataatggaaagttgtgttttgtggctgtgggtatattctagaataaagtttttatttttctaattaacaggtttttttcccaccacacagaaaaatgttttagagctctgcatagtattaattctggctgcattcaaggtggcaataaatgatcagcagctccaagtcgtaatggatatatgaacagataaatcattaatgtatacaaacttgtagattgagtcccagaaatactgttagtgcacttaaattataaaactgtttacctgaagcagcactgagcaatcctttggatatacttttacctgtttttattctaataaaaatgactagtacaaggaaaattagttggtttttagcctgaattgtatgttttgatttgatttttatttctccacattattttgcttgttagcttttcttcaaaccagtatcacaaatggatgctgtcttcactcagacctgactttggtaaatgaaatattatgttctgtaataaatatgaccttcagtcatatagaaaccagtggtctgtttaatatctatttctcatagaatcaattcattcttcttttttcttatcaatttaaaaattcttgttaaattttacatagcttttattagcaccaaataaggaagatggcctcaatgtttttgagccatgtgtttcaga

SEQ ID NO: 77812 - DNA, 1038 bp, Homo sapiens
tgtttgattaatgtctgaagggagcctggtccagtggttggaagaaaaagccctggccttcaggaaggacaaatctgatccttctccagggcctgatgaccctgggtaagctacttaacgccttcccccagtttctgaggaaaatgttaagtttttctttagatctttcttattgaagctttatgtggattagcaagcagatagggcatgtttaagcaatcagactttttttttttcagtactaggttaaacctagtttgaattagtcagagggcagtcacaaaggcagactgcaaaggaacatctggcaaaccacccctgctaattctcaaagctgtcttcctgctatgaaatttgggcaggaccagagtagggagaaaaaagtggagtcaggcaaagccctgtttaaaaaaaaaattagtgtgagtttggggcagactgaccttttcattaaaaaacgttctctcccttagtgccaagacaaatgcagtgcgtagcttctgaggagacagtgagcatgcctgcctgcttctggcaagggttcaagtgcagtgagtgggtctgggaaaaattcctgacagtagctgccttttattgagtatatctactaggtgttaagtggtagggccagttgttacagcaacctataagatttgacatattcattggtgtcaccatttacagatgaggaaacaggtttattttggcagagtatcttgcccagggtcacacagtaaattggatttgagcctggttctgtttgactctaaaacttaatcctgaaatatgaccctgtgttttcccactcaacaacgttgccttagtatctctttggatattatcgttgagaaggcaagggtaattagctctattttgcatatgcctctagttttagaacagctaaaatacattgctgctctttggatgcccttaaaaagctggcctgctggaggtgaggagggggagagatttgcaaagagcgacagtgaacagctgggctctgatgagactggtgtactctatttactagtactggaa

SEQ ID NO: 77813 - DNA, 1130 bp, Homo sapiens
ggaaatacaatttgctattgggaggatgttggttttagggaactgttgaagaacttcattaattattgtgtgtgtgtttttcttttcttcttctttttttttaaactggaattgcccatctgttgagactgaaattcaagagtaaaaaaaagtagggcagcatttattttcaagagttgacaataaaggcacctttctttatgacatgctgagcatgatactttgggggagaatttaatctagaattttgaagcattttcagaaggaagcaagggttctttatatagtcattttatgtaggttacgtttatgttcttcaaaatggcatgtagtgattggaattaaatttctgggtagataagattatgttcatctgttacctatagaagggaatgtaacttaagtagtcacttaataatagctttctctgttgatgctaccacagatggtattctctacatctcaacattgctgatcagattctgtgttaatacagtaacacaacttgaatttaataacaataaacttgtgttaggcgttactgtcaatttagttctggtatccagtacaaataccagttttatagtgcaatgtcttcttgttatgttcagtgctgcaaaaattatgagaggatatttgttaaacaaatgagataatggagtaatgtgttaagcatagagcctggcatatagtaagttagtaagtgcccaggaaatggttatatggaaagcttatgctaagttttattccagtatgcaagtgtgtattttaaaaataacagtaatgcattcaaaatgttgacagaccctaaaattaaatttcttaaaggaaataggccagcttttttttttaactttgagaactaatgtgaaataataataaatatataagtgaaatgtcccagatgtctagaaatgaaaaaacaagattttaattttgacagctatatttttttttcttaaaagcatccctaataagatataatgtactatgattaggattatgatttgaaaaataaaactttaaaaatatttttgatttgaaaaataaaacttatttggaaatgaagcgaagctttaagatttaccttatatcaaatgaaggatgtctcctgaatttatgcaaatgtg

SEQ ID NO: 77814 - DNA, 1031 bp, Homo sapiens
tgcagagggctctgtcctttgaattttttccctttggtgcttgaatgatatttaagcacccagcattctgaagttgctgttttgaagtaatttcatgcactttcccaattactcctgctccatctctcccaatgttgtcttaaatctttgcactcaaattcaagcacatcctactcctcctgttctgagtgacatatgggcaacactttaaaaaagaaaagctctctagaaaatctagagaggtacgagcgatggcccttctcccatattaggagttagatttttagtattcatcaataaatactgatgagaagaaactgctctacttttaccaacattcttcaggaaatttattaagatttttattagccacagtatctttgtcagcttggaaacatatatgtttgtgaatcacatttatttagtctttaggtaagtatatggattttgatgattctttgcagttactcctatctctctatgggtttcttgcccataggatgggaaccagtactctaggatttgaaaattaaggtagatactgttcacactggcaaatatttaagatgaatattaaacgtgtatactaaaatgtttattggtaagtaattcattaaatgggaagatatactagatgaagtaaataattaaattgcaagcacaagcaaattaaatttgagatttgggaatggtctgtcatatacttttaaagcaaatatcatactgataatggaaggacacgtgtcttgtggagctcagtatcaggaacaatatagttggtcctgcaggggactaaacatgagaactgaaagtcattaggaacacgagcagcctcattccactgttccagggaccttataatttctttctgtgtatttattttattttctttttgaggaccgtctgtctggctgtttgtatgtcggcagatatgtctgctctagacttagatacttgctttaagaatccaaaagagattgcattatctaattgtcatttatatctaaaattaaacaaaccatgaagttaga

SEQ ID NO: 77815 - DNA, 1544 bp, Homo sapiens
cattttggccaggctggtctcgaactcctgacttcaggtgatccgcctgcctctgcctcccaaagtgctgggactgcagggagtgagccaccgcatctggccgctgacatattgttataattactcttagtattgttgttaatctcttaactggctccaatttataaattaagcttcatcataagtatgtctatctaatgtatgtataggaaaaaacgtatttatgtagggttcgatactctccatactctccaccatttaaggtatccactgagggctttggaatgtatccctcacagatgaagggggtgctgctgtgtttgagagatacagtttctccacaacctcactaccatttggtattggtgatattttttgtgcgtactggtatcttgtcatggctttaatttgcatcctaatggctgatgatttcatgtgcttatttgccattcatattttttttggtgatttgtctgttcaagtcttttacccgttttgtgattggtttgttttcttactgattttagagcattctttatatgttgtgtatacaaaatcctttgccaaatatatgatttgtaaatatattctctcagtctctggcttgtcttttcattctcttaacagtgtctttagcagcaaaaaagtttcaaattttgttaaagtccaacttctcaatatatggatcgtgtttttagtgcctatcttagaactctctgcctaactctaggtcaggaggttgttctcattttttcttctgttttacccttatatgtcttacatttagatccgtgatcctttttggtttcatttttgcacaggatgtgagctttagatcttggtacatttttcttttccttttgtccatggatgtccagttgttccaaaaccatttgttgaaaagtctaccctttctccattcaataagttttaaaaatcaaaaatcagttggccatatactgtaaattaggtatcaaaacaaagacaggaagaaatgaatgagcaattaactattaataaatacaggtttattgaaggtataacatggctggagtctggaaaaagtgggaaaacattttagagaataacatgggcaaagatctgttctagagaaaataagtaagaactggctatttttgggagtcatgcaagtgaagggaagtagagaagtaaaggaaggatcattggttcgtgaaaaagaaagagtatataaacttctggctagattgaagcatttgtaatcagtttcattggctattaggaaggtgctgtatattcttaatcaggaaaatggtatgatagaaatggtattaaagagaagttgttttaggaccatttgtggcagtgatacgttggtaggaagaacaggatataatcatgacccttgacttacaactttgttttacaaatatctgccagaaagctaaaaaagtggtgttacttcagaatgttataaattcctagtattttctagaaggcagtggtagatttcaaacttttgctgctgtcctcagtgatggatatggagaagtcagcaggacttc

SEQ ID NO: 77816 - DNA, 1032 bp, Homo sapiens
atgttgagattgaccaagaatatttcacttgtgatttgcagcccttcagtattatcacagagaatttttctttttttttttttttttctgcagaagagcaagctcttatagtgctatgcaagctgcccatttaaaactatcattgcttggcacctatgccctagtgacagtttgaccaacatgtgagcaggcatactgccatcctgacagatgggcgtgagtataggcagccaagaaaccatgtatctgcatctagtgtatttgttaagggcaggattcccagtcggggatgttcaaacgtctgtccattctgagctttcacgcctatggataaaaggatgtcatcattaatcccatcctccatgggtatataagagcttcttggctcttacagaagtaggcaattggggacaatcaggataattgttctcttcttcatcacaggactacttcaaataatcctttcctctttctcctagccagctaggtttacagtgagtacaaacctgttcagacattgtcctgatacttgtggaatatgtgcttgttcatttcttttccagagtgtgaaagctttgaaagtcatttgatgtttatgctttggacagtgacatataaaattgggtcaggtagatctagttcaaatattgactgctgtgtgacattagagcaattcaatttagcatcaaatcaaggtaaaataatacctatcttagagttgttgaattaactgcaaactgtatacatgagtcatttggtgtaatgtctggcccacagtaagtgttcaataaatgtttgtcatcatcatcattttcactttgatatacctgaaggtatttttctctggagaggtatctgaaacaaaacttttttcaattcactctcacttcccatcattcccctccctccctccctcccttccttccctccttcccttcctctcgctctgtcaaccaggctggagtgcagtggtgcgatcatagctcactgccaccttgatttcctgggagcaaatgatcctcctcctgagta

SEQ ID NO: 77817 - DNA, 1184 bp, Homo sapiens
ttagctattccttacatggcatggtttcatgtcagtttaccacattggtggctttcctctttttaaaaaaatttcattttaaactgtagtgctttgaattgaattctgtgctccagacatggcttgatacgtgagaaatagagttgtatctcttgttctagatataacacttttcttctgtgagttaagggaagaatatcaccttccttcttctacataattttattaatattagctatatccttttgtgaccacatcatacattgaacataaagttgaataaaatccctgcatctatctaagctatgtcttttcatcctgtttgtatgcattagttttggggtccaaccatgggagcttatgtttgtcttgttaaatttctttttattgaatttaactaactgcaacttttaaagatattttggaatcctagttcttggtttaattggcagtttctagcctaaaagaacatgtatgtgatgatgctatgcactgagattggaaatacaagagaaagaagtcactctctctgtctctctctttctctgtctctctctctgtctctccctccctctctctctgtctctctccctctctccctctctccctctctctctccctctgtgtgtgtgtgtgtgtgtgtgtgtgtgtgtgtgtgtgcatgtgattgaaaagagattgagtatggaagcctgggtaataccaatattaagaggcagctgggcagaaaggaagtaagaaaggagaccaagaagtggtggtcaaaaagttgggatgaaaataataggagtatcttgtaatgctggagtgactctgtgttaagtactgtggtagatacttgaataaaaaatgaataggacatggtccctgctttctgcccctgtttttgtttaattgttcagtttatggaactgcctagtcagtcattcctgaagacttggaagtcatcctttatttctccctcatacccttgcctctttgggttaccaagctccattgattaaaaaaatttttttgaagtgtaacaaaaaggtgcagaagcatcaagctcaattatttttaaagttttacaaagtgaacaccctgtaatcactactacccagatcaagatactcattttctagccctcagaagcccagattatgtggggatatcttgcagacagtagttactcccacccaagg

SEQ ID NO: 77818 - DNA, 1034 bp, Homo sapiens
ttaaatactaagaaaatttgcctttagtcatatgttttgcaggtatttttaatttgttttttgaatttgtttatggcttttttttaatctgtggagaatttctatttttattttgttaaatttatcagttttctttatggcttgcgtgttttgtgtgtttagaaaaatcttcttgtctctgagattctgaaaagttctttcatgttttcatgaatttttttaatgaccacagtacacttctgttatactttatttagtcaccttaatttcctcttagagtatttggaaatattctcccatagagccctgccccaagactatatagggaaaaatgttgttcagtagctgttctatcagatctattgatagattattatatagtgaacatccagagaattaattgtaaaagtttgctcactaattttgctccctaaatagaatgaatgagaaatctatttaccagattttgaaaatatgctaagtgttatgtaaaagtattagctatatagttcacagtttctaattttagaaaagtttcagtgtttgctttatataaagaagcattcctttgagctcttctcatgggccataaggtcaaggagccaggtgtcaccgctttttgaagttgacatcttttggcttgctcctttcctaggtctgactctcttggataggcacaacagtgattctgttttctggtctctgtaggaatggatgttactgtagtgtcttcatcactttcgtttctgggagacctgttgagacccaggaatggatccttctacctactatctcaaaagtcagaaacggaaatacagttaaggcttcagggaatgcttcccttgtaggggaaagtgatagcagtgaggtgtcttgggcttgtgtttgcaaatgtaccacactgtgcattctcagttgaaaactaactctgcagttagtgtttctcttttagaacttttagaagttttttaaggaataaaagttgagaaagtacatttgatactatattttaagcattttactcactataccaa

SEQ ID NO: 77819 - DNA, 2791 bp, Homo sapiens
ccaccaccacgcctggcttattttttgtatttttagtagagacgggatttcaccatgttagccaggatggtctcgatctcctgacctcgtgatccacccgcctcggcctcccaaagtgctgagattacaggtgtgagccaccgcacccggccaaaaacattaattttttaaaatggcagagccataagcatttttaatagctgatgggaaggatctagttgagggagacattgaatatattagagaaggattaattaatagtgtaagtcttgagaaggttggaggggatgggatccaaagcaaaggtgaaggacttgatgtttgataggaggaggatagtttctttcaatgtgataggagagaaggaagctaggattggcttgaagtgggtgcaggtggtttgtaggtgtggctcttagaaagatagggaattcccatctgaagtttctgttttctctctaaactagagtaggtcatctgttgataattatggcttaggaaggggaattagagttttgaggaagaataaatagagtttgacatagtcattgtagagggtggttgctggacttttgaggaatgacattgtcctttgcagttgggtgatgtatattaaacataaagttagatatctggtagttggggaaaaatactaaacttttttgctgtttaattttatggatttagtgaattcctgctaactacaatgtattgtgactaagacatttctcatatacgaggagcttataagcttatagggaaagttatttgtcacatgcaataagaggtacaaacagtactgaaacttcaggtcatatctgacttcagaagagataggtctttaggtatggggaaaatgtcaatcaatgtataaggagaggttaaatgagagaaaaggctttgtgctgggaagaatggagataaaaatatgttggttccatgttaatagaatggtggagtccagtttgtccagaattatccttgaatcagagtgtctctatacagtgtaaaacatatcagagaagtttatgactttaaagaaaatttcataaaaatacatgaccccctaaaggagtttacatgcagaactattttggggaaaatttatgagtagtcattcagtatataacgagctttattcagcattgtaattttccagtttgtgtatgatgaattcatagagctcattaagtgtaagtgtcattgttgtgattcattcaagcctttttcctctcttcagcagaaggttaaaaaaaaattccaaatttgaatccaggacttgaagaatgccagttgtctaaatacagtaccatattgtgataaatatagctattgaaatttttaaaaatctattcacaaaactttattttaatattcatagcagaactttttttggaatgttatctgaaaaacagaggaccattttatcatcagagctgactattaattagggtattgttgcagatataaaagttgatctgccactgaaattctatttgaatatgtatagttccaagcttgctttgtgtatttaataactttagtaccataattactctgtttacaattaaattttggtgaatatgctaatatggaatataccaatgagtgatttcagcaaagggcagtattgatttgcatcttgatgtgcttttcagttgcatctgcatttcatttaatatcagaggaaaagaagtggtcagattatgtaatgctaaacttttttttctttgaaacctctctgttgcattggctactataaaagtagacttgcatagagtcagaggggctgaaattatgtggaaagatttaattttgttaaagtttgtgcctttcggtatattcattaatagaaaccttaatgcaagcatcggtttcattattagaagaaacctataatgtactaaagtgattgtttaattctaattagtattttaagttcttcagaaaactcactaacttactgaagcaaatacttgtgattattttatttctttgagcagggacttctggttttaaataattcctcttttaagaaattgcctgaaaagcaacaaggagattgagaaacagtgatttcatattctgagaaactgagaagcttctgtagccctgaactagaaaataaggagctgccaaattcagtgaaggtcaaacagggtatgggaggatgctgaaagggaacctgagacacagatgtcaggaaagctggcagaactgtgttctctaaagaaaggggcacaccctgagaggcacattaataagcctttgtctgggagaacaggaataggtgttggcaggcaggggcactagggaactttatggtgtgatgaaaatgttctgtctggtggtcgcacaagtgtatgtacgtttgtaaaattttgtcagtttactttgtgcaagttagtaatttattgcctctcaactccaaattcacccctttttgctctatttatatactcgagccagaccttttaaatattttttcttttcctggacagtgttagattttgtcagtagaaggtgaggaagggatactgcaagacttagcagagaaagtgcttctcttgttgccatgtgcttgtttttttgttcgtttgtttgtttttcttaatctcttaaggtgtggctgtcagctctacttactctcctgtaagcttcattagcaccctggtaggcagcttcttgctcccaccagtatctcgtgggcagcagattcctgtggataagctgtagctcactggccctacagagaactaccctaccgctcagtgggtcactgccacagtct

SEQ ID NO: 77820 - DNA, 1051 bp, Homo sapiens
tcagaggcaccatactttcttctgcttccttctttacagttgctgataccacacagatcttactgctgtttgtcatggtctgtcttcacctgctcaaattttgtagagataaagggatactgtccctccgtttggttggagaggttgtccataggtgttgagttttgctatccagttgtcctgtccagttttatgggggaattcagggagatgaaacagctgtgctgctgcctccaccatgtccagcgttaaccttcaggagctgtgatttagaagcatattgaagatactgacagcgatgacgctgttctgtgggactatttttaggaaagaaagtcattccaagccttaattaattattacaattagtttcaattagttggccacagaaataaaactaaaaataaaagcaaacagctttatttggaggaaaatcactttttattgaccacaatttacattgaatagatgctgagccagaatatttcatttaaaatatatttttgtcacttctggaaaggaatttcagaaaaacacaaaagattgtccagtcactattttgagatatataaagataaaaaacatgttgtccactcattttaaactattttgattactataaggaaccagtcaaataagagattactctgatgatttgataaagtgggttgaaattcagaagggcatctgttttaatatttggaagtactatgtgttttagttgtttcttttatttggtttactaccataggtgtaaaagtaacctttcttggtgttttgagtctaggctagcttggttggcacagaaattccattttgcaagattttaccatgagtaaaaacacattaattaagagaactaattgacatgaagaaataagagacacttttatttattttgaagatgtttttgttaacttagagaagatttagacagcgaagatgcattagtattctataggaaaaaattcaatttaaaaagtccccagtaaattaataaggaacattttcagataaggagtttgtgtatttggagtgatagtgggtgagt

SEQ ID NO: 77821 - DNA, 1004 bp, Homo sapiens
agctggtgtcatacctgcaatccaggtcttttgattccagtcagtactcttttcacaataaaacactgctttctctgaatgttatgttaaacttatgtgtcagtgagaaaaatgaatcaagattcatctcctaaaggatagctaatgggaaagaaagcttaggaattctgggtgtcaccagccttgcccagatgattaagccacagtttttcctgtcactcttgaaagttgtgctccttcctcacagtgacttccataattgtggagcatgttggtgaggtcttggagccaggtggtcaccggtgcaattttctgttgttccaccacttaccagcttgctgagccttagtttcctcgaaatggaggtgataatgtaatcttcacagagtcatgaggatggatgggaacctgtgtaaagcatttactagcatgtcccgggaacctttgccccttccccttgtgctcagttgccttatgttttcaatctctgcactgtgttctatcatatcggtattgaccttaataaactcttcattttgttcctataaaatgtgcattctaattggatgcacctttccctctcagcttcatagagcaattctttgttgttattaaatagcatttttagttgtagttgatcattatgccattggacttaaacctaattatttccttgaaaatagttgcatatatgattttattgtttcttctccaaagttaagagataatcaaataggatttgagccattataagtcagaattaacaggtatcctttaagttttggagtaagtaggaatttgaacagcatctccgtacggaagttttccttagggaaaaatgttttaaacacttctaagattagaattctgaccatttctttgttttatgttatagtgaaaatgcctcgtgtaaaagcagctcaagctggaagacagagctctgcaaagagacatcttgcagaacaatttgcagttggagagataataactgacatggcaaaaaa

SEQ ID NO: 77822 - DNA, 2186 bp, Homo sapiens
agataatacgatcatcctgtttaaacctctctgatgactctccagtgtccttcaaataaggtgccagacttttaaagagtggcatacaagtcccttcttatacaacgtttatcttcatcccttttgtctcctcaaagtctgtgcttcagccgtcttgctgccctttggctcttgatctttgtatatgatgctttaaaaatttttttaatatattttattttacattgtttttgtaccaagcctttgaaaaatttttagtagctttactgaggtataatccatatacttagactattggtatagcctcttaactgatctgcctgcttctgccccttgcccctatactccattctccacaaagcagcccaaagaagtctttattaccatagtctgattttgctaaccctcttccaatggctccccatcttattcatagtgacagccaaaacctttatgttacctgttaagcccatcgtgtttgttccctgctgctttctgatctgtctctcctcttctgcctcactgtttcccccagctacttttgcctccttgttttccaaacatgtcaagcacactcctacatcagggtcttttttttttttttttttttttgagatggagtctcgctctgttgcccagattggagtgcagtggcatgatcttggctcactgctacttctgcctttcaggttcaagtgattctcccacctcagcctcccgaagtagctgggactaacaggtgcgtgccaccaccatgcccggctaatttttgtattttaagtaaagacggggtttcaccttgttggccaggctggtctcggaactcctgacctcaggtgatccacctgcgttgacctcccaaagtgctgggattacaagtgtgagccattgtgctcagtccagatcagggtcttggtgctgttctccctggagtgctcttcactaagatacatacatggcttattcccttcctgctctcactgctcaagtaacaccttgtcagtaaggtttagatccctcttaccatgtagccactctgcttacctttctttcctgcttaatttgtcctctatagcacttcacactgtcaaatgtacttcatattttatttctggtctgcatcttaccactgaaatggtggctttgtaagagtaaggattttttcctgttcattgctaaatctctatttcctagaaactgacgtttagtatgtacttggtaaatatctgtttaatgaatatgggcaaccttatatttctaactcagtattctggggcaactgtacttctttatttacatgaaataaaatgatagccacattaaaattattctgatggcagttgaaagttctagtgccaacatcctgaactattggttcaggtgagtttttcctaaactagtgctttttagaactttagccccctcatttcttactcttcagatgctcctctcctcttaaaagaatttcatagtttattaaatttaagaaatgtattacttatcctctggggaattcacaatatccactagcatatcaaaggctattagtacttttgaattaaagaaatctttaacttatttaactcagtttcccatatgtaattgataatcatatagaagaaaccagaaattgtaagatgcattctcaattcagatatgttaaaacatgaataaaagtcttaaaatttatgaaatgtactgtaatgatatcctgaaacacatacttgggaactgaagtgtattctatcaagggttacagatatacaaacctaaatattaatatatttataatattacttgttctgatatcaaatattttacttttttaaacagctgatatgaattcttcagagtcagttggcagtgatgcaccttgtgttgtaaaagtggtaagaaatattttagctaatttgtttcttttctgttgatttggtgtagtattttgtaaaatgccttttttgattaactagaattaattaaaccataagatactacatttttaataacttaaaaaatatttaataagacacaaaagtagctttatagttttaaatcacttgagtgtgaaaagttcctctcttgaaataaagtggcactggtattcgggggtaaatgaaggaaagcataaaggcatgcagatgtggaataaaaatattcagctcatttaagaaatttcagctactttt

SEQ ID NO: 77823 - DNA, 2675 bp, Homo sapiens
aacgttttaatggttcatccatattgttggtgtatcaatcatttgtttcattttattgctctcttgatagacattgaggttgtttccagtttttggtattatgaataaagcgtctataaacattcttgtacaagtgtttttatggagacaggtttttatttttcttggataaatactttgagttgctggtttatagggaagatgtctatttaaacttataagaaagtactaggcagatttccaaaatggttgtgcccttgtacacattggccaataatatatgacagttctgtttgtgtcctcttcaacatttggcattgtcagttgtgtgtatttgttttttagccattacagttagtatgtagatgtgacttatagtttcagtttgcacgtgcttgttgcctaatgattttgggcagttttttgttgtgcttattggccattcatgtattttcctttgtggagtgcctcttccattctttttgcccctttcctcttatttttatcttttaaaaataactgggttgttttgctttttataattgaatagtaagagagtttttttctggatgcaagtcctttttcagatacgtgttttaaacattttctactagtttatagtttgcctattcattttttgaatgctttttctacatctgagatgaatcacagggtttttctcctttcctctgtcaatgtggcaattacattgattgatatttgagtgttgaccgaactttgtattcttaacatacaccccacttagtcatggtgtattatagtttttacataatgctagaattgatttgtgaatactttgttaaagattcttgtgtcgttgttcgtgaaggatattggtctttcgtttttttccccactgtttctcaatttaaaatttccaatctcattgttgattttggtagcagagttctgtacctggcactctgtttggtcttcccccttttgccctgcaggcttaagtctcctccattttactcctaggatctctaggggaaaaaagccagggctgccatggactcactttgttttctgtctcttaggggtcacagtcctgtcctgtccattgtctaatttctgaaaatagaaattttctgtttttaagtctgtttttatctttgtttgcagtgggagggctaactgggtcccagctattccctcgtgcagggaagcggaagcaaagcgatgcctttcaagttgtgtcaaagtgctttatttctcctgcttcttttcatgatggcctttcattgtggatttttcttcttcttcatttatggaatagcattctttttggaatattcagcctgttgctgaatcagaggaactaaagttcttagtattaaattgggtcatttgtatttaattgcagaatattgtgtgcatttgtttttgataatacaaattaaaatattaaaatctatgggtaagatgagtttcttcttaggctcattaggagttctgttgtgagaagaaagcaagtctccttctgacgtctcataacgttgaggttcaaatgatatggttacctctgaccccttgcagttagttggcatagctgtttctgtgtcttggaaggaaagtgtgccagtgtcatatcttaaaggtggaacagtgtataatcatgtcttttttgttctgtataacttgaactttttttttttttttgagacagtgtctcatcctgttgcctgggctggagtgcattggtgcaattatagctcattgcagccttgatctcctgggttcaagtgatcctctcacctcagcctctctagcagctgggactaaaggcacgcaccaccatgcccggctaatttttttgattttttggtagagatgaggtcttgctttgttgcccaggctggtgtcaaactcttaagctcaagtgatccttccctctcagcctcctaaagtgatggggttacaggcatgagccatggcacatggcctctgaacttaagttgtattttctcttagaatgatgtgcttccttattgtaattagaaatatttctgttgttcttctttattgtgagtaattagaagtatttctgttgttagtcaatgtaactttacttttactgcctttttaacttatatagttaagaaaaaacatggccaggaacagtattttctatatgcttaaggtaatgaattatatttttaagtttaagaccaagtacctagttcaggactgtgtatctcctgtctcctaatttagttctgtttccattatcctttattacttcttctctttgtaattaggacagtgatactcagttgatttctcttttgcatttaatattttagtaactttttggatgttacagttatcctagaagaatgtcataaacaaaacaatactactgaccaggcgcggtggctcacgatcataatcccaacacttcgagaggctgaggtgggtggatcacatgaggtcaggagttcaagaccagcctggccaacatggtgaaacccctagccaggtgtggtggtgcctgcctgtaatcccagctactcaggaggctgaggcaggagaatcacttgaaactgggaggcagaggttgcagtgagctgagatggcaccattgcactgcagcttgggctacagagtgagactctatctcaaaaaaaaaaaaaataccaaaaataaaacaa

SEQ ID NO: 77824 - DNA, 1158 bp, Homo sapiens
tgagaagtgacctgaatttttaattcatatatcataattttttggtaggaaggagaaattttgtacagcttcatttttaaatggcagccagttgcttttagctggtgccattgaaatatatcacattttaattttttttctgttgtcatcttcattttgacacttagaagtcttaaagaaacgtttagtgatattctagttaaaatgtcagtcccaatttcttttctaaatcttggctattatagagttggcaaagtattttagatttgaaatatgttaataaaattttagttatgagttaaggtattttcttcaacaggaatagctagctttggctagagtgcaatgccaaggaagtagctcctttattttgtgataatggaagtttattggattagaagaagtatgaaatgagctcagagagccttccttgtagtgggctttcattataatagcctgatttatatggttgattctcattattataggtttaataaattattgcctgaaggaaaacttgaaagttaaagttgatatgacataggttgaaactgaataaatcagaattttatactgatttgtcttaggaaaacctctttcaaacctgaattatataaatgagctattccaaaggtaagctttggagaggaactttaccagaatttctccttttgaatttctttttcttaacgctgattctgtgattcctaccaaagacctattcttagccattggctggaaacactgcaagtgtctcttgcaaatgcttgcaagtgtcaagctattattgctgctaggaaaggagccataggttatagaggaacttgggtactgagtccataagttaaggaatcagcactcatactttcagtatgttggttagttcctccttcttaaggagttgttgcatgccaagccatgatactactgtcttccaaggttaaggtgaaaagtatacttacctgtaacaaataaggcacgcttgttttcaggttgtgatccaagtgttaatgtgtgttgcccatttactgttaaatgctcattaataactgcctgagtctgcagattggctaatccgttttcctctaagtactttatttttatttttgagacagaatcttgctttgttgcccagggtggagtgcagtggcacgatct

SEQ ID NO: 77825 - DNA, 1653 bp, Homo sapiens
gccttcttctaagtactttaattggggattcctattttctgaattataagaaatctgagataattagagcagagagtatggagtggttttctacagttgagggtatcttgagtgaagaaaaggtgaacatattttaagtgcttgcaaaagtcatctctagcaacccaaaactataagttgtcactcatttaaggtagtaggcctcattactcacttcccccaatgctctatttaactttgaactccagttaaccaagatattctgcccaaaataatttttttctcatacctcctaaaaagaaaagcaaccctaaaattagtttagaaatgttagcttcctcatttgaagttttcactgctttaaaaactttttttaattcccaataaataatgaccaacacaaaataccagacattaaataaatactaattttaatcagatgaaatttactatttaaaaagtccacagaattataagatcttttccactcttacatatttatttaacaaggcaaaactgctgacaggctgttatttcttgtttgtgcaaatacgtttttgtgaatgtatgtctctttagtaataattttaattgttaatatctctaaaaacataaaatgaatgtagtccataacattggtagaaaacaattgttaatgagccccatgtttggtttgacaaatgtaggaatctgtgtcagaaaggaaggatgcaggttagtggacagtgcatgcttgttcaggagatgcataatatgggctcttctttgtggtaaggtctgtttttgccagtcctgataaagtagatataagtgtaatgaaaacaggaaaggaatgggattttggcattaattggttaaattaggtattgaaattttattaaatctgagaaatatcttatagccccttggtgatacagttaagatgattgctcatctttgcttaagggaaagcttaataaagatgaaaattagtttaaacatttttcttaaacttctgcaggctgagctatatatctgattttgtataatttatcacttatagaaatggaacttgagcaatataagaaatatagactaatatttctctgaacatttctaaggagtttgacttaatcttaacacagttataaacttaagtatcaaaattacattggacagaaaaatagatttgttggtcttttttgaaggttcattgaaaatatctcagtaattttaactactgctagtactaattaactcttatattttaaggaacccagtgacaatggacctctttttactgaattaaagttctaccaacgagctgcaaaaccagagcaaagtaagaaatacagtacacatacgtttacacttttaaaatgaccagttttttgttttaagccaagacctagagcattgtatcttattttatgactctttgttatttttttgctttataaattccacttacatgggatttgtgtgaaagaattctggtcttttaatgggtttgttgcatcaagattttatctatatagatacatagaatgaagttaataataaatgacctatgatttaggaaatattgttaaacattgagaattattgatgaaatagaacaggatatcaaggtagagagccagaacctctcctagtcactttggtcccttctgt

SEQ ID NO: 77826 - DNA, 1753 bp, Homo sapiens
attacatattataagtaatctagagatgagataaagtatataagaggatgtgtggaggttatatgcagatattacaccattttatatgagggacttgagcatctggattttggtgtcttgaggggtgggggttcctggaaccaagcccctagaacaaaggaatgactgcactgtagttttgatttaaaaaaaatgctttttgtagatttttcattttaaagacaattttaagggcaggataacaattttgtaggttaataaaaatgttttcatcgtaaaatgcttttcgttattcgttatactgtattcttcattttcttttttatgaatacaggtgaattcttattgcatgtataaatacattttgctcttaatgattttttaaaaaattatcatttatgtataacaattgaaatcacaaagatctgttttaatttgtagttcagaaatggattcgtacccgtaagctgaagtacctgggtgttcctaagtattgggggtctggtctacatgacaaaaatggaaaaaggtaaaaatatgtgtgatttgtctttctccttcccttttgcaacattcactatttagttggtttagtcagtaattatttactgatcacttacaatattactaggcctccctctggagtatgtggagtgtatgtgacagagaggaataagatgttatctctgtcctctgctttccatagcagcaggctatgatgccttattagaataggagtgcctctctagtcagggagcttctgcagagcagtatcaactgactggaacccaactgacaaggaggaacaaagccaaacaccctgcctttttttcctccttgcctttagaaataaacaaacaaaaacgcctctgttcttcatgcaaaagggaaccccttcaggattccatttggtatttctgcccacacagaaatgttggatacataatctgcccacacaagattaggctcaccctttatgagggttttagtctagctggtgagtgaaaacaaaaatgtttgaaacaattagagaacaattaagtgctaagttgtataatactgacttacgtgtcttaggagttcagagaatggagagaatgaattctttgggatagtttatttggagaaaacttctaatactttggttcataagcagcacttgatacatatttgaatgaatgaatggaacttcatggagtaaggctttggtagctgagacttgacgggtagatttagtttggaactggggatatattgcttaggatgatttcagctgcaagtaaaggaaaactttgactcaggcagtcatcaagggcccaggttccttatcttgcacctttgccctcctcttcttggttttgttctctgttagttctccattgtgtggtcgccaggtggctgctccatttctaggcttcacatgcaggcacagtacccaagggcagaaaatggtatctatcgtgtgttgtgagtttcactttcctggcaaagaaagctttcccaggagccctgtggcagactttctctcacgttttcttggtcagaattttatcaatacttaaaccattgactggcaaggacaaagtgatcacagcgatccatgtggaaaaggatggaatgccggaaccaaattggtgctccgttagaaaagattgagaggaggggtaagtagttgggtaggcagccagtgttgtttacttgggatccatgcctctcttagggagtgtggggatccctgaagtcacttttaaca

SEQ ID NO: 77827 - DNA, 1022 bp, Homo sapiens
tatgttataatcattacacacatcacctatttagtaaaagccaacatgtatatgtgccctggtctcatctctcaaccttgcaaaatctgttacacaaaggaaaccaggaagtcaaagttaccattttcactttattatcttacaagccaaggtgctaggaaatcttacatgaatgaatatattttgtcacaaatttttttttttttttaattgaggtggagtttgctcttgtcgtgcagctggagtgcagtggctcaatcttggctcactgcaatctccgcctcccaggttcaagcaattctcctgccttagcctcccgagttgctggaattacaggttcctgccaccgtgcccggctaatttttgtgtttttagtagagacggggtttcaccatgttggccaggctggtctcgaactgctgacctcaggtgatccaccagccttggcctcccaaagtgctgagattactggcgtgaactaccaggcccggccaccactgactaattttataaccttggacaaatcactttacctccaaagaccttagttattttatttattaaaagatgtttagacaagatgattttctaattttcttccagttcaaaaatgaatagaattctgagttacttgttcaacatcttgtcttttaatgttagtcaactcttccttccctattgaacttgtcatattgttatcatagaagcctataacatataaatgggatttttgtatcctactgacatttatttcagttaatatgtagtacaggggttaaaagcatgattttgccacatactagaggacaaattatcagttttcttctgctgtaaaatgggtatgataggagttacctactttatagagtgatgtgaggtttaaatgcattaataacgttttaagtacttacagtagtgctgtgtgcataccaggtgttcagtaaatgctagatgttatggtgttgatgattcataatcttcctcattggagatgtcctgatacattctgagtgtggttttga

SEQ ID NO: 77828 - DNA, 3765 bp, Homo sapiens
ttgaatctggcttttgttaaagcatctcacgagaatcttgattttagcagaatgttgttactgctgaaatataccttaaaaataaggagaaacagtcacaggaaggaagctgatatccagaaacatgaattaattttaactatgagaaaaatcaatgctgtcatttttattcagcttgttttatttttaccgtgaataaacttgttgggttctctctgtgagcattatcttaaattgaatagtctcttgaaactagctgcgaccaggaagaggccctccaggtaaaaagcaggacctgaaagcactctgaactctttgagatttctagttgggagaaattgtttcaaatgtttgtatttcttttttaaagaatacttctttactaaacattgtcttgaaaaaattactttgagagtactcattacaaagttggttttcttgcattgtattttgttcattggcttttcatatttgtcttcagttacaggtttatgataatggatcgctttgggagtgaccttcagaaaatatatgaagcaaatgccaaaaggttttctcggaaaactgtcttgcagctaagcttaagaattgtatgtgagctatgttcttcttgtttttaaaaaattgttttgagtacagtaaaggctagtttatgttgaagcttggtcctctgctggctggtgttaggtactgcattaacttattctgtatgatactttcatagctggatattctggaatatattcacgagcatgagtatgtgcatggagatatcaaggcctcaaatcttcttctgaactacaagaatcctgaccaggtagttttataactttaatttctactatttaaagcgtgttgtttgaaaataaatatggttgctttgaacttttgaacctgtgtagaagttttactttttgaagtagatatggtaataatatttcttcttgacactttgatctagttaacattctacatttttgatgtgatttgttggcactttatcaagttggctattttgccctaaataatattcagaagaagtgcttgtgatacaaaatgaatttcaaatagctatttgggggtggaagcttaaaattatatagtacaccaatgaattatgtttgcctgtctgctttgtcactttttttattcctttgttcaagaaatccatcaaatgtaagtgttctattacttggaaaatttggtctttaacatgttgattattcaaatcaattggtttacagaaatatcttagctgtctaaatttgtatacccttagtgtttggaattcaaatgtgcattttttttttagcttattacattccctttgtaatttttactttctaaggaaaggagaaaagctaatgttattatacctttatttaggtcagtttagttgaagtagagggatctatacaattttcctgtataactgtttctgtgatttcggtgaaagtaaggtttagttgacattcatacttaatgtatgttctcacttcttacttgatcttacataaaaaggaagatttaaacattttaaatgtgtttgggtactttgattattgtaattatttgtcagtactctgtacttcattctttctctcaaatgtacctttaactacctttgcttagtttttcctttttcctttggctctcttttctttttctgtcgtctcgtatttgcttcccttcctccaatgtcagttatggtggatagaagggaatctatataagtataaaagaagaaagttactatactattaagatagtgtgctaatggagaaatcttaaaaaggcaatcatcaaattcatctctgctctttctagccatttctttttagatatttctaggctaagaacaaagaaaacgcagctaacaacctgaacaataagggttccattaattgaaatagtctggacttgtacagtataataaaatacaacttatatcactttgtaggtgactaaaacatgctgcctttgtttatatggaaatatttttgcagctctgttatccttcagacatatgctttggatgggattatttttccagtgttagatgtatgtgctagatctagccacatatttttacttcagtttcctcttgtgcccagatgcatgcatttgtgacatttactcagaattagagatgtaatgtgtggctatggaatggaagaaagccaagtttattagctttgtatgctaatcagacccacatgtatatgcccacgaataagtatgtatataatattaaaatttacttttaatcatgaagacttggctttagaatatagtatttagatatagataaaagcctgatctaacagttctttagatcattattatgatgtatgaaatgtttttataaagtaaattgaaatttgattattttacaagtgaagaaacagaggaatagaaggtaactaacatatcatgtgtcagcatcattagcagtcttctactgggtgtgcttttctgtgtggaaagtagcagttgtattgcaacaagtattgacggtttgctctgtgctcaattttagagtctgtaagataaagtataaaatgtataattttcgttcaaattgagacaagattaattacaagtataacatatacttatcttaaaaaagtatataaagtcaagtgattacactgtagctatgtggtcatttaacatttttattaaaaataaaaagcctttcagaattaagtatttgctgttgtttgcattttggatctaaattgtttggagtgttatggaatgaccttgtaggtgaacccaccttcagatgccagtattttgtttctgtgctttaaagggttatatgtgcagtgattttgactttagtttgtcttggtgcttggaaatttataggtgtacttggtagattatggccttgcttatcggtactgcccagaaggagttcataaagaatacaaagaagaccccaaaagatgtcacgatggcactattgaattcacgagcatcgatgcacacaatggcgtgggtatgtcagtagtactggagtgagaaatagactgctaatgttttcacccagattcctacatagttcttaattatgcataagtaaatgaatagataaataaaaattgaaaaggcacagtggcatgaggaaagaaggcagaggtgagactcctacaattgtattccaggaccatctgtgttcttctgtcctgccttttcctcgcagccttcaaagataaccaagaaggtggtagtggttcattcagctgccatgaggatttctttttggttttatttagtttaattggaatgtttgtttttgtgttttttctcaagtttcttatgtatctacaactttgtaacagctaacttttattttgttacctgttaagttagtttatttcttcagcagtcatttcttctgtgctcaaagctgtggaagaactcaaatacccagttctctgggcctcttaatagcatataaaaattttaagaatatcttcaagttttccaaaggaaaactagttttatttctagactaacagtctccgcttgaaaccctgaaatttaccaatttgggttttaaagtagattattagctagaagttaattgggaggtaagctatttcttttatactgtccaatgttcagtacctaggtgaaatgcagtcaaaattttatgatgaaaaacagactgtggagttgacttgttttatgttattactttatatatactttaaattatacattaaaaattatttcagtctacctaatgttctt

SEQ ID NO: 77829 - DNA, 1056 bp, Homo sapiens
gtaatcccagcactttgggaggctgaggtgggtggatcacgaggtcaggagatcaagaccatcctggctaacatggtgaagcctcatctctactaaaagtacaaaaaattagccaggcgtggtgacgcacgcctgtggtcccagctacttggaaggctgaggcaggagaatcgcttgaacccgggaggcggaggttgcagtgagccgagattgtgccactgcacaccagcctgggtgacagagtgagactccgtctcagaaaaaaaaatatgttagatggtttgttaaatgaatacttgagcctcattcaattattattcagtgcttttagcaaaggaagcaaatttcattcatacattaagttagtaaatattgaggctttattgtgtgccagggactgggggtacatcagtgaacaaaacaaatatccctgccctcatgaagctagcattgtagttggaggattttagacagtaaacacatgagcaaaatttatatgttccccctggttagtactgtggaactagaagaaaacagggaatagaattagggggatggggatggggtgggtagtaaagtagtgaggaggactgtaattttaagtaggctgtccagggacagcctcacttggaaggtgacatttgagcagttgtaggaaggaggtgagggagggagtgagctgtgtagaagtctggggaagagagttctaggcagaagggacactagtgcccaggagatgcgaggactgtgtcttcataggtaaacatgagggctttggcttttacttcaaggaagagtgtgaggtttgtagtagaagagtgacatgaactgcttatcctgaggggaagggtctcctgcttctggcatggggatggactgctgaaggagcaaggatgggcctaggcagaaagcaggttaagaggccactgcagtaacccatgcaagagaagtagcagccaaagagtgagaattggtcagtctggatatattcagaagtctttctaagcctttgctcagttgtctccttttcagggaggtctatcctgaccttatgct

SEQ ID NO: 77830 - DNA, 2515 bp, Homo sapiens
gtgtggatctgtgcacctgtttctggactctcttttttcaattgtcctttttgcctgttcttggaccacactgtcttagttactgtagctttatttaaagcttgatatctggtagttgaaattctttggcactgcttttctttaactggactttgctactttgctattctttgccctttgcatttctatttaaattttagaatcaccttgtcagttacacacacactcacccacctccaagtttgctggaaccttgggattgaatttgactctgtagaccaatttggggagcactgacatctttatactgttgagtcttccagtccacttatatggtatatattttattaaatttggtctgtcttaatttctctcaactgtgttttatagtcttctctaggaaactcttgctcatctttcattgtatttgttgcaaagtatttaatgctattttaggtattttttgatagtttattttccaattgctttttgctggtatatagaaataagatagatttttatatatttaccttgcattttacgaccttgttaaatgtatctactagttctagtagttctttgtagattctgtaggattttccacatgtagtattatgttgtttgtgaataaagactggtttacatcttctgttccactctttatgccttctatttattttcctatcgtactagctaaaagtacacataactattctgttatactgaagggatatggcaaaagtggacatttttctctcccaggggagcattttcaatgttttatcatacatggtgatatttgttttaggttttttgtacatctcctttatcagatgaagaaattggaagttagggattgttgtccgtttttttcttggtatattccaagtatttaggaatagtgcctggcacataggaggtgcttaataaatatttgagttaatgaatgtgtgtatatatgcacacgcttgtgtgtgtgtgtgtagaactgataagatctcttgaaggactggtgtgagaagaaatgattcaagggtgactaactcagattttggcttgaggagctagaaggatgaaaatctcagtaactgagacagagaaaacctcaagttttagggataggtcaagagtttagacgtgggtttgttggaattaatggtgatatttacacatccaaggaccagtatatgaaatgatggatatacaagtctggaggtcgggggaaaggtctgtgtgtgagtcattagctcaaaaatgaatttttaatattgagaagtgttgatcttgactagtaggatttcttttttatggtgtggttctgtctaagtgtacagtacacttttatcatttggaagctgatttttctcttttataggaaagccagatcttatttctttcttctttctttggcctctttttggtgtgttttatttctcatttacacgaagaatatagctatctgctatagagctaatggctttgatggcaaaaacatattggctatgatattcattgtatttaaggacattttactttctaatctttattctagatccctttgtatttttttataactttaatactataatagttatttttatgagtatttacattttaagttgtcttgtttctcacaattacaaaaagtgtgttttacattgtatctcaaaatactttttaaatttcagttatctgacaattcctgagttcaaaagcatacttttcattgaagtgattgaaaaaaataggtatcttaacaagatgtgtatttgcattctaactttactataaccatgaattattttttttagaggttagagagaaatatattgaaagttataaaatgattgtgttattcttttaggtgaaattgccaaatacatggaaacagtgaaattactagactacactgaaaaacctctttatgaaaatttacgtgacattcttttgcaaggactaaaagctataggaagtaaggatgatggcaaattggacctcagtgttgtggagaatggaggtttgaaagcaaaaacaataacaaaggtgaattttgttattaaattattctttggtcttcttgtgtttataattgcaataaatactaaaagaaagtatagcagtagttcaatgaagaacaataacagattgcatggcaattaaggcaaacattttttgtaatacagaaaatgtgtagagggttgtagaaaaataaatatttatatatttcttatgtttagtagcaagttactaaattcctgaactgattttaacttggaatactgatatctgacagggaaattttgatggtgcactgaattcataatttatatgttcttttctcccaagtcaccacttagggttcatcttgtcttggttgtttcttatttgtggatatggtcagagtatttaccagttgaaaacgggcatttgaaaaattaccatttgaaaatttccttgtttgttggtgtggtgcattttaccatttgaacattattttgctctgtgaagaaatatt

SEQ ID NO: 77831 - DNA, 1736 bp, Homo sapiens
ttcttcccagccagggaagaaacaaaattacaggtcctgcttttggggagtcactggggagtagggagggtttcctcttttcaacgggcttaagtcttttctcccccaagctgcctgacttacatcttctagactgggggccactggtgaaaaatttcagaatggtgtttgctcacattcttgaagtgtctgacaaacttcatggtcatcacttttcaaaggttatgctgcaaagctatgatacttctgtttgctgctgaaatatttcttaattgttattttgggttcattacttcagattttaggtggagggaagttgtgaagtcttaacctccaaaatgtctccactcattttttaacacattttaatttgtttatgtgtgtgaacatttaattagaatttatgttcttttctcacgagtaaacagagcttgtttttacttttacactctgagccctccacaaaccatctctcatactgcagtcatctggaatttttagttctagttttttgtgtcatttgtatactatgtattattttttagagttaatcatgagtctaacgtattttgtgttttttgtttgtttgttatccatgtcctttctcttgactttatgtttcagagtatatgctcaatctttttttaaagaaagcttctggatggtaaacttgtaaatcttgggaagtccaaaaatgtctgttttttccccagttgaaaactaatgtggctatatagtttttaattgaagacattgctttgttgccttctaacatctaattttcctaatttttgttttttactagatttctattttttccactcttgctttgaagcttcttgcctttctctttgtcctggcattctgcagatatctgtgcacaagtgtgtgtgtgtgtgtgtgtgtgtgtgtgtgtgtgttctagtttgtttttacactttaattagttatctttcttggtacttggcagacctttttcatctaaaggcttaatgcctgtcttagacgcttgaacaatttattttctgtgtatgtgaggctttcctttcctttccttctctattctgtccctccggaactcctaccacatgaatatgggaactctggaagctagcttcttttctccatgtctcctaactcttcgaccacatgttcatttccttaacgctgttttgtatagatctgtgggcttcttcttgcccatttgttacatctgttttgttttttagtcatattttaagggtactagttctttttttaatatgtcagcatattcttgttttattggtaagatagcctcttaaatcctttgagaatagtaattatgagacttttttatattaactgttttggcagagggattgttctttttgagtttaatgcctttctgttttggttctgtgatattgcttagatttttttcaatgtttattatctagtcatgttttttgttgtttgacttattttaatagtgtatacctcagtcaaagttggaatacctattttcctgttagtttaatagaattttcattacagacatctacttccagtgatttcagaaatgagtgaaatttgtggccagatagcttgttttttaggtgccaggactcactgcttctccagtttctttttctggtccattaacacacaaatacctcagatcattttaatggaggtgcttgtgaggctgtgggtggcatccttagttgcatattataataaattcacctgggagc

SEQ ID NO: 77832 - DNA, 1071 bp, Homo sapiens
ttagcctccttagtttatagtattatattaaatagttttcaaaatcttacatttttaattcttgagcattcctcagaagacttgattgtgctcagtacaggtaataggatattgaccctttaaactttaggttatcactgagcatttatgtagtttctatattctttcaggacctttaaattattttttataacttttgcagcatgcctgtgaaatatatttgttcataaatgatgggactaaaactcagaagaggccaggtgacttgttcagggctgtgaaatcattattattatgcatttatatagaaagttcaaggcatcctagtgattttaggcataaaatattaaagataattaaagcatgacccggccactcatttgccttttcccataaattgtacttgaaccatcttaactttgccaaaagttttcgaccttaatggtgcatgtcatggaaccctcagaggaaaacatgagtgaagagatgtgacattgactttaatctagaatagaatacactgacatattagtcttctagaccgtagttcattgaatctctggaaacagctttcgtcttgttaactgactatacgtttgatcatattaaagtttcatgatctccttgtaacatgaatgatgttagaatcatgaaaagccattgctgccaacaagttggaagttgaatttacggttttcaaaagtgtcattaggagatttttctaggttgtgcttgctattattgtatgacattttgatgaaagttcttaagcatgtagtactcttgtagatcatgtaatcaagggttagcttgtttcacagctaatctgcttgttagctgaatgttttttctaggagaatggatgacagtagagcttgaaggcagctttccctagttccttagtaagccaagctgaagggacatacatgtgctctaaaataagtgaatagacaaattatgctgactttatgaaagcagtgcttttgctgaaaaaaatgtgttgcgcatggagcaatcaaccctgatagccaaccagatggtttttttcctccatttattctgacaaagtct

SEQ ID NO: 77833 - DNA, 1088 bp, Homo sapiens
tctgagttctaattttccacagccaccttaagaatgttttgaaacagtgggattaattgtaatacatagataataacagttctgaccgtttggaggttttaaggtaatgtgccttgaatagagttcagctttcccatgtagttctctttggaacagaacccatggttgccattaggaaaaggaacaatgtgctgtcagcaggcattatcctcttttctagctgtacacaaaatggcctgcagcaaggaacattctcagatgaagtttaacttattgttaattgttagaaaatataaatgaggacattctgttgcattgtgaacctgtgagatttggggcatgtcggatggttttctaaatgatacagacttattttaggcaaccaagagaagctttggattaaaatttgtattttaacctgcttaaatttgaaactacagaagataaagttatataaaaaaattcaaagttttatatttattcctaatgcccgtctataattttacctatgtatagagatgttagagaatttagaaacttaacgcaggattggacctgttagaaaatgttgtagtggtagaaacacataaaatgaaattgaaggaacatttgggaagaatggatggtgacagaatataagcactgactcctaaataacacttcactagaaaaataggacaggcccaagagaatgtaggaaatccagacgatttttgagattttcggagagctttgtacttttaagactattcatgtacagtaaggtttatggccctcttaaacttttaataaaaagtatgctaaaagagaaacaattattacaagtttttcattattgattcataaatagaattctaccaccaatgttatgtggtacaaacactgatttaataaatggggcaagacatacattttttccatttatcaaatagattatcctctccaccccacccatgttgtacaatgtggagagtatcattggcctgagtggtgatcgtgagtttgtaaaacattttgttttaaaagagtttctgtatgattagtcctgatggttaaaccatagctttgaataatgaagtatataaagc

SEQ ID NO: 77834 - DNA, 1502 bp, Homo sapiens
aaaaaaaaacacaaaaaaacaaaaaaaacaaggtatgaagtcatttttctgagatggcttataaactggcactgaaggcacttccaatagttccagaaatgacattagcaaaggcagcatctgcaaagggcagagctaggttggactttggtctgatatgtttaataaactgccagccaatgtgttccaggattcatgtgatatgatgatgtacttgactcaataaagagagctattcagtgtggcccacaatacatttttttaaaaagatttttcctgtctgcctttttttttttttgaattattattttgtttgtcctgaaatatttcttggttgctaacagaaaaggcttatttttggttaaaaaaaaattttacagcataggtgccatattgagtaatgccaccaatttattttaccttccttttgctagtgacattagtgcatgtttgtggaaagcacagtattcaactttcaaagagaatcatttttgccctgattttattactatgttcttcattacatattatggttagaacatcctttggtttaatctgttttaacccaaagaatacttgagatacctgaagagggaatatataacttcacactgaaggcgagaggttttgaagtagtccctctctttttcccgctgctgtcttcctttcgctactgtcttttttcctcctttcccctgtcttgttcattttgttattaggaagtgaggagtcccaaggagcaatacatcgaagcatgtctcagccagaggctagcagcagcagctatgacagtgagtgggaacaaaattaaggagtatttataaatatacagcaatattcttaaaaaacaatcccttaaattttaaaactggcaattttagtttcagaaagatcctgcattgttctagtgagattgacactcattaagtctaaggcagagtctcagctgcgcatcaggaagactcatccctttcttgactgcctggacatcatttgttacctgaactttgcttaatgagcatcaagcgtttttgttttgatagataaatgcctttaaattctagtataattatgaatttttttttaacctaagtttttagtttaaggtcttctactgatgctttttcccatgagaaaatatatcagtatttttgttattttattaatgacaaaagagtatagtaaagtcataaataatttaaggagaacaattcagtttttttgacctaactttttcagaagataaagaatagtcagattcacccttattcatataaactcaaaattgccgttcttaaaatgctgtttatttcccccattacagttcacttttttcccctaaagtacaatgcgagttaaggtattttactatcaaaataatcataagtgagagaaatattatctgatggtaaaatattattgcttccagcaaaaagaaaaagccaagagttcatgtaaatgtatatttttaaatttatcagtttaaaagttacttgaaggaa

SEQ ID NO: 77835 - DNA, 1424 bp, Homo sapiens
tatcacatatgatccttttccaggaggctactcatttgggacctgtataattcctagcggaaaagactttccatttcagtatatcccagtgctctcctgcctcaagggtgtagctaatagtctttaaaaagcaacttattgctttgcttttcataacatgtgtgacctcatcgcttccaccttaggagtgaatgcttatctatattgctaaggtttatatttggagataatgttttaaattttacaacaaatttaaattttggagagaaatatttcagtattagtaaaaattagatacgttttatcagtcagtatttttatatggcttaagagaaggtaggttttgtcagcatattttttgacatattaaaaaatgacccaattttctaagattttcagagtattagcaatcatacctttgtatgtcagttttatctttgcaaatcacgagagtcgatttgattttaaaatgttaataactatatttagggatatttatatttctgttcttttgcttttgtaaattattgactagtgatttcagtttctttgatttttcttcaaggttcaagaaccagaaagagagtccagaagtaattcagatgctgtgaaccagatttccttttctttgttttcttttgacttttttctccttttctatttgaactgttttattttcctgtgagtcttgcgaggtggaagtaatgattaaatactcatgtgttcagaaaacataaactttttttataaaaatattttgtacaattcattaaaggctaatttatgaaatttgaaaatcttcaggttatactccttaagttatcccaaagccgtgtgtttgtgatgttttggagtacatatatatgaaaattattatgacacgcacttttctaatcattgtacatttctcagagtggataaaaatgtttgacaaagtcctcacttttaaggaaatgcaaagcttaaaataaaactctcttttgtttgatgcaaacacacagtatgttgtggctgtaaggtttggtttgtattgattttgttctgttcccaaaatcttttattaaacacctgctgtatgagacaggaggtacaaagacaggaaaggaatatgaaataaaaagtggaggaagcgtatccatgagagagaaaatctacatatatgaaagattacataagaattatgtcagtatgcaagccgtatgacaagaaaacaagtgacagatgatcaaatggtggtgtgattaaagattgtgtaaagactggcttcatctacggaagtcctatgaactagatattaatagatagagcctattgttcattcacagaagtttatttttcttaaaagtttcactttcatagcatgtaatatttatacagtaaaccaagcacttcagagtttcagtgatcagaaagtttaagatctg

SEQ ID NO: 77836 - DNA, 1099 bp, Homo sapiens
ttacctctcaccactggacctcttgttcccagcatgttcactgagagcaccttagctctctgcatgttcactgagagcaccttagctctctgcatgtcacctgtcctcttcaccctccctttgatcacagtcaaactcttgggagcccttgcaaagatcagttatttagaaccaaaatcacaggaagatgcatatgatagtgaaaacctagaaataatgtaaatgcctgaccataagagatagtttcagtaatttatgacatattcataaattgaaacagcctttaaatgatgtgggaaaaaaaggataaatgaaaatgtccatgatatttttattgagaaaagaagcagattacaaactagtgtttaaaacttaaaagatgtagattttcacgtaagaaacgtgctatagaaatgtgtaaatgttgccccttgagtctgctccaattttgctaaaataaagtctttgatttcagagttctctcttctacccttgcagcttgaattcccatcagtgtgctgagggctcccaaatctagattccttcccaagatttcagcattttccaaatggtcagtttatcactgccttctaaaacctgctctttctttatgttgctgtcatagtcagtagttctaatattctaccagaaacctgggaatcatttaggatttctctctccactatacaaatccagccagttaaccaatttctgttgattattgctttctaacatccccaacctgttcagttctcctgatctctttcagcactttctcttgggctgtattatttcataggtgggagtttgcagcagactcctctctcatcaccttgcttccattatcactgcccactttgcttgcacacactgaagccagagcaatctttctaccatgcagacctggccatgtcgttcccaacttcaaaccctccaccttgaacataatctaaactcttagcaagatatttgataccccaaagggccggctccagccttacctgcgaatcatcactttttgactcacctctgagctcatctatccttccatccatttaggtatccatccatccaattcccccatatgtccccctatcca

SEQ ID NO: 77837 - DNA, 1029 bp, Homo sapiens
ttgtacatgtgtccacctgcacgaaagccttgggtaccagtgtagtttctctgcttggacatctgctattcttattcctctgggaaataccacaggattgacctgagccttttgtagtcaacctattttattctccttgtttggcattgactggcctaagtgggtgcctagtaaatgttaggggaatgaataaatgcatttaggtgcacaaccttggcacactcaagaccggtctgagagcaagtgcttaaaaaaattcctgggccccaagagctccatgtttcagtcacatgatggtctgacagggatgctggagtcttatctctcattctttctgtctgtctgtctctttctgttttttggagttcagctctcttttcctctccaagccctcccttcctgcctggcccctttgtcgacacttgatcatttacatcaagttgacattcgcagagtttactcaggggtctgtaattgtattctttccctggttctgcattaccaaccatgaaaatggaatcttatcatccctgaccaatttttaatgtacaaaatgatttggctgaggttcaaagggaagcacaattgaaatcaggtgaatgatacatgtagttttttcagttcctccgtgcttagatttgattttttttttccggtatagcatagaagaagtagattatttttgcaagttatataagtgcatttctgtgctgtgtaggtatgaatctttatacatctgaaagcacgaatatgtatatgcatgcatgtttgcttgtattaccatactcacatttcacatgtgtgcacctatttagacataagcaaacaaatataattatattgtttgcaattttattgatggcaatcaaatttgcaatgatccttaaaatgtattcaaagcacccaaggagctagtgcccaggattaatggctggaatattcaaatcaagctctgacactcctttgttaattcagaaaggaacccccagggagaaagtggcactctctggttctggccagaatcatccc

SEQ ID NO: 77838 - DNA, 1039 bp, Homo sapiens
ctgtaacgctgttgagcaaactcccatcttcatctcagagaacatcatacttgtgtctaatgttggagtccctgaggaacttgatcaaatctctcaggatatcttggcagaaaggatgagtatatgggggtaaaataccaggaggtgttagggagttattgttaacaattatactagaggaaatcaatcattgggtcaatgtcgttgctcaggaaggaattctggttgcgcccaggcctctgcctcaggctcagtccagttgatcatttctcccaatccagatgaagaaagagaaggtttcttatcagatttgcagctggtccaaagtgaggatgtattggttgatgattctagacttgaaatgaccttgatgcttggcattttgggtctaagtgatcaagacagatcacatactgcccagaagttcctaactcactgaaacatctgcctcaaattccaaatatctccacagtgccacttacacacacaatattcactaagggaaggaactatgggtaataataacagttatttactgagcaccttttttgtgccaggcacctaatcaattatcagtctcttttttaattcccccaatattctctagtatttaaaaaaggtaggtcacttactcaaagtctagggatctttggaacagtcaaaccagaatttgaacccagatattggggcccaaagtttgcattccatttgctgtgctgggcagccttcatgagctcagctcaaatgccttctttctgctcaggggctgagcttgcattccaaagtttgtattccatttgctgtgctgggcagccttcatgagctcagctcaaatcccttctttctgctcaggggctgagctcaagtagaggagctgggaaggaggagcgcctcaagactgggtcatgggaatttgcagtggccttgaaaatgtccatccaaatgttgggccaatcaatttccaatgtatctctgcagcaacccacagtagggaccaccacagtcacaactaccctctactaaccatctgcaggtatgt

SEQ ID NO: 77839 - DNA, 1032 bp, Homo sapiens
cattgctttgctacggctcggcaggcactaggatagaaggttcagtttgtgaggttccttcctgttgcagctagttttcatgtcgggttaccagcagggtgtgttaggatgctcccgagggggtcaggtgagggacacagggtcactctcttagtgagtcctgtgaaacactaacattaacatattaattcacaaagctctcagttaatgccagacctccaaattgaatcattctctgttgttctgatatgctctaagatctcttttggatgggagagtgtgaatgtagttgacttttagaatctgaggttattttatttatttttcgagtgtgggcttattcttgctttcacctgacaggttctctaacaccgtgaataccaaaaagaagggattccacggtgccttcaaaatgtacagctgtctttcctcccatgaaagcccagggatggagttggtttacttttgaatgcttcccattagcacacacggatgacatccagcccttgaaccatgtttaattgaaaatggcaaataaacattgcccagccggagctcccgtgcctggaagctaaattaaaaggaaaaatgaccagcttcctgactgtccacacggcctttccatatgtaacgtgggatgttgcatttggagttgcattaattttttatcattccttagtaattaacattgtatttctgctgataaaccccatcaatatggtgatttgattatcacaacataaaactactcattaaactccaattatgttgctcaggtataatttgattttgattggttagaaaaatgctgttgtgttgccttttttttcctactcccccttttaaaatatccagttaagtgctacatttacagtgctgctcatgttgcaaggcttctttagcgcaggacatgtcttaccatgtttactaagaacccattgatatttaggtgccaacagtggggatgacatttatgcaatctaatagtcagaaacctccagataattcacccttcccatccctggtgggaag

SEQ ID NO: 77840 - DNA, 1034 bp, Homo sapiens
ttgttgcgcaggctggagtgcaatggtgtgatcttggctcactgcaacctctgcctcccgggttcaagtcattctcatgcctcagcctcccgagtagctgggattatagctgccctccatgatgccctattttttttttgtatttttaatagagacggggttttaccacattggccaggctagtctcgaactcctgacctcaggtgatctgcctacctcagcctcccaaagtgctgggattacaggcgtgagccactgagcccagccggaattatatttcttgaaaacttcagagaatagtaattgccagaactctcctctgtgcctggtgtctagaaatattttgggagcggtatgatttctgaggcagaataatgctgaagagaggtggcatccaaaatagcacatttttttttttttaagtctgaacaagggcatttgcagtatgaaagtggaatgttaattgaaatcggactctgccaacaggagctttggaaggagcccaatcaggattagactaattaagacatctttaaaattgaacaggttggactgtcttaagaattgaaccaaatgaaaactatatgctcaggaatgtgactctggaggtttgaaaaagcaaaacaaacaaacatgaaaataattatggtaaagtcaaaggaaggaagaaaagatactagagccgtggacttgagcaagtcatcgtaaaacacctcgctggaaacaaaatattcttacatgtggctgacactggcagattgctttagtgttgggaagacagtctttcaaaccgaattggaaataagcccgctggtgttattttacaggccacgtcgggtgttttatagggaacatcttccccatacttgaactaccattccaaaggccaaaatatttaaacagaggtcatttaacattttaacataaagtgtcatgtacttgaaaaaaatggtttttaaatgttttaacatgttttctctctaggcttctcttcctttgtttcctcctgagccaatcaaaaagtctttatttta

SEQ ID NO: 77841 - DNA, 1527 bp, Homo sapiens
gcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaagcgcgcgggccccggcgccccgcacctgtacagtggaaccgttgccaaccgagagaatgctgacctgacttgcctccgtgtcaccgccaccccgcaccccgcgtgtccccggggcccaggggaggcggcactccaacctaacctgtgtctgcgaagtcctatggaaacccgagggttgattaaggcagtacaaattgtggagccttttaactgtgcaataatttctgtatttattgggttttgtaatttttttggcatgtgcaggtactttttattattattttttctgtttgaattcctttaagagattttgttgggtatccatcccttctttgttttttttttaacccggtagtagcctgagcaatgactcgcaagcaatgttagaggggaagcatatcttttaaattataatttggggggaggggtggtgctgcttttttgaaatttaagctaagcatgtgtaatttcttgtgaagaagccaacactcaaatgacttttaaagttgtttactttttcattccttccttttttttgtcctgaaataaaaagtggcatgcagttttttttttaattattttttaattttttttttggtttttgtttttggggtggggggtgtggatgtacagcggataacaatctttcaagtcgtagcactttgtttcagaactggaatggagatgtagcactcatgtcgtcccgagtcaagcggccttttctgtgttgatttcggctttcatattacataagggaaaccttgagtggtggtgctgggggaggcaccccacagactcagcgccgccagagatagggtttttggagggctcctctgggaaatggcccgacagcattctgag

SEQ ID NO: 77842 - DNA, 1139 bp, Homo sapiens
caagatctcgcatgccatgtcttctgctggatctgagctgggattcttgttcctcttgcatccccagctagtgagtgcaatgctgcaagacgggtcctgtctgcaccgtctcttttatgcagagcattaggagaggtacatactggaaaagcggcgagcttcacccccaggtgcaggagggcacttgcaggatgggttccggaggaaatgttcagcctccattttgtgattgtctcagtgatggacacagacgatgacgttttggctccataccacgagtgttcgctacaatttgctgcccgtgtcaccagagccagttgctaacacatcagcatttgccactgttcatcctgactgccctgtcagatgtgaggatgttctttcattgcttagtattctggcagaggactttgaaagactcatgtaggccagtgtgcccccgccttccctggggtctggaggtggaattccaagcggtgtttgggcgtgtgtgtgaggacacggggtgggggcagctgtcacagtagtagccggtcttcacagcatgttaaattttttctgttcctaggaatccatattcaggtgtacagtgctttctgcacagacggtggtgtaggaaacacgagaatttcctatagctaaaaatcccaaatgttgcagaggtattgcagctatttctcttaaaaaaaaaaaagtttgcaggatagtacagtttgatttgtgtttctgtacaactccctggaatcaaatattatcagaattggttgttctcaaaggggtcggtgatcttgcccccctccctgggaagattcggcaaggcctggagacatttttggtcctcgcaaccgggggaggtggatgctcctggcatctatctagtgggtgcaggcagaggatgttgctaaacatcctgcaatgcgcaggacagcccccaccgcccaaagaattaggatgtaaatgtcagtagtgccttgactgagaagccctggcctagatggtttcgggtgtggagcatcctcgagggctgggatttgccagggctgttacacagtccagccttgacagaattcctactactggaccgtattctcacaaacacgatctcccgtggcctcggaggtaatggagatcagaatccc

SEQ ID NO: 77843 - DNA, 1037 bp, Homo sapiens
gggggcagtggctttcttagccagaggctggctcagcacattaccaccagaggagaccatgtcttattggtcatagtaccactgctattaccatcagcacttacacccctcagtgggccacttgctttgaaaggtttttctcttctaaatggcatctattatttttgccatgagataatcagcatgatttcatggagttactgcaattctagccaaaagcaacacatcttgacatttttgttagtacgtgggctgaaatgaaaggtaaaatactgaggcccaggtagctagccccatccctgcccggagtgtgtctgctgctcttctgacccagcgtttatcagaacagcataacaagagcacaggctttaccgtgggcagctgtgcagccccaggcggatcccctatctcttcccgtcctcagtttcttcatctgtaaaatggtcatcatgacggtgggtactgcaggggttgttggagcagcatgtgaggtccttggtgtgcttagctcatgcctggcaggtggtaaggatttcataaagctttcttgttaccactgtgagtgttatttccccagttccgcctttgtcttggagagagctgaggtttcacggaatacatttggaacaggcagggatggttatcaattctgcagatggctgtgcccagaatgatatagacacgaaacttaaatagatccctgcggtgcccaatggacatctcctttctgacgtcatgaaagaggatagtttttaaatgaataaggaatctacacatctgagggataacactgataattacgatcattttggaactgtggagacggcatctttagcagacggattctggaggcggactgagtggttggccggtgaaaccagccatctccttgggtactgggtaccctgaagtccagagtggggaagggagctgccacagggggccctgggatctggtttcccatccctggatttggccacttcggtgtctacctcacgaggtccccagtgacgtgtcataccccgcaggctcgcttg

SEQ ID NO: 77844 - DNA, 1739 bp, Homo sapiens
atgatacccctgcggctggcaatgttgctttattttggggttgggtggctgtttcctgagcctgaaactgcacacctgggctaaccaaagaattgaacggttgaaacacagactgttttgggaaatctcgggtgcatgcagccatagttcagttttaatacttccctgttccaccgacagcctggactgtcttgtttctgaaggtggattcacaggcctagggtattcagatgtgaggcttgctggaatcgtttaactcctgccggagagggtaacctagaagccaccttccttgctagtgatcttcatagactggattttaagtttcattcctttataccttatggaaagcagcttgggaaggtggtcctctgaagggttcacatgcatccttttgttatattgagattttccttaatactgaacagttcttgacttgagtaggccttgagtgtgggcttgaaatttttcatggacgaaataggaaagttttcactatgatgggatttacagcaatggaatttgctctatatccagctaagtttcttgcgtgttttctgaacctctcccttttcaattttgccttcagttcttcctttctttgagtctggagtcccacctccgcctttaggcatgcagtacctctgccaggcatgcgctttccctcccttctctgcatgatgcacttttttttgagacggagtcttgttccatcacccaggctggagtgcagtggtgcgacctcggctcactgcaacctccgcctccaaggttcaagcaattctcctccctcagcctcccaagtagctgggactacaggcacctgccaccatgctggctaatttttgtatttttagtagagacgaggtttcaccatgttggccaggctggtcttgaactcctgacctcaggtgatgtgcatgccttggcctcccaaagtgctgggattacaggcgtgagccactgtgcatgatgcactcttattttccattctgaatgaacaccagggtctcttccttggagaatctttcctggtcccccgaggatgtcagcctctccctcctctgggttccacactgcttggcacacccttcactagtgactgagtggcctgaaccctgcctagatgttcctggagtcattggcctcttgctctagactttatgctccatgaggacagaccttcatttctttgtgtgtccctcctcttggcatagggcctggcacagagtagacacatcgtgcatctgtgaaggaagggaggaaggaacaagtgaataaatgttgttgagaagttgacggtgaagccgtgctctcatttcttgctgtaacgataccatttctgggttgccagatgcggtgaggtcttgggtcatcctgatactcttccagggcttccccaggaaagcacctcgggagcagggtgtcttctgcacacctaacacttaccctgggtcaggagggcgagtgtgcgggagtaaggacagccctgtggaatgagccaggcctgcactggatggagaccccttttgtggaatgctcttgggtatatatttgcctctccggttgcatttcccatttcccccgacctgcctcattctatagcaaacagagctgctttctgcgtcgcgtggcccagcgccctgcaccttgagtgtgctcacacagctccctaccttgcggacctttccctccttggcctgggcacctccggttctctgtgtctggcttgaacatta

SEQ ID NO: 77845 - DNA, 1109 bp, Homo sapiens
tgaggcactcagcaagtgctcagcaagggccagccattgttttgggggtgcaaagcccagtgcagtatcctggcttgggggactgtggtgtgtggtggggtgggcaaggatagaatgctgggtgcaccattcgcctgcagcattctggtctcatctgcaaaatggaggtgctgggggagccccacagaggaggtgtggggaatactggagagccctgggaagcttctcttccttttcttccagaggagccctgggtcagagtggaccactgtgttggtgtctgtggtggatttgacagtggggcttgaaagtacaggtcaggaagccaggtagttcgctccacatattttcctgagaacgcatcttggcttgctttaggtacttttcagtcccctgatcatctgggcagaagaggagtctgaaggctcgagttcctgcgccagcctcatccttgggctgtgcgacctcaggaagccctttctgcatgctgggcagccttcgttttcccatctgtgcacctgggggagatggctctgtgctaaggtgacttattggtggaaggagcaagggcaggctggctggacctgccttgttgcctggatggccttgggtagacgcgctttgttcctgagccttggcttctgcacttgggagctgaggtaagatgggatcgtggtaaggactgaccaaggtcctactggtcgggtgcccgtggttcaggcctgtctgcatcctcgggggttgctattatcgaaggccgtctgctccacggttgagactgcttttgagccaagtcatccaagcctgggtcccagctccttcacttcctgtaggaccagccacgcaacctggttgaatctcacctttctcccctgagtgacagggaaaatattagcttcctctgggggccattttgcagacaaggcctttcacaccgaaggacagattcagagaagttaagcaccttccccagggttgcccagctaataactgccgagtcatagctggttgggaatagaaccccatagtgttcagtcctttgttcaaggtgcatgggcaacactggatggggttctgggtgccccacagggcagaagccgagaaggaca

SEQ ID NO: 77846 - DNA, 1123 bp, Homo sapiens
gtgcacctggggatggctgacctagtctgcctgggaggaatgcagagagtcggaagcctgctagccccattcgccgaagagttttctaaaaccattgattaagtggaaagttttttgctgtgctgaccgggggtggggtggaacaggtattcttgtgtcttaggattagcccagatggggctgttctggtgagtgcaaagcagtgcatttcggaaggtgcggaaggtgcggaaggtgcactctgtttggaaggctgggggtatggctgagaatgtgtcgcgagacctttcataccattcaatccaggaattctacttccaggaccacggcctgaagactaaccagggacacgcataggctcatacgtatacacctgcagcgtccctataatcatggaaaagagagtggtgaaataaacatgccccagccatagggtggaacatcacccagcaattgaaaataatgatgtcagggcacttctagcgatgtgggaaaatgtcaagcacaaatcaaaactgtatacagcaggagctcagctgtttgaactgtatacagcaagagctcagccgttcgatgtctgtgtgttcttgtctatctgcatccacaggaaagggaccgaaaggaaacattgacattttaagagaagttattttgatggattatatttccttccatatccttgtttgtacctgtaaaggtttccacaagaagaaaagtttccttgaaaatcagacagtgcaatgacactgatctcaaaagttgtagccactttttctcagtggaaagaaaagtttctagctgggcaccctgcatcggcagcctctgccaaccttgtggtttcattagctcctcctcccacttcccagaaaaccatccagcccttcgatggatcagggggatacacactaagcccacgcgtgtcagccagctgtgatggatagcttcccgacacagcccgcgtcctgtgcatttgggaggcatcgtctctttattgctctgatttccatacctggcttgcggcttcaaattggaagtcaggggcctgcacagcagagtctgctgtcctcttctggggctgggggtgcatgacccagaaagggggacacttggtgaggatgtctcc

SEQ ID NO: 77847 - DNA, 1044 bp, Homo sapiens
gtggctgactaggcctgttctgctccctgcggccatggggaacgagaacgggaacacatggggcagtggagcagcccttgccttccagatctgtggttggggaaagccacagcctcagtttgtcttctaggaagtgggagttgagatagggtgtggaagggcccagcttcgtgccacagtggggtgcggacattgaacagctgagagccgggatgaggggaccctgtgtatttcttagtggaaacagcttttcaccggctgtccgaccccagagcacttgggctgtgaggccctggattcttggcgggggtttgaattagatttgcctggtttgactcccttcctgaccagagaccagaacccagagaggagaagggacacttctgggtcactcagcaggggcagcgctgcatgagaccccaggcttgttctaccggctccaggtggcctcggcctcgctattccctgcctgagctaggctgaatgaggctgaggctggggaggttggactgccctgtagccaggaggactgttagacttgagctctagtggccgacgacaggtggcctctgctctctccccagggctctgtgggccctgcctccctctctctccctcccatccccatgagtcctcagggcactccttgcgttgccttgcgcatggcttcaggaggaagctgtcttgtttgtcatttctggcccagggctgggctgtcctcttctacttcaaggcacattttggctgatcatgaaattgctacccagcaccttctctgatggaagggcagtgagctgacaagctgggaggctcaagtgtcctcctcctgggataggcctattaaaagaaaaagcaggagaaaagaactcttagaggctcctacagcatgcagagctttcaccagaaacaagtgatcctggcgcttataaagaggccagtggctggccatgctcacacctgtaatctcagcactttgggaggctgaggtggtaggatggcttgagtccaggagtttgagaccagcctgggcgatatagtgagatc

SEQ ID NO: 77848 - DNA, 1031 bp, Homo sapiens
ggggcttgagctgcacatgctgcagctgtctgaccaacctggaaggccacctctctggctttgggtgcaccgtttgatttttggaaattttggggagatccattttgcttttgcttctttattcagcaagttgctctagcccccccagtgctcaggtgaatccctgggtaggaggagcagttgcttgggttgatggcacctcctggaaaagaagacaaagtgtagggatgatgagaatgagtggaagtcggtgggcaggatgggagaagctttgggcttggaatctgatccaaagtgtggtttctgagtttggaaccaactcttctgctgggatgtgtggaggggggagtggggatgggcaggggttcaagttcatttacttgtatcaagttgaagtttcttcttcttataagtaagaagcaaaagcccacatagatgatgagaaagacaggctggaaaagcagactttgcttactcattaaattttctgtaaaataaacacaagtttagaaccgaggaaccagtggtggggggtactccagagggcagggcggagtttggtgtgaacctctgggtgggaaatgcaccagcaggtcagagtcacacattcacgtgaaagaggtcaggtgcagccctgagaagtaaggacgatggactcgaggaaccaggtggaggggggtgtgtgtgcacgtgtgtttgtgcatgagtgcattgtgtacatgtgaatgcatgtgcatgtgtacatgcatgtgtgcacatatgtctgtgtgcacacgagtgcatgtgtgagtgtgcatgtgtgtgcccatggatgcatgagtggcattggcaattctacgctataccctgagaccaggctctgtggccggctgccatgaggaggaggacagaacagcaaaaggcacaggccaggatggagtgaggggcccagacaacacccaagtacatgactctgccctgggcccagaggctgtccagctgcaggctctcatggggacccctttactcccctggttgcccatgggcttggg

SEQ ID NO: 77849 - DNA, 2112 bp, Homo sapiens
ttttttaatatttaaatgtattttaggttccgggatacatgtgtagaatgtgcaggtttgttacataggtaaacgtgtgccatggtggtttgctgcatgtttttttttttttctttgagatagggtcttgctctgtcacccaggctggagtgcagtggcgtgatcatagctcacagcagcctcaaccttctgggctcaagtgatcctcctgtctcagcctcctaagtagctgggattatgggcatgcaccaccatgcccagctaattttttaaaattttttgtagagacagggtcttgctatgtttcccaggctgttgttctcaaactcctggcctcaaatgatcctctctcttcggcctcccaaaacactgggattacagacatgagccaccacacctggccacacctggattcagattttatgtagaagttgccactcattggaatctggagtggagggcagtaggctggagtgtccctgggaggcagggtctttgtgggaattgaagctaggaacaggcagggccgtggatggggggacactcactgtgccagaagggaaggggaacttctgtgctgtttcaccaagggggtcagtaatatcctctccactaattaggcagctgacaaatggtgacctgttgttctgacacttgagcccaggttctgcctgccctctgtggggtctgaggactgggtctagggagagggaggagtcagtgtcctggggccaagcctctcggaggagcaccggagggctgggatgtgtcaccttgagtgttccagcatcagaagcaagatgctggccccagcagtacccttgtgcctgggcgcacggggcagcccctcggggggcccttgccaggggcccctgtgccttgttgccagatgctctccaagcagtgccccagagaggggacaggatgtgccccaagtccctgcgctgagctaggacacgtgtggctgacgctggactctatgccttccccttagacctttgtgctctgcccaagctcatggactctgcagcctgtggcgtccgggagtgtgggagacaggcaccggctggggttctgcatttgtacttttggggtagtaggacttaccattgcccgtggagtaaaatgagtgtttcttagacaatatttccctgagcccagattcctcagaagtgaaaattaagttcttctattaaaaacatgagtcataccagtccagatgagagtcattttggtgttcctcgaatttttggaggggaaacgtcgcattcatgttaatccattcaattatacctcattgctgaataacgtgccgggcattctgggtggcagcctctgctgtctgattagtcggggctgtgtctgctgcacttgagagggagcagctcggggccttcatcctcttttgtgctggcacacccaggtcggccgagcctccggggctcccttcttcattccaggggctcatcgagagcctgggcatggtctcagcatctgattcttgcaaatgattcctgcccagctgaaaagcctccctgtctgtctgctcatgtgagttttaagcagatggcagtaggtcccccactctgcactggcacagggtctagggtcccctctcccctggtgggcatcctgctcaggtgaaggtggagacaggcttggttttgttccctcagtgatgttattttatcctcccagaagccaccaatgaccaagactggaaccaaagcaggaaatcaaagcaaagtatcactgggtttggggacagacccagagacttcttgtctaaagacagcacatcctgctttgggcaagggagccaagcaggtgggggaggttggagagcatcatggccctgggatcagccctctgcagtgcagtctttctgcctctcacatgggccctgtcagggcctgggtcacaggcaagtggacacttgcctccagcttcagctcctgggggtggggcgtggaggggttgttctctgggaagtctctgctgaggtcggggctgaggtccgtgtcacctgtgccctccccgatgggcccctgtacttacccatggagacacctatcacggggtgggtctcctttcctgtctccctggctgtcc

SEQ ID NO: 77850 - DNA, 1658 bp, Homo sapiens
cagaaatatttttagtttgcatcttttaagacatggtgcatgttttcagggagtggagttcggagcccactggcatgtgatgatgtcaccaagtcagagcacacctgaagcctgtggggacggggtggtggcaggcggcggggtcagaggttaaggagcccagttctgagcaccatttgtctgagcatgcatttgaggagaggtgttccaccagcctaccgtggcttctgtaggtgctggagcctggggtgtcctggctacccccagtctggaagccagtagcattgagagaacagcagctggctcagctcagaggccagggggtgggggttccccctggataaggtggacctgacagggtctgagcggacctgcaagaaataaccaagacttgagggaaaacattccacggctttttcatttggagccaaacattgcctcatgtaattttctccctggtttttcccattgcctctgccagggtccttgggcctggcacagacccgtaataaaaggccgtgtgtgtgtgtgtgtgtgtgtgtgtgtgtgtctgtatgtgtgtgtatatttgtactcgtgagagtgtatatgtgcatatatgtgcatgcgtgtacacgtgtatatgtaagtgtatgtatttgtgagtgtgtttgtatgtgagtatttgcatatgtcagcatatgtgtatgtgtggatgtgcatatgtgtacatgtctgagtgtatatgtgagcatgcatgtgtatacatgtgagggtatatatacatatttgtatatatgtgtgcatatacatacgtatttgtgtgtgcacatatgtgtatgtgtatttgcatgtcagtgtgtgaatgtgggggtgtgcatgtgtgtacatgactaagtgtatatatgtgcatgcatgtgtatatgtgtagatgtgagagcatatgtgcatatgtatttgtacatacacgcgtatttgtgtgtatgcacacacgtgtgtgcagatgtgtgtacacatgtggatatttgtgcatgtgagtacatatgtatatgtctgagtgtatatggtatctgtgcacatatgtgtatgtatgcgtgtgtgtgtgtatgagtgtttttgtgtgtgagcatgtatgtgcatatgtgcatgttgagtgtatatgtgtatgtgtctgtgtgcagtccagggagaactatcagcacagaacaggcccctcccagcctcccaagctctgtgtttatggtgagggcacttgtgattatttttcttccctgaactttctgattcttcctggatttgtggtgtgtgtccatcctgaggcctgctgaggcctttgagggcgagtctctctctagagctgaattcaccttcttagtacctcctgggggagactgagcccccgcccccaatctcagagggagcccacagtccacagtgctgggaaatgtggccagtctggtgtgtgacccaccaggagtggctgcagagagaataagggctgtggaagtggacggctgggttcaaatcccgactcggatgtctctgagctttggccttgggcaggtagcccagcctgtgtgtgcatctggttccccacctgtggcatgagaatagcaccatctcacgactgagagtgggcggctagcagtgataatggggcgctgtgctaagaagcgttc

SEQ ID NO: 77851 - DNA, 1021 bp, Homo sapiens
tgactctgctgaaggaaggtggggctttgagtctaggcgttcctgggaactgaaatttcttccctgagaaatttcacatagaggatttggcacagtggctgtggggtcaagagcctcagactgtgttcctggtctgtgcttcagctggccaggggccctaaagaagtcattgcctcagtttccccttctgtaaaaatacacgtatgtatgtatatgtgtatgtatgcaacatttgaaaacgaggctcgtgttattttctgagacaggtcagtgtggagctgctgtgggtggagtgagcatggggctagctaggtttccagggcagggcgtgggacattcagagaatggtttggacactcctgggctttgtgccccgcatgccagaatccttccctgttctgaggcttccatgattggaaagcggtggtcaagtgtatgagactgcttgggggtgaaggctgttctgccccatgtagtcatttcccctctccatccctcagtttccccatctataaaatggagctaaggataggacaggctctgaagggtcgttctggggatcgtgtgagatcatacgggccaggtgctgagaacaacaccatgtgctgagtgagccctgtcgaagttagagtccatgcacgagcggaatgggattcacgacattgagactctgtcaggtctcacttcaagctggatcttcgctttccattcttaaaagtatttagccttttggctggctcagatcatgtaccagctttgggaggtggaataggaactgagacacttcattgcatatttaaaagctgcaaatggtcatcagccacagtgattaatatgtgtacttggtgaagttcaaggtctcacacaagaacacacaggatcccagctcagggaagtggaagtgtttggctttaatagagggagtcagttgcagtcattagtatatgctgaaatcacagggcaatcttgtaaagttaaattcaatttacttttctactgaaattgtgcttgctgtgttatt

SEQ ID NO: 77852 - DNA, 1094 bp, Homo sapiens
ccatccatccatccatgcatccatccatccatccatccatccatccatccatccattcatccatgtagccatccatccatccatgcatccatccatgcatccatccatccacccatccgttcatccatccatccatccatccatttattcattctttagcttgaagccatttggaaggcacctagcttgtagcactgtgcacacacaggaagagtcggcaggcaggtccctgccctcgtgcagcttgcagtctggtggtggggaggacagggagtggggacctgcagaaggggaaggaggagcagggagggagggagtggtggaggtgggatttgatcccaggctctccatccagcacctgccacatctttggctttggctcttcttctggcattaaaggcctttttagattttaggccttgagagctgccaggactcagagcctgtgagcaaccagtgcttgattgcagtgctctgggagggacgtgaggaagggcagtgtcctgttcctggggctgggactgcaggaggctgagcccctaggactgctccaggagacccttctaaggggcctgctcttacctcctgccctctgccaccatgtctggtacagttctcttttttcattcggtcccagttcattggccctcaccagcttgcaccaccatgtttcccgatcaatttgaatacctgaaactatcctattctggtgttttttgtccctttgtgatttgtgtccctggcactgggctgtttgcttaagtgtttttagtgcctgtttaattagtagttggaatggagtcattaagttcccagtaacccgttaggaagaagcaggcctttgtaaagatggaatgggcctgctgtccttacctggttttgtcccttttcggatcaggatgcattgaacccatctcttcaagttaacatggagaaccccagtgtaaacgtgtttcacacaggttaattgcgtgcctgttaccgcatctgcagttatttatagaaggatgtgattttacggggggagaaaaccacacaggtatgtgtgtttgtgcacaccctgggctggcagcatcccagggggccctgcctcc

SEQ ID NO: 77853 - DNA, 1028 bp, Homo sapiens
agctgcctcctcccaccctcactcatccgtgatcacttcacctctgcgtgccctgggcgctctcccgccctgcctccccctgccgtgctgcagcgcgcgcccggtctcgggtgacgggactcagggtgagggtcagacggaggctccctttggatgccagtgtcagttgtcaggtaacagacgacgccgcggtggggggcgggcccccgggatggcggggtgtgccatgggcagcgctggagcaaggtggggacccagggaggaagggcagctcccacccagaaggctttttggggtgccaggggaagtggtaaagaatgttcgctgaactatgagccagggcccggtgcccctcggtcaggagtcccccacggtgcccccacccgttctgagagtcttgctcccagaatgcattccccagcctcccaatcccgcttctttgggttgtttagcgacagcttaattggataacacttaacatctgaggttttcttcggcccttgccactgccaccccctcccccaccccagacaatcccctgccccgccaagaccaggctaggggaagattccttggttgactgtgtacattgctggagccgtccaaaatgctgagtttctctttgggagaatgtgttgcccattagctttgaaaaagaaaaaaagtggctcaaaaggagcctcttaaaaagctgtggccacgagagggagtgaaacactgtgaggtgtgtgaggggtgggggcgggggctgagtacctgctgtgcgtccggctctgggccagacccagacacagctgtttgtgccgactcatcctgctctcccgggcgggcggtgtggctgcccattctacagatgggcagatgggccggtgtggtgacacaaactggcctctacctgccctgcttctccccaagtggaacccaagatcttattctgcctagggtctctgggaatccttggggtccttgggaattcaagggcaaagggccctctcacaagtctgtccccccggcatctcggcagggcc

SEQ ID NO: 77854 - DNA, 1032 bp, Homo sapiens
gccaacaaccaaaaaaaagaaaaaaaaatcaacaatgcaagaataaatttctctggttggaaaacaactttgcaaacttgtcaaacagtccttgtggcttgctgctgccaccgctgtagcgtccaccagcgccacctccttccccccgctgtccttcccccaccaaaaaaagaaaaaagaaaaaaaaaagaagcccaagataaaagagaggggggagagaaaaataaataaataaataaataaaaagggagaaacttgagcctcagagatgaatatttgtcaagagagttgacgtaagtttcatttgcataatgactttgtacttctgcattaataaaatttgcatatgaagccatgttaattactcctgatcatgctttttgcattcatgcatagtaattttctccgacttgtgagaattaatgtcttggcatggggggagggggcgcggggactgtcaggttcccttgccagtgtccctcactcacacgcgctgcctccctggctgtctccttccttgatctatgactcatttctgcactatcagtaggagttctcagcttaaaaaaatgtatcaattgaaaggcaccagtagggagaaaaatactcgtctcctgcacagtgtattccagaccacctctctccagctctgaacatggaatctgtaatcctcccatttgggaggggacgccccagaggcttcaggggtggggaaggctcgaattccccctgaaacccggatggggcttttccaggcgtttttgtgtctccacgctcctcggcggtgggcgtgttcgctgggtgagtgcgcatgtgtgaggaacggagcaggagcctctgcaaagtccctctagaagagagacgggtgacagacccctgtggaatgcttaaacccatgaaggcatcaagaatgagcttatctagcattgccctgttttggagcctaagaagaggcattttaggggccttatttttagactttttttttttttttttttttttttgtgcatagacctccaaagccagcgtttt

SEQ ID NO: 77855 - DNA, 1045 bp, Homo sapiens
gtaggcacccaatctgaagatgagtttcctggtttttgccttgtgtgacatgtgagttctatcttaactgtgtatttccactcccacccccagctctaaattaatgaagaaataggaacatatctgagggatgcctggccaagcttgtcattggagtctggcccctaagttccatctgggaaagggctacagggtcccaacccgaagtcccacattctttatgcttggtatccagatgatttatctaacactttacttcggtttgcagcctgccttcactcttcgttgagttattcttcatgcagatgacatgtagtatactgtttgtggctctggacgcaactggagagaaaattactgaaggatcttgaattaaattgtcttagaaaacagagactgctgaaggttgaagcagctaccacacctctgatcagaaaacctaaattgagaggaaaaggggcaattcctccattaggtattgactggctgattttgctggtgagatttggagaatctctcagttgcaatttgtccttgccctctgtggactctggttggatgcgcgcaagacatcttaacatgtccacgttgctgatagatgagtgtttgtgtgtgtatgtgcacatgcatatgtatatgtatatagaacctctcttatagataatagaagtgcatgcacacatttttctaaccagtgcgacacatggcttcaccttctgttgtcctcaggcctgcccattccaggatggtgggccccaatttggtggaccctgcctgcctgaggtcacccagaggagttatattcatttttgtatctgtgtcctgaagccgtgatgcctaggagcaaaggaatgatcagcgtcccggctggaggacaagtgtttgtggtttatttgcatttcagtagttcggaacactgcaggattttccccgagagacaagcaaaagaagagtccaagctgcgtgtccctcactgcgcccccctaccccctgcaaatgcccacttaggggctggaacggccagccccctccacctccgtggttc

SEQ ID NO: 77856 - DNA, 1009 bp, Homo sapiens
ggagcctccgggagttcccttgtacaaaaatgtgatcatccaggggcaacagccccatctcaaagtggggatttcgtggggaccttagtttctttccgagtgggagaagagtaagcccgcttttctcaaggacaaaagtgttttcccaattgtgtgggaatggaaccctccactggagtgggacaccgaagctcctggaattacagggatttaatgtcagtcctcctttcagcctgacttctcttaggataacctcttccaacaagaatttgtatgcaaatcgtcaccttgctaggagtctctagttttgtgtgttaaaaattggcctccaattgtttaaagcacttcaacaggcccttaaaggcccagaaaagcagtggttggacgcccagcctgtccaccacaaagctcttaagaaaatgttcaaacattttcccaaagctgttactctggaaataaaactgtatactgttcgcctgtagccgattaaaagtttaccttcactgtgacagcttttccaggctaggattggacccacatctctattttccatttttcagaaataaatctaaaccaggcagaattgatttgctataacaagagtcaaggtagtattaaaaatatgcgtatacctatatacttataatatgaaatagtatgttacacttgctgggctctcaaggcgagtattgtgtaaacggcaccgtcatggcgttttgagtaagagttgattttaaaatctcagatttagctaacccgaactttgagcagccagcttttctggtagaggaatctgaaggcatttgtcaatttattttttgcaagccctccggaaaaggtaacaaattcaacacttgggagctcaaagctactgccagtcctggacaggaaggttttcatatctgtctgaacttgctcgctgatttctcagacgtccatttataacagtgggtctaacaagatagaatccgcctttgaatatctgtaaatacgggtaaagatcacagtc

SEQ ID NO: 77857 - DNA, 1028 bp, Homo sapiens
gacatcctggtttttatagagcacaaaaggaagcagtgtggcggcagcttgggtgcctgctatgacaaggccctggacaaggacagcccgccaccctcctcacgctccgagctcaggaaagtgtccgagccggtggagatcgggatccaagtcacccccgacgaagatgaccacctgctctcacccacgaaaggcatctgtcccaagcaggagaacattgcaggtatgggatgctgcgcttgcctggttgctgtggaagccacctcctgggtcccatgccctctgcctgagtgtgctggtgcaggggaaggcccaggggcttccaggatggcctctgggccaccagccggggctccccctttctgagggtccaccatccaggtgaccttcaggaggagacaggcctggggctcggggaggcccaaatggctgatggctgcttgcttttggtgaggggactctgtctcgggggctaatccagaggtggtcagaagcacagaatgaaaatttggaagtctggttggccctctctttgctactgatcttggcttagtccctgattttgaagccagacagttttgggttagagtttgtcttcacaacttggacatgttagtttgcccatctgtgaaatggagctaaggaaacccacctcattagggttgctgtgaggacgaatgagctgttgcatgcggcatgacctggtaggcacttaggaatgggagtgctcattctctcccctctcctttctctctggactcagtttcccatgtgtgaaatgaggagttaggccccctgatctcagaggttgcttctgacattgcccgaccccaggggccggtcccaggcaggggtgtgggaacttgttggagcactgtgcccgttgggggaggttggatatgccctttgacatgctcactcatttgaccactgggacagctggttttaccaccttgagaacaggtctagggcccctctgtccccaggcgtgggtctgctcaccacagtgagttagcatgaagtccctc

SEQ ID NO: 77858 - DNA, 1028 bp, Homo sapiens
ctttttgattaagattgccatcttgcttttaggcaaaacaaaccaattaacaaacaaccacaagaaagggagaagaggtgcctgtgggagattttgcagacctattgtgggtataggtattttcttcctggggaagaattcagttcccgtctcagctgtacttttgtgggcctgtcatcttgatgaccagaatgaaagcttgctctgcctcctgccagccagaattggtggcgggacttggggatacagcgtgaaggtggggaagttgcacagcagaaaacagaattgaagttgggaaactctagagtctgggcaaaatgtttggttttttctcttaaaaaaaataacaccccattaccaaaagaaaaggtaaggtggcaaccttatttttaatagtttgaaatgatgataatcctaattatataaaaatatatatataaacacacatatatatagtgatttctaaagatttgtttacttttgtgttttgttttactgtactaagaacttgtcctttctccttgaatcaaagtaggacatgcatcatcctcctaattttaaatgttggctctgattttaaagtggtgcatttgattccagccttggtaatggagagtttgcaaacacacagcggcccacagcttcacgtggtggtgtgcagtgtgaggcagctccttggctttcctggttttcacaacaagctagagattttcaaagctacacttttgagtaaaaacccttattaaaagaaaaacatgattaatatttttgtctattcctttttttggagtgggacaggccctgtgagtttagcttttacacaatccatcttactgcccaagcattgttggaaccttgacctcctgccctgggctgtgctaacctgggggctactgagacatagccgtggggcccagaggactgtaggagcccccctcatcagcgtgcccatctatgcaggcagcgggaactcaagaaaaggagtccttaggatttaggggaaggaaaaggttgggaccatgtccttg

SEQ ID NO: 77859 - DNA, 1036 bp, Homo sapiens
ttttaagattattcaatacttttttataatttataattcacgtgatttcacaaacatgttttcatttgtgctttttaagttcactactgagccactaacttcaaatacatctttctcatttattcgttccttcactgatgccattcacccacgtgctgccctggggctacatcagtgcccaagatagacaggatgatttttaaatcagtgaagttccctggcagatggggtagcactgtttgatttaggctgttctttcttgttttgtaacatttccattgaggtataatttacatacaatgaaaggcatacttctgaagcgtacgttttgatgtgagtgtctggtcatgcgaccacctgcccagtcaagtgttagaacctcccgtcaccccaaaaagttccctcatgtccccatccccagccgttgtgccctctgtctctatagttttgctggtttagacttcttgtaattaattttgctcttgttttccaggaagataaatccgtcttgaaaaaccacgatctttctgttcgtgcaaaaatggccatcaaattgcgcttaggtgagaaagagattttggaaaaagcagtaaagagtgcagctgtcaaccgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagaggcaatcagcaaagcaaaggccacagaaaacgggcttgtaaacggtgaaaactctatccctaatgggaccaggtccgaaaatgaaagtctcaatcaagaaagtaaaagagcagttgaagacgccaaaggatcttcttcagacagcactgctggagttaaggagtagctcgaggtgaagctggatgggggatccagtggagcaggagttgacggacagtccgttcacatcgctgtgtttccttgttaacatttttctttctgc

SEQ ID NO: 77860 - DNA, 1064 bp, Homo sapiens
ttagagtaaataacattgcaaacagaatctgtgtagaacacaaaatgttcctggctacagcctcttatttcatgcccagaaagagttaagtatttgtattgagcatctacttttatattagcttaaaacaagtcatttggggtttcttatgctgagatttgacctctcgtggttgtgtttttatttttcatcctaaaatgtatcttacaaatttcctggccctgaggtttcatttttaagagagagaaagagagagagagagagagagagagagagagagagtgtgtgtgtgtgtgtgtgtgtgtgtatgttttgctgttgttaactaccttaaatcctgtacagaacagtctgagtaggaatgagtaaatgagtgtttgagtgagtgaacagacgaacaagtgttctggaaggaagctgcccaagcacttccttggtcggaggaagcagtcatggcccatgtgggggaagctgctgtgctcggcggtcactggctttggttttaatgtctggatccagggagcagtgcagcacaagtccagggtttgacgtcatgctggaggcagaaaaaacctagtcccgaaacaggagaggcagttcacacaccaaccgcagaacccaaactgagatacagtcattgttcctcataagcaaccctgtcgctagatttacggttattcaagtgggagcttttggtgctttttgtacttgggtaatggttcatcaattcaatgtaatgaacacgagttaaggggttaactgtgagcttttcttgcatatatatggatacagaattgaatgttgcagttcatgtactcaaggcatttataattaagagaggtgatggtgatgatattccttgaatttgtgaagcattcactgtgcgccaggcatgatgctacatttggtacatgctcagttttaatcccatcagccttgattgggaagtgctcccattttactgatgtagattccacttcaaagagggtaagtattagctgggcgtggtagcacgtgcctctagtcccagctactcgggaggctgaggtaggaggattgtttga

SEQ ID NO: 77861 - DNA, 1711 bp, Homo sapiens
actgctttacagttccagaagagaccctgctgtattaaaaggacaggaagaacttggtgaattttaaaatacagtcttatagtaatagccttgctgtcctttggaaggagaagaggtttataatagaggcctggtgaccccaggtcacctggggtcctttgagtactagtaaggcctttggtggtactttctcctggcctcccctctcctctccacacggtggtggaagtgggtgcttggtctcagacagtttggaaagttgggaaaattgcacagcttcacccttgcaacctataccaaacaggtgtatcaatactttcagctatttagtgtctaaatgtaaagtagcactaagcctctgccctgccctgtgttaagaatacatgccaagtttgtctaatgcccttttcttttttctttactgcatctcagatttacattttttatggcactcgatccaacgcagagtttgtgatccacagtggttttttctttgacaataactcacacgacagagtgaaaataaagcttggagtgagtaaaagtgacagactctacgccatgaaggccgaggtcttggctcgtgccggcatccccacgtacgtagaaaaacatcggttggccctttcttgcagtacttgaactatttccagttgcatagtgtttaattggtgtgttaataaaacttctctccagtagtttgtcttaatccgtttatccccgtggcacagcaaatttaagccatggcgacgcttggtggcttaccagcgttttcaggtaaacataattgtgtcgttgggcgcattcacagtcagttctgggggatatggcctgaaatcctcattaagttaaataactactttcgtatcattcatgtctttcaccttgaaaaggttaatggcctggatcaatttgtttcatttaattcgttgctaccattagtttctgtaatgaagtcatgatcctcagtgatttcaagaatttctagttaagttctttaagattttcttgcatttgaggcataaaatgataaagaagacaggaattaggattcattagttctccagggaatagaggaaccattcttaatgaaaatggattatgcagaccttttttttattgaacttgtcaatatttgattaatgattaaagtgtgaactcaacataaattattgttaacactttttaaaaaccatgtgtatgtttaatttttgaatgtattatgtgcaacctgagattacagctgttaggctctaggaaaagcttgtgaggatggtctccaattctggatgtccgcttgcctccgccccagcctgcggccttttgcaggggctgaaaatcgtgctcacagttgagatgaggagctggaatgacccattccagctcagctctccttgaggacaaccacacgtgctgtagacttaaggaatctcagtttggagcaagtgggtaaccgcagcagggtgactgatcttgctttctgcttttatcagttccagtgtttttgcattgcattttaccgagccgcccatctctgctcagcttttggcttttctccgagtattctgtatgactgaaggtaagtcatttcaggaaaaaagagatgttgacttttttctttttaaatcatgaaagtgtaaagcatagggattcagattaaaggtaaagtggattaaaactacagtacttttgggaagagagaagatacaat

SEQ ID NO: 77862 - DNA, 1114 bp, Homo sapiens
ttcctctaacctccctcctgtttgtgctgctggcaggtccctgtgtacctgtactgccagcaccctgggagtgcctggactccctcctgggagttcatgatatgggcagcttctcattccactttgttgtcaaggtgatgttttggggtcagaaaagtacatccgatgttgggcaggaacttcatggagttgattttcattcaattgaagtgtttaaaatgttctgcgagtgaaatgttctagaatacttggcttcatttatttctcattgctgcatatttatcactggtctttgcagatcagaagcatgaaggaaatttagacatatggttaataaaccatatttattcttgggatattgagtttaaagattagtgttacatggccttccatcccaaaatgccattccctagactcagaagtcatcttttgaatccaagctattgataccttattagcaaggagcacttgtagctgctgtgaatctttgattctccaggataaaatgagtaggtcaaaaagtaatcagtgaccatcgacagacaacctaagagattgggcgctgctctaaaagacaggactctgagaaggaggttttaatagaagctggggaccctttcctttcccctgcgggttcatgcatcacgtgaatattctcaaagaccacttcaggttttaggttctgtgtgctgagcactcgggacacagagatcaacaaggggctccagcttccaagtgtgaccgacggggaggcaggtgcacagataacgtgacttgggctggagcgcataaggactgggctgtgggagtgcacaggagggcagggtaaggaggggcttccctgagaagccaggccacaacaggagtagaaggtagtgtcaggcaggagggaactgggatggcaggtgggtggcagttcctgaagctggagggaagcgtgagccgcctccttattcggccgtgctcaggaacttggggtttattccgaaggcagagcggaatcataggaagattttgaacaggagagtgacatcgtacaattagcaactccagaaggacagtattggattttgagactaggttccaagagttggaaggtttttgcaaataacaa

SEQ ID NO: 77863 - DNA, 3156 bp, Homo sapiens
tttaattcactgcacagtgtaataaaaaagtcacattttacatttcttacaattcacagaggatttctgatcagaaaggagttttatggtttgcttttcaatgaggcttaaaataggtgcagagtcagcatttgggcaaaagagggttgggttggggggtgtcggggagtggattttgtgagtcacgaagatccgggaaggggcctgagccctgcgcaaagccgtccttctggctctgcttcttgggaacagtctgccttaaacactcactcctgcatttcccctggctctttcaaaccctgggtttgtttttaaatgatgatgaaggccaaacattacctttgttacttaggaaaagactttgtacgtttgtaagagatcaaacctaaatttttggttatgttatttcttactgcaattggcttttaaatgttccaaccttaagtcaccatttatcttgttataggtgggcagtctcttctgttatgacgaggcaaaaccaaattcccacagaggatggttcccgcgtgaccctggctctgattcctttatgggatatgtgtaaccacaccaacggcctggtaacgacctcttcccctgtgttgtgttgaatctgggaggctgttgttgctaagctttgggagggggctgttattccacctacccatcgtactccccccgttgcctccctccaaaaggaacaaacaaaaccgaaccggccactcctccccaccgcccacagatagaagctggtatttttcttttactgcattgactaatactgaaaactgggagcttgaatcttataccattttcaaaagccacagtgaactacatgtgtttgctaagccataattccagcctcaacattcattttcttatcttattgtaccacagactaaaccaaagtttctttttacttattctctttaaaatgctcatttattggggaaaaaaaatcatatttctcattttcccttttgtgtcttcttttctttgctgacactctgtttccagttctgtacctttgattctttcttgtccccggtcccttcccctgatgggctgacgaatccctggccatgtttatgaacctgtgtttgttacttgctttccctggtgctgtggggcgggaggagggggctcatgccttgggctcctcgcccttgactgcaggagtcagctggcatcatcatacctgggaagcctggggaggaggaagttgtattattatggtcccccacagctgggaagaggtggaggcaggctctgtttctccacattcttcggattccgggcagcagcataggtgaagcgctctgtgctctgtgagagggttgtctgataaagatttcctgatattagtaggcagaaataagatacatttcagatcattttgaaatatcatactttatactagtatactgtttgattaggttttatgttcatcttttctctgtcagctttccttgttattagcagtattataaatagaataaagaaatgccgtgaatgattatttcacattgaattccctggaatggccagaacacacgtagtgtgcgccagacactgaagacagaatatcctagtgctaatttgggaaggtctagcaacaagtatgttcttgaatcttaaaagtatttaaattgtggcaagaaagaatagttccatttttataattacattttggccttaatttagatatggttaatttaattagtaatgaatactaaaacataatagcatgttttataacttattttcattaatgaatataattttacattttttgttttgtttttcttcagagttattttaaattgacggtaagcttgaaatttaagaaatcttcaaatagcttttaatatctgactgtagtgtttttcttcttctttttttgaatgagatcatttgttcccaaactcaattgattattagagttctttttaataaaattaaagcaataatgcttggctttactctaaacaaacaaaaagaattaacccaggaacctctgtagcaaggtgagcagtgccctacccccagccccacagtccacctgatggtgttgaggccgccaccaggccaccgtggtccctagcgaagcttccatccattggcacctcacacactcatctgcacattggtttttgtttagcttccatgtaaatgggataaaacaattcctttttccctaccaagtgttaaaaaaaaaagaggtttatctcaaaataaagaaattgatgacaaccagtgctgtgttttccctaatacgactacatactttttaacctaccacagtcctggcagaaacattgctaacctgtagaaggtttattcaggatgctggtactttgtcttacagtggttatgttcctgacattctgcactctgcactcttgttgaactgtttcccattgtaattataagatctcatgggaaatttactggagtagaatttaagaaattctattttttaacactacaaagttgtttatgatatatattacagttaatgtctttttaaaaataaagtcttgaaatcaaggcttggcttttaagacgagattttcttttttgtgtgtgtctatcctgacgatcatcttcttattgtcagtctaccctgactatcactcagggagtaggtagaatttgtaacccagcaacgctgtctgcttctaacaatatcccaaaaacctgattatggtagtagaaacagaagaatcaagtcagtaacagtaattccaaaccagtgacagcaaggaaatgctaaagaaagtaaggggctggatgaacacctaggctagagattctggtgaatataaactaatttcctagccactcagagaaataaatgtaggaagggttataaggtgtggtactaagctggaagaaacaacacatctttatatcttgcatgatttgttcaaacttaatgtaagcagcaggtttcctttgttgaggatttttcggttgatatgacaaggatacttctaagtgactgttagacagtggtattagttcccatacagagagtatgttggaataatcagtgcttgcatttgaatctgcgactctaccaggtgggatgaaagggcagctggaaattcaggcacaacggagggaagttctttttcagggtccttctgtttg

SEQ ID NO: 77864 - DNA, 1006 bp, Homo sapiens
agtcagtcagcagattgagatgttgggggtgggggtggggagacaggtagtgtcaaaaggcaaagaaacgaaagatttactgtctttaaagaagacagcagtagcttgtctgcacctcccacccccccccccccccccccccccccccccgccctcgcctggctttttccagtgaggaaatggcagcacaagtggttgggcagcatgcttggatgacctggcaggttcccagcctcacctcttcgaagggtgtgtgctacatgttcggggtgagttgggggtggggcgagatttggtgaccatttggtacagaggactggtgggcttgatctgtgttgttgtttctctttggattcttagaatagagctttctcaaatgtgtttaaagagagatttggggaaaaaaatgagaagattctctggcccctagatggtagaagaatattctgttcataagagggaacataggatagaaggatgtggaaagctgtgttttttgaagcctatggtcactgccttggtgtggcaggggtgcccacatgggctggagctttctgaagaggaatgtggagatcagattcccctggggttgccagtccctggtgcagcctctcagcagcacctttggagtcatagctttcctccgctgtcccaggaaaaagagtagaagtgtatcttgtcacttggagaaagaagatttttttgtcccattccagcaggtgtagttaaaaataaattttaaaattttaaaaaagaagaggaattctttgaatgaggcactgagcaaggcactggggactcacagggggtcaaagaagacatggtccctgccttgctgagcctgcctgtggggactggaggggaagagatgctaatcaaatggccacagcgcatgcagttgtgaggggcagactgaggccagcgtgggaaaggcaggaacagggcaggaggatcaacagggacctggagattggagaaggtggcccggaagaagagggatttgcat

SEQ ID NO: 77865 - DNA, 1036 bp, Homo sapiens
tcagctcttcctgggctcccctcatccctgcactgctgagaaaactgagaccatgtgacaagaacttcctttccttttgtctccacctgggtttcttatgtcctcctctcctcccctccctctgaggaagggaccccccttagagctaagggaagccctggggcctggtcaggaactcaggtcaggagctcagcgacattggccctgtgttttcactctttctttctgtcctggctttatccccttggtttacagacagcccccatgcctttgagatgatgtcctgtctgtcttccacctttaatcacaacatttatcaagaacattccacactgagagttcttccagccccagcagcctggctctccccgccctgaagtgtgatgccctctgggagggcctggggtctggcttctttccctgcccagtcccctcatcctccccacgttcctgcttcgttcttcctgctcttctgaatctccaggcttttctgaccctaccattcctgtcccccgaatgtaagagctctccaagtttctgggctccgagttgggagtcagctgacctggatttcaaaacccaattctgaagtcttttctcatctatgactatagtcaaacatcttatagtaaaagatagcttaagtcagtctattggatttcctgcattctattccaggtggacaatttaataattacctgttttctaggtagtgcttaaaagatctgcactgattaaactattctttcattgaaaatttgtttccagaaattgaatgctccaacaaaatggtatcattcttaacaatgtgagatagtatttcctctggaaaaaaaaaaaagagagtgaaatccattttaccactattgatcagtagagcatttaatgaagaaaatataaggcaaagtatgatttttatgaaaaaggaagtaatcagacttgaattttctaacttgtgctacttggatatcccttggccgttctcataagagaaaccaggtacaggtgggtgcactctgtgtgatttggccttgct

SEQ ID NO: 77866 - DNA, 1772 bp, Homo sapiens
tttcttccaacctacgattatgacttctggggaaaataggaagtggcaatggtgaatatggagtcagttcatatttatcagcaccttctgtttgccaggtccagcaggagagctaaggactctctctgctgggtccccttccgccctctccccacattcaggcctcagctgctctgctgctttccgtgctctgcacaccccagcacctgttccctgttgttgcttccttcctgtttgtgactatttgtcagtgtccaccatccagcagacaggaagatctgtgagggcagaagccaggtctgtcttgctccctgcttttccacttcactcagagtgggtgctgtgaatatttgttgaatgagtgaatgaatgaatgaaatccatgaagcaactcaggagcaatttcacgtggcataaaccagagtgctacgtggtattttgtagactgcatgggttagacatttagaggtcactggaggtcatatgtagatttgaaggcaaaggaatcttaaaccttgtcttaggatttggctaagtggatgggggggcggattattccaataattggattattattccagtctggaaagttgtgaaaatgtgtatgtttgggggaggagggtttgaactgttttccacaccaagttttttttagggattaataatctaagattacctctaggttaatacaacagcttgttttttttagaaattaaaaggtaaataggaaaaataatggtcattttgctgagcatagagtcttaactgacaaagctaatgatctggaaaaacctatgttggaaaatgtcactttattatatatgtctggaagtacagatgggaaaacagatttttttctttttgcagtagattcattaagtgcttaagaagagattctcttctgtaccatctttacagcctgagtaattggaggctaaatctaaactccacattgtcttatgtttcttgcaaaagaggtagctggattgctattttctgacacttaaatggaggtccatttctaggcatctgccagtgccttgcttagagcgagataatcccttctgcacctgccgtgtacaaagcgattatggcagaaactaaagactaataacagctgacgcctactgactgcttactgtttgctgagaatgttccactgagcacagaaaccttaggcacttgctccaggtcttccaggttcagagctggcgctgggctttgcagggctagatgccaggcaggtgctctaaccacttggctctgctgggccacacggcagctcccagtgcccgctggcaggcctttcgtgttcttgcatgcgcctaaccccttgtggctcctactctaggagagttaaataccaaggtgtgcacgtggatggcggagttcctccttgaacctctgactttggcaagatagttggctaaccatcttgtagagggtaggactccttagttcagcaaacctgctagagtgttattttgtgtgccagtgcataaattaaccattattatttatagtcctgtttcttttggtctggtgcagtttaatttaaaagaagtagggagaagtgaaactggtttgctgtgatttagtccatcagccctccctctggactgcctcatccctcctgttctatagggcaccctccgaagccccgtgtcctccccaccatcccctttctcagcttctgctcccgggtgctgagtgttgtgaagtttccaggtgccataacagttagtgcaaggtgagtctagccttctcagcct

SEQ ID NO: 77867 - DNA, 1093 bp, Homo sapiens
ggagggctttattcagagagcagagatctttctttactcttctcctcctcagtgggagccagtgctaaacttggttcctggattcaactcgagtgagcataagtcacctgggaaacttactgaaaacgctgtttcctgggcttccctctctgggcccatcaggcccatcttgagccatcaaggctgggctcactccccctcccctctcgtttaatggctgggggtagtgactgcttgtctttggacccactccagaatatcttaccatttcctctatacttcacagttttcatctgtttcaaagaatgaaaacaggtgtgtggaattgaggagaccaaaataaatccttaagcatataaggtaggccttatggaggccttaaaattacttgattttcataagtaactttgggacttaaaaagattcagatgggtttctatattggatttgcttctgttcaagactcctggtgttgaggcacctcttcctcacgttttaactagccagtgtctgtctggagtacagagcacatgtttcaaagaacttggatatatccaaaacccataaatttaggactgaaataggatgttagttatcagatgactgagtgaatgctgaacatatatggaaacaaaagagacaagaaatggtataaccatattaatgacaatcatgaaacagaccaaatgcctcgcaccctaagcaaagtctcttacatcccgtttaagagaatcggggtgctctgtttatgtttagatttcttggcttctttccattccatctcagagtttcccctgcgtctcaccagtgctccttttcttcacttttcttttcttgtccagcctgtgcccttggtggtgtgatgcctcctgtgtctgtgttctgtcacttacttgccctcccttgtgtctttcttttttcttcatccttttaaatcctcttctttttttcctgcaaatatgtttggttcctgtgaacagaacagttcagtgcagaagggcactaacatttactgggttcctggatcatggagtggagatcccatggagcagaggcacaggcagcacccagggagcatgcagtgagtgagaaa

SEQ ID NO: 77868 - DNA, 1281 bp, Homo sapiens
ataagaatttgtggtggtagagtggtcatccagtgtgtgttgtgggatggcagttgctttgctgtgtgagaatgaccctggcaaggggatcagttgctctaggtttagacgctagggtcttgttttaaaatccctactactgtaatcccagcactttgggaggctgaggtgggcagatcacctgaggtcgggagttcaagaccagcctggccaacaatggagaaaccccgtctctactaaaaatacaaaattggctgggcgtggtggcatgcacctgtaatcccacctactcaggagctgaggcaggagaatcgcttgaacccgggaagtggaggttgcagtgagctgagatcgcgccactgcactccagcctgggcaacaagagcaaaactctgtctcagaaaaaaaaaaaaattcctactaatgcatgttgctattttaggccactgctggctccctcttgtacttttctgcgtttttgtgaatggtgtgcactagaaggagtgctagagttggaatcagaactcctgcgtttgagtcacagctctgcctgtaaatcacaaaggggtggcaggtcacttggccacagtttctccatgtggtaatggggttgccaatcactgccttaggttggtattggaaagattggatgagaagtatgagagcacttcatgaagtataaatcttcacaaaaatgtaagggacccacttggtggaaatacctatttaacaaaatccctattatgtgttatatttgtgcagagacagcacttgaggtggttaggtgaagaggattggaatctcctgtactttctggttggatgacctggggcagggcttttctgggccttttatctgtaaaacaggagtgatggccactgtgtggtttacatttgttaatacatagaagatgcttaggacattttattgtgtctggcacacagtaggcactcagtgttcattgttacttttattgttactgttagattagagctgatttgagtgagtgaaatttaggacctgccccatgtctgcacatactgaccagtccgctggacccaggtgaggtttgtcctggaatatttagtcctggttgccagccctttgtgggcaggtgggcatggtgctcgtggaggatctgctgtgagaggagaaggtggcgcctgggctcagcagtgccaggttcagtcactcgctgatgcatcacctgcttcctctccctcatttcctcagtggcgccacgtgagcccctagaggcctgagagcaaactcccttcctgg

SEQ ID NO: 77869 - DNA, 1245 bp, Homo sapiens
cagctacttggaaggctgaggcaggagaatcgcttaaacctgggaggcagcagttgcagtgagccaagatcgcaccactacactccagcctggacaacagagtgagactccatctcaaaaaaaaaagaacttttaaaatatatattttttaactcaagatacctgaaatatctattaaacatgtaattaatataaaaattattaatatattttacactgtttttataagttttggaaatccagtgtgtattttggggatgtatattacattattaatttgtaaaattgtaaaacacacataacatgaaatttgccattttaaccatgtttaagtatactagtgtcatttattgcattgacaatgttgtgtaaccatcaccaccatagaaaatttttaatccccccaaacagaaactctgtgactgttaagtattaactccccatctcccctccctgccattgcctgtctttaacttggctttttcttctggatgcgtgtcctttacaagatacacattttgtgattatcttctagtttgtggtttgcctagtcactttcttaatgatattatttgatgaagttcttaattttaacaaagtctaatttatcagttttattttttaaagatagtgctttttgtgtcctttataagaactccttgtttagcccaccggttctccaccaagaatgactgatcccttgggggaatagagacattttggctgtcacacctgggcctggggtgctgtaaacaccctgcaagacagaggacatccccacagcaaagagctgtctgtcccagagtgtcagcaggttgaagctgggagcctctcagcatgagatggtgagagtgttcttgtgtgtttgctactggaggcattgttgctttgtgtgtcactgttacgtctgcatccatctcttcttaatccttgtagatgtgatgagaagaatttaagagaaatcttggtcattccacatctgtgcccttagacttttgtttagaacaaagctcagtacattaattatgggagctttatgtggaccatattagcatatggaactgaagttttgctttttggtggcttaaaagcaatacttaaagtgtgaatataaatggcttggcatttgcagaaaccagagatttttttcctgctttgattcaattattaagaacttgatttagcatttttgtcattgttgctttttaactttcagattagaattgtaatgaagactgaaatact

SEQ ID NO: 77870 - DNA, 1446 bp, Homo sapiens
gttaaaggcactgcttcagctccgttctgttgaatccctagttgacaagctatcgggaagtaagacacatggggagaagctaaatgtcaataaaatacttgaataacagctgatcacaacaaaggattttatcagtcagcataggattaactaccaaaattctaggtagaaattgccaagaaaacttgagaggcaggaaagagtcaaatgatttatgagtttactacctaaaaaaatatagctatactttaaagacaatgacagcttccaaacattgagcattataaacttttaaaataaggtttattcatagtctatgaataaacatgacaatatgcatggcaaataacagaaaaggatgaaaatatgtacctggtggtaaatggtatcagagtaataacgaataggcctttgactactttgttaattttttaaaatagctggtattaatagaataaaaatataattttttttaaaaggctggggccagttagtaaccctcctatagcaaagatgagccagtttggggagttttctgtcaacttttaattttttaaaaattgagatttaacttgtacataatgaaatacatgtatattaaatgtaggttgtttttttttttttttttttttttttttttgaggcagagttttgctcttgttgcccaggctggagtgcagtggcgtgatctcggctcatcacaacctctccctcccgggttcaagcaattctccttccttagcctcccgagtagctgggattacaggcttgcgccaccacgcccagctaattttgtatttttagtagagacggggtttctccatgttggtcaggctggtctcaaactcctgatctcaggtgatctgcccaccttggcatcccaaagtgctgggattacaggcatgagccaccacacccaggcaggttagtttttgtactcaagtagcacaaccaagatgaagacatggaacatttctagcaacctagaaaactccccactgtcttttccccgtcagtgccccgcccgtgtcaggggtaagcgctcttctcattctgtaaaactccccactgtcctttccccatcagtgccccacccatgtcaggggtaagcactcttctcattctaaggcctttgggtgctttgcctccttggggtttttgcgttgggggagcatgcagtagggactccttggtctctggcttctttggctcagtctctggaattcacccatgttgctgtgtgtagctgtagtttattctttttgaaaatttctgtatagtttctcactgtatgaatgtaccagttttttatctgttctgtcgatggacatttgggtggtttccagtttttggctattacaagtgaagctgctagaagtaatcttgtgtttatcttcttgtggacatatacattcatttcttctgggtattctcttgggagaagaa

SEQ ID NO: 77871 - DNA, 1272 bp, Homo sapiens
ctcccagggttgcctgtagtgcctgtggctcccgccaaagttgggatcaagtggctgctgctttagcagttctctttgtgtgatacgtgctgaagccactcggatgctctgagcctcagtttccatatttacaatctaccctctgtgacagacttgtgaatgtagctgagctatcatgaatataaatatgttttttaagtacaatcattcttctgatgtaattaacctgaagctggatgtgagcaccttcctatgatgttggaaagcaaagtccctgtattggatgtaaaaggcaagaagatgaaacagaaaggcctgttcacggtgagagggagaggactaggtcctgaagagcctccagcaagccttgccaggtagttgggatcttatcctgtaggggcacatggtcagactggcactggtttggttgcttgcttaatgacaaccccagcggcagggaggtggacggtttggaggccataagactacttagcctggtgaatccgagaagtacctgcaggtagaattgacaggatctggtgacaaactggatgtgaagagttcgggagataaggatgatcttgaggattctggaataaattggttttaagtttaccttgcttataacatgacattactaacctttctctgttttgaagctttatggtctagaatggaaatcttcaatgctaaattcctagcttattctaacttgtctaaaccagagacacaccacaggtaatctactatgctttgcatccgagctttcagttcagacaggtttattttattctttggaatatatatttgaaaccttttgtatgcagaagtcaagcctagagcaaatttttattcttaaattataggcttgtgaaagtgaaggttttaatggaagtgctcacccaaccttaaccgtagtgacacacacatggtagcatgtctgaacgaaaagctgtcagaaagagcagatttcaatttaaatatatcagtgatttcaagaccagctctaatgagtttcagaacctttgtgtcagtctcatgttttttccttaaatgctctgaagtcatttaaaattaataagccagtttttatttgatagagtttacaacagaaatgctgccatcggctttgaagtccttgttcttgtgtggtctttaaagtgaattagtggctgtggtttctggaaccagaaggaggttggcttctcatgaatgggcatgtgggctgacctgagggactgcttatgtacagttagctggtatctaaatgca

SEQ ID NO: 77872 - DNA, 1342 bp, Homo sapiens
attttcatcatttccataaatgaaaactgtagctatgtcatttaaaagatctgtgcttttaactatgttcttgttttgtaaatgttatagatcacatggagacttcaccttctgtgaatttagtgttcttcattttttctattttgtccagctttagttccagtggcttttgggggactgaagaaatgaaatgggctgggcacagtggctcacgcctttaatcccagcgctttgggtggctgaggtgggcagatcacctgaggtcgggagtttaagaccagcctggccagcatggtgaaaccccgtctctactaaaaaatacacaaattagctgggcgtggtggcgtgcgcctgtagtcccagatacttgggaggctgaggcatgagaatcgcttgaacccgggaggcagagttgcagtgagccaggattgtaccactgcgctctagcctgggtgacagagtgagactctgtctcaaaaaaaaaaaaaaagaaatgaaatactttttctttgtccttggggctctgtctggggtcttctcggtggtgtgtgtccctgccttggagcctgggggagggtgcccctagtgtacactggtgtgtccccctgaggcgggtttgagttcccaggtcagaccccagcatctgcatcctgccctcgggactggcaacgcttctgctctgtcttcctcgctgacccttctcactggaagtcctcctattaaaccatggccttcctcctcttcctcatctctttacctgactgcggtccttggcccttttaggaaaagtgttgcttttgtcaatcagtttgggagctgatgtccagcaaagtgatgcacgttttccctagcctcccaccttacctgtgacgcaggtgtttgcatgggagtagaggcacccataggggcatggaatacagacttaaagggcaaacagttaccatggagtcccaagtgatataacttggggctggcatcctaaccaaggaaggttaggcaatgcccgctgtgggctgagcacggtaagacttttcttactttctattatataaggaggtgtctgaaactataccttcctagaataatctgagacagaattaaacaaattagaagaaagctccaataccaggtctaggctgtcattgatcgtttaatttgtgtactgagaagtcagaatagaggccagaaatacagggctttctcctaagacagtgttccttggcgcctccaaatgccagtggtgggctgagggccctgacagaggctccctaaccctcgctgttcctccagagctgggcaccgtccccattttataagtgaggaagcaggtgtaggaacagga

SEQ ID NO: 77873 - DNA, 1286 bp, Homo sapiens
tttcatgaccccggcacttttgaagagcactgctggcctgaccggttactttgtagaggtccctcagtatgcatttgttggatattttatcatgtgtagactgaaattacgcattttatgcaagaataccatggaagtaaagtgtgtccttctcagggaatacatgaatcaatatgtctttttggtttttccatcagaagttactgtttttctcttataattaatgaataccttatagaaagatactttgagactatgcaaatgtcctgtttctcaccatcaaatatcctgtttctcaccagatgcaaaaacctgatagatactggtttttgtatctatcatgatttttgtctgtaatagttactactgtagtgtttgccaagtggtgattttctgtctccgttatttcttctacatgcattcattgggattttactaaaaggaagagctgtcccttcttccacatttatttacttattcagctgttcatatcggtatggactcatggatatttattttatttgatagactatgtaatccattactatatatttgatacaaaaatggttttagatggctcttcatgtaaagatacctgatttcctcgtcactgataatttgagagtatgtgtcttgtgcagtttttgcatggagtgcttaataaaaaattgctgaaattgatgcataacacagcagatcatttataaagttcacttggcctcagagttccaagagtgactgtggccactgcttcctgtgtgccattttcctgacctcagtttcacttaaatgtttccctagaagcaaacgtgttccatatgtgacattttttgttctcagccaacttcatggtaacattgcatctgctgactgaggggtatgagctacaaattgaggagggacagaatagagtcaaagatgatggtgagggtacaaggcggtcagtttcataggccggaggtgttgaggttgatgagccgtgaatctagatttaatccttgcattctatggtcatgggaactgggtagatattatggggcatagaagggaaagaatgatgtctgttttcaggttgttcatctaggttggctggaggacttttccagtgaggtaagcagcattcttcacagtgtgcccctggaactgttctgtcggagcggctcttttccacgtcgtaggaaacccgtggctgcagatggaagacactgcgtgagaagggggctgaagctgtgctgagagctgcagatgacgcttctgccactgccactgccactgtgacagtggat

SEQ ID NO: 77874 - DNA, 3053 bp, Homo sapiens
agaggaaggaatgttactctggcttcaaaactcagtagtagtagtaattcacatcgacagattagggtttttgttggaggcaggaattttgttttgatttggtctggttttagaacttaaaagtacagtaaagtatacagtaaacgcctttatgctctactccaaatgttatatttgcttcaggttaaagttgaaagtcccttttttgattatttgcttctcagcatatgtagtttttagtttttctgttggaaacaggattttaagctatacttctactcatttaactataagataaatgcttacattttaaaatgtatttgaatatttatttgaagtgctgatatgcagccttaagttgtacttcatgtgtgattggatttctgaccgtagatatggttggattgaagactgtaccgtgttttgatgattctcctattattatttttttccctaggcagaagaattgtttttatgggttccacgaaaattgctaatgactgttgaatctgctaaaaattcagtgttgggtgagaataatttctgactcttcaaggcaaagcacaaatgacaaaaatatgtaaaattccattttatggcactaaggataatacttggtttttctcgactggcgaaatattccctcaaatatgcattaagtgtttttcatttaatgttataaaaaagatgcacatgacctttatttattattattattatttttgagatagggtctcgctttgtcacctaggctggagtacactggcaccatcatagctcactacagccttgatctcccaggctcaaatgattctcccacaggtgtgcaccactacatctggctaattttttttttttttttttttttgtagtgatggggttttgctatattgcccaggctggtctcaaagtcctgagctcaagcaatcctcccaccttgacctcccaaagtgctaggattacaggtgtgagccactgcgcccagcctgtacctgactttaaatgttacaagaccttttagtttttctgtaatttgtaaacgtatatttaaatgaagtttttaagaagtttgtggaacttacgctgttaacttctgggttaattcagggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccaggtgagcagctgtttgcaatttaagtatatatttcacagagtggggaggaaagaggaattgagtccataaatattccatttgatgtcttattaaggatacttaaacattttactttttaaattgaaaatataaaatacatttcatcgtttgtttttacagaaatatcaatgaaatgcggttacatatatatatctgatttcatcagtgcccagtgttaatacaagcagcagttgttcctgagttattgaaatcaccaagtttttttgtaaacaaaagatcacaatgaaattttaaaagccttaaagcatatctaatgcaataagttactctgtgtataaatttttcaagaaaatgagggttaatttttttctatatatgttagtgtaaaatattgacagttaatttagcaaattataacatttatgtttttcaacgtgtactgtgtattaattttaatttgttctcagtgaaagtttctcatagaaatctctataaggctccaagtatttgaattacctgtgatgacacctttctgtattttggtggtgtggccaccgttatctttcatttgcagttgaacagcagtcagaaggaacagggccagtaccacagtccccaccaggactgagaggcagtgtggctccttctcctgattctgcacaatctgaatcactcaagagtcagctcctgggctgctgttcttgagatacgacaagtgggcaggtgaactacttgctcgctttccttgtctttggttggtgtgacaacctgaattaggtttgatttggttgttccttaaatggtctatccttgctatgttttatttgcaagaagtggtaacctcatttcattgctacaggtgatattgctttccgtttattattttcactttgtagcatgcttactacacaagaatgttacactcagttacatctcctcctccagcaagcacttcaaatatgtcaaaaattatacatgactgttgtcttcatgtggaaatcaatcactcggtttttctaaactttaggaagtcattaggaatggtcatacagtatgtatatagcttttatttcaagttggcttaatttaaaaactattgatgaagccaaatcaaaactttgcttcttcatatagtgtgcacctgcagtcctgcagtctaaggttggtttggctcttcatgacctggaagggttatacttttattcttagttctcaatggtatatctttcatgactaaaggttaagctgactttagtaggtctaagtatttgtcattttctcttgctggacaatgaactacaagctggccctttttactaatgtgcttctagtttgcaaacgctggtagcctgctctgagaggactctcttctgttggcaggttggagggtctaggatgatggcaggtcttctgataaccgacttggcgtgaatgagctttggctgtttctttgtattaactggtccatttacttcagtattaactaagtagtgcagctttgcttcaaaatttgatgagtttttcaatggctgtgagtcactaaaatactctgttcatatagatggaaccattttttgtcaatttgtttaagagccaggtgtcttcataaccccctgaaataagcttccttagatgatgctgagatgctacggggattaaattataccaccttctatgtaataaacggtg

SEQ ID NO: 77875 - DNA, 1802 bp, Homo sapiens
tgccttacagccttctggcttacagctctacagttttgtgttcttagaatcagggctgtggggctcatcctttcccatgtctccttgtgcacatacgcgagctactcatttttgttttaatggaaattttgttaaagcaaatgtgaacatgagaggtggcatgtttgacttttaaggagaaaactgctctgtaaatcatagtagtggtaatagaagctctctgccctttgccatcgtattacctaatagtacctaatagtcaatatttatattacctagtgtcagtatatatttcactgtaactgacagggagtttaggattttaattcttcttccctgtcaccagttaaggtatgtactgtgaccatctggtgattagttttgatttcaagattggcgtgttaagactatttccagtgttagttatggcctgtttttattttctgagagacgtgtgaatgatatgtgtcctaaaagtagctcttgttttctaaaacgtggattaatataggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggtgagtttataaaatgttggtctcaaggggtctatgtgtttgaactgtggtgtgctgtagagggcgcagggtgaagaggtagacgtgtggtgggggagttctagttctgagcctgtgggcagataggcagcctggaagggccttgggctcatgttctaagcagctcctcccaccttatcctcctggggagccaagttgctaatcagtgactggggcaagtcagttcacatttctgagcctctgttaggagaccatagaacatgcctcacaggattttgagatttacctaaagataaggaggtggactcatggtttggattttgtaacttactggaggtgagtgggtggaggactggcggtgtgggtatgcctactagtgtctgaaatggatgactatgaggctgaaggtactaggagctcactgaaatggcaataccagtggcaatagggagaggagagagaaacagccacctactaaggaagaagggctttttctcccctcttggttcttggttcttctttccacatgaagggagcagcagtcactggccatgcctggcctcttctcacccctcactcatgtctcttctaagaggaggcactccttcatctgttggccaagtttgggagaaggaactggacttggcctttttctcgatgggagctagttgcccgtatgcattcattccactctgctctctgccctggaagctttgcaggggcaggccacatgtggggagggcggtggggatccagctctgcctgtaactaggtgggggagtctgtctaattctgggattcagtaggtgatattttgggtgaccatctgttgtattctatctctctctcagttgcttcagaacttgggtggaggaaggggtgttatttgggccccctcaaacctccagcaacatttttggctaagttgtagttaacctttcattgatagattgataaatcacatgctggtatattagatacctgttaaatgtctactgtgtgaatggtagtatcttgcttccaaaaaaaccagtctcttccttcatgatgcttataatctatatagtaagggacaagacaggtacaaataacttaatagttgacattggtgaaagcaagatgccacatgttcttctcttgtg

SEQ ID NO: 77876 - DNA, 4086 bp, Homo sapiens
acataagagaagatacacacgttagcctgttaaataatgtgatgtcctactgttttagcacatggccatatttgcatggactcagttacagcagagtcaatgatcatctgtatagtgggagaatatgttttaaacctttgtcctagcatagttcttcacatggtgatagttaccactttttgtaaaaaacaaatggaccaaagtctgctttttgattctcacttgagataaagtgtaactgactggggctcctggaggccatcctcgtggtggtttgttattcattagcttatggatcgccctaccagcttcttggctggacactttttccatcttccttggtcatgatcttagccccttgtctctggagaatcaaagccagactcctctggcagtgactatcaccctgtcttgagtggctgcctcgctaggcttccctagagaccccctctccagccgggttcccttcctcactgtgcttccctcacgcttctagtcctgtccctgtctttgaatgcccccccccccccccgccattcttcacacatccatgtcccttactttctttgagacctattgttaaaagcacttgcaagcaagcattatctcatagggtctttacccaggacaccatggcgtgtcctataccacatggtctcatctgcgtgtgaaaatatgctcatcatttctcacatgcccgcagaggacccgtgtgtggcacactggaacgcgacgggagacctcgttcaagtcccgggtctgccatcagcttcctgtgaaatcccaggcaaggtgcttgggatttcccatggagcaaaatgcaggagttagactagctcgccagagttttttccagctctaaaacgtcttcagcatttgtccagagagtgtgatcagttgcttatgatacagttatggttaatgggaaatgattattttaaggcaaagtggggagagaatatataggtctttatgcccatatgtgtatgatgtatgcatgggttttatctctctagtatcctggaatatgttagtctgcacagtgaaatctatgtaattaaaaaaaaatctagagtaaaatttgctctactatagtttttgtaggtgaaaaagaacgaacttttcttccagagactacaaagcagatttttttttttcccatttgagaacctctagatactaatactacacatttctttttctggaagaaaacttcatgtaaggtaagatcttagcctctgaagactaagacactgccatgtgttggacatgttttattacttgattttgttctttggtaatgtaatttttttctcttttctttctcttctctgtagtcagaaaaatgggtaagaagagtcgagtaaaaactcagaaatctggcactggtgctacagcaactgtgtcaccaaaggaaatcttgaacctgaccagtgagctgctgcagagtaagtcctcctctgggctctccctgccttgatgtggtggctgtgcctttttcttctttgtcaccagaatggggacgcgtgcatcagacaagctggtattcaggtccaagcttattagctgtgggcctgggcgagtcacagaggttcccaggcttgcagtcctcacctgtgaggatggaaacacccgtcagaactgtgtggctgttaacaaggcttgggtgaagtaattgtgagcttccatggcacagtcacctggaacatggtcttccctgaggacctgtgggcgagaagaagctctactgctttttcacagtgtgccgctcggcagattactgaacccttccgaaactcagtgttcttgtcgtaaacatagataataactgtctcagggaatgagccaagggccttgtgagatgtggtgtgtgaaggtacttcacgggctgttggcccaggggagtccagcgtgcctcttggagacctggccttcagagctctgcccctcactggaatggctcgcctttctttttggtgattcaattaacagtgcttctgattttttttcttttttaaacagggtcccgctctctcacccaggctggagtgccatggcactatgacgactcactgcagccttgacctcctgggctcaagtgatcttcccacttcattctcctgagtagctgggactacaggcctgtgtcaccacgcccagctaatttttttgtagaggtgaggttttgccatgttgcccaggctggtcttgaactcttgggctcgagagatcctcccacctctgcctaccaaagtgctgggattataggcgtgagccactgcacctggctgtgtatctgatttttacatgctgtagtttgagagttcttagtttaaggaagtgaaatatctattaagtgcctctacttgttttagcaagttagtgtaatttggtaactttttaaaattatgaatttgaattggtgcaattagtgccttggctgtagctgtggtcactccgttgccctttgtccatgtttagattatgtggcaggctaaacctcaagtaaaaatgcagctttccctttgagacagaaagcaggccgcagccaagttggagtcaggtccctctcgagtgctgccctggaccctactggccggtggagtgtggctgtcctgcccattcctcgctgagctcccctgcctctggcagcttgaggacaggctcgctgctgcttcatctttgaggcctgttccaggcctcagtgagtgcttattgttggagaatgaagtaagactggctacccttcatagttaagactcagcgtgtgtctagttattgttagttatttgccacatatactcttttaatagagagcaaaggggccccaaaggttaagcaggagtgtgggaaggggctgtctaaaccaatgcagttgtgtgaaaagaaagagctgccaataggcggggtgcccagtgtgcagtctttcaaactcacacctcagcctcgggtgttggtcttttggttctggccccacagtggaatcttggcttcttttttagcagtgactatgccatctcattttgcaactcccccagactgctgaatatagtgccgtacacatggatgtgaaatgtttgtcgactaattgtccttatgtccaatttaactggttcccttagggaatcagtgttatggggtttaactaaaaagaaaggttgacttttactattaacttttactattaacttctttttgccatatagaagagttttggggggatagtttgcattttagcttagctttttatcatagattttcctgttagtaagtatattctaaaaagagttaactaagaataaggtggatgtgagctaggtgcttgctcagtgctctctcttgggtacgttaagtgggggatgtttttatgatgccccagggtttgtctgctttgagaagtgtacctgccttgtacttctcacattcattatcatggctgtcatatgtctgtcttttaaaaataaaccaaccccagaacagcaacaacaaagtccaaatcctctttcttgtgcagactagtaggttaagttgaaagagagaagtgtttcagtaccatgcctcttatgttacagaatgcagcagtccggcgcctggcccaggaaaagagtgggaagagtatgtgcagatccggactctggttgagaaaatacggaaaaagcaaaaaggtaaaattgctagaatgataactgtattttaataatgtcatgtagaaacttgattaggtcaaagggttgacgagtagtaaaggtctcagcatcattggtgtcactctgaaaggtcttgtactggggcttgcagaccgggagagagagcagttagcgggatttctcccctttctgagatgctattacctgcttcggaaagggtgagaatgttgagctttaggagaataaaatgtttgtatctgggtgctaaaatgatacaattttatttatttacattttataaagtattataccgttatttccttttgagtttcaggacagtgcatatagtgtatatcgtcaataacaaataaatgctgattggttaatgcattagcaaggtttataatgaactcacacacatctcagttaaataagaggt

SEQ ID NO: 77877 - DNA, 1047 bp, Homo sapiens
agaatcccaatataagccaactctttagcatctgtaataaccttgagtttgaccctttcttactgactttgttgggcgtgagggttgcatggaagagtctagagtttcccttaatgccacagggcacatttcggtagagcctcaaagtatgtgaaaaatcttgccaggagaagacaaggggacaggcagtgggatagctgcattccagaaaaagggaggaacatgagcagtcccctggagctgtgttgtgtaaaggtaggatgaagctggacatgtaaaatagagtgaggcagttcagtcctcgaagaccttgctagggaggttacgcattatcccgtgagctgtggaaagacgtgtgagcgaaagaaacctacacagtgtagaattccacttatatgaagtttaagaataggcagaactaatcggtaatagaagttgaaatgtgggctactgggggaaggactggttgtgaaagggttcgtcaggactgctggcaaggactggtgtgtttgctgccttctgcaaggctggggccttgcatgcatggggatgagtccatgaattcgtgcactatgcggtttgtaggtttctcttttttttagtcagggtctccctctgtcacccaggctggagtgcagtgacgccatcacagctcattgcagcctctgccttctgggctgaagggatcctcccacctgagcctcctgagtatctggggactacaggcttgcgccacggtgcccagctaatttttatattgttttgtagagacaaggttttgccatgttttccaggctggtctcaaactcctgggatcaagcaatccacctgccttggcctcccaaagtgctaggattataggcatgagccactacgcccagcctatgcagtttgtattttatacctcaatttattaaggctgactgttgacattgtggtcggggaggacttgtaggcagggaaatgaatcacgaagggattgaaagagctggagatgagggtcttagctaggagtggcttcagtgactgcataaacatcacccaaca

SEQ ID NO: 77878 - DNA, 1067 bp, Homo sapiens
aagataattcagtaagtatttgtaaattatacctgatttcagtctaaactttgtggaaaaaaatttttgagttagcattgtaccttctggctaatatctgtaatttaacttgagttcgtatgtgtatgcacatataattaattcagtatgcatttatattttcctaatataaatattggaaataattattgaaaataaacatttggtctttgtgggaaattgatgaatgtttaatatatttttttcatgaagagcatgaagtatgttcagaatacctatttgagtgtctcatttgtttaaacttgtaatttagccccaaattcagctgaaatgatcatgaaaattattcacggtatataacagacttttgaatcataaatgaaaagggtagttatttaaatccataaggttggggaacttacatggcatgaatcttttttgattgctaaaagaaggcaatattgggtgaatttaggaaaccacacatactggatactaacacctcacactgaatcttaaaatttagtcatccttcttgaattgtactttatttcttgcccttctatgtttagttacttatgtgttttaggaattatccatgctgctttgagtgtgagtcttggtttcccagcctcatccttgggaactgcaggcctggttttgtccaattttgttgtcttctgcaacagcgaacatagtataggcagagagacgttgtgcagcttagtttaatcaagcttgcgtatacttagagtccacctatatgctggagctaatgcaggatttcaggtttgaagctatgggtctgctgcttggcagctgtggtctcttggccaagtcacagccctctctaagcctcctgacaactggctgtggtcactgccggcctcagtgggctatggtggggatgcagggaggtcatgggcggatgctcgtgtccttggtcacaagtgcccatggagcttttccctgtgcttgggccgtaagctttccttttctatcagaaacagactaattcctgctttattgctttctaaagaccaataatgctttaaaaattccagtgt

SEQ ID NO: 77879 - DNA, 2021 bp, Homo sapiens
cgatgcaactcttgtcttttcccggtctccacttgggaaaaggagctgacagtgacgcgcgcccctggctgcggggctcacccctgcccggccggtgttgggaggagggcatttcagtgttgcaaaggcattcgcgggttaggaccactcggaccgtgttattttgcttttctaaataaataaggtgatgtttcaaaagcaaaaatacttttaaagtatgctgacaaatcaattttgcttttaagaatcctcgaagagttaccccatcttcgtagcctgattgtggtgctgatgaggccactataaatgcgtttgtcagaactcagaaccggacactgaaaagtgtgaattttatcttatgtaaaatatacctctccctctcccgtttttcttcttgaaatgaccttgccagtatttcaaaactgaactaaccagtaataatctcggagaagtgtttattattttaagcgaatacatttaacccaagaatatagcaaaataaagcagtcttcctctccactgttaaaatttgccaagacttgcttgaaccttgctgtatgtactgtgtttatacgggctaccatgcgtgaaagtccagcagtactggattagtcccaagggctgccgtgattgatactttggtgaaattccaacagtttaccgaggagtttttcttcggcctaagaaagtagtttgcaaagccaagttctcaaacagctacagaacctctttattgggaccccagacaaccttggattttagccttctgctacccctttcctgtctgccctccaagtgattgtaagttaatatctgaaatggaactgtagtctgaaggagtaaaatggttgcttctccagtgtgctaacatctcagtgcttttttttcctggaattggagtggtgttggatttgaagattagaacatcttatgtctgtatgtacggttatagcgaaagcttctcgtaagagcacagtgactgtcagtaagaaagtgatggctgctgcgctgctcttccgtgccgtggacatttaggccacattttaaatgataattaagcttttgctttagaagccactggataatgagaaaaatatggaggtgatatttttcctatttaaagcttaaccactggacaactgttttggttttgagagttctgataaacggtcacaacagcctccttggaacacagtactctcctgcctggaggagaatgacaggatgacggcgccggggaaggtatgaccatcagcgacggaggcttgcttggagtgaatatttagtagacaatcattgaattcaatgaaaaccaggtgcatagtttgtgctgtgtagagttgtagtaaaaatatgagcaaaaatcctacctccaagtcagggttactctgaatgctttgtgactagatgtcagtgtagtttgaggcgtaccagttttcttcaatgttttaattacatagagtcttttttcttatcacaaatccgaagtagggtttagaactgtaactagtaatactgtatctttcttttgtgtagttggatgaatatccttctctgagaggttatttatctttagagactggtttgcctgttccctggctgctgtgccttgtgcttctgttgagggtggagaggaagagtttcaagtgtgtttctttcccttggaccgaagtcctgggaatggagtggtgactttgttccctcaaagagaactcggagtcatttattgctatggcattaaatgtttttaacagaacggtgaacttatctttattcttatgttactttggatgttgcttgtggccagttataatatttgctttctcaattacctacccttatttttgggccctttttttatcagtgaaaaatcttttgattagccgtgcatcttttctctcctgctatagtcatagaagtgtttatctggctaacagtttgttttgggtcatatttaaccagtcgagagtattagaataaagagtcttgctttttcagttttctatagttttcacttctgt

SEQ ID NO: 77880 - DNA, 1995 bp, Homo sapiens
catggaataaactgaaaaggggtgctggatggaagagatggttagttttagaacataaatctttgtcaagattaagacaggcccaggttttgctgaagaatggaatctggaccagcgttagaggacctgtatgtctagtgaagaaaaaccagaagaaagtgagatatacttcgtttcttccaaaactttgtcaaataaggttaaccctttaatctcaagagagagggaggaaatagtcttatttttaaactaccatgaaatttgagatttattaatattagtactggggtcatcttacagtattgtgttaaattggctctggagttagcccgggcttgtaactggcaattgacagtgtggtttctataggaaatagtgatcccaaaccaggtacaatctatgattctagattgcttatagtatggagtattcctttccaactttgtttttctctttctcataggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctgtatcctgactctccttggaatctgttacagataggctccccactcaccaccaagaaataattagattctgtagacaaaatatatagtaatttctctgtaccagagcagttcttaaatatctgtttgaatgttgtttctggtgggggtttttctctttctgatttgtcattttaaaggtgtagacttagccactgaggaggtggccagccaggaggatatgaggcacccattaggatcacagttgaggctgggcacagtggctcatgcctgtaatcccagcactttgggaggcctagacaggagcatcccttgaaatctggagttcgagaccaacctgggctgcagtgagccaagatcacaccactgcactctagcctgggtgacagagatgctgtctcaaaaaaaaaaagatcatagttgaagtgtttctaaagggtgttaaaagtataaaacttcagcttgctaattcttgtaccagaattctgacaccctgagattcccatctcattactttgccactaatattgtttactttaccattgattttgttgttgttgtttgtctttttgtttttctacatttaactaagagtataacctgtaaaagttattggttagagtccttaaccagaacaacagacactatgataccctggcaactggaataatttattttcatcgcttctatatgtttcattccttcaagcaattcccaagatatgtaagtgtttgaattttattgtaattctctgtcatatgttattatttccacacagtttggtggactaattataagctctatttttctcatattttccagaaagtatttatttttatatggtatatactgcatataaacaaaatcaagtttgaactttttttattccaattagccatgttcaaatcttttcacttaggccaatatggaccatagtcatattgcgctttgtatgaaagtttactcccgtggtacctttcccagcataaatttgggcttataattgagactcaacaaagaccaagaaagcaaaatggaacagaagttgtctatgccatatcactcattcttcggttactcctcaagacgtgcattgtgtcttactctctgtgggagatagagtagctttcagtccaggataagtggtatgacatgcacagaacacgtgatggaaagtgaggccatcagaagatactgataaaagagttgtggcattcaaggaggagacaacttacatcttggagagagcagggaaagtgctaggaagaaggtgccagcattaagg

SEQ ID NO: 77881 - DNA, 1050 bp, Homo sapiens
atttatctctgagttttcatgaggctggctatcataaactctttcttgcttaaaatgttttcaatgaaaattcctaaaagattgcatttttaaaatttgaggtcttgaaagaaattacaatttagtcaaattatcaataacgtaaagatctgttttgtaaagggagactcatgtatgtattgaaaataataatatttttaaggatcttttgttttcagtatttttttttacattacacctctgctttgtcttcctgtttgagatcttttcagaatttatcagtgtctctgagcatgttaaaagtctgagtgggagagaaaggaaggaaaggcagttgctaaaatataacttgaagagagaataaatagacaggaaagctcacttttgtaatgctgcttgagacctgcaattgtaattactgtcctaacatttgtgattgatttttaggaggaagtaatggttctggagagaatcttactgcagaccatcaagtttgatttacaggtagaacatccataccagttcctactaaaatatgcaaagcaactcaaaggtaagaagaaagttttcagaagaattttttcattctgaaatcaagtctttataatttgatgacactcaaattacgcttctcaaaagcggaaaacaaagtttgatgtgtgaaataccaagggcatggcttgctcagtcaattcagcattgcagctgctaatgctgtttccttttatgtataaacaggctctgtcatccagttgccaagtgatgggagaggcaggaaaatgaggcagaattttttaaatggactaataaacttagccttggagccaggttttccatacatggtggttcagcgtaggtcatgaggaggaagaaggggtaggatgtggacccacatcattcatccttgtttcccacgcaaaagctctttgctgtgtatttgagtggtgctgaacacgtggtaggtttttaataaatacttgatgctgcctgtgaatttttctattgctattaatttacctttttgtccccatttctaggtgataaaaacaa

SEQ ID NO: 77882 - DNA, 1522 bp, Homo sapiens
ttttgagaggccagggatctaatgaggggccgtggtgggaaacagaatgcctgtgaatggagttgctgccagccccatcccactgcagtcagtgaagcttctcttacatttgacttcctccataagatttcatttgaagaaacagttgagtggctaggatttcaacagtttaaataacataagtcattttcattggtgtagcaatttttggatgtgctagaattcttctgattctttaaggaatagagaaattactaactatggttaaagtaacttagtcgggtacctttagaagagtaaagacttgagtttatttatttatagtactttaattaaatttaggggagaataagcaaattaatggttagttatggcatctccatgcactggtttaatcataaatattagatcatattatctaacctttttttttcttgttgaactagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaaggtaccaggcatgctaagcgttctcgtgagggtgttccatgttgagatgattcttccatgtgtaccctgagtcccaagaatggattttcccagatagacatatgtgagcaatatttcagaagcatcattaattaaattatctaatagtttccactttgtccaaacacatacttttggtaaactaaaaatacacaccagtgttgcacacaacgaagatggggtgagttgtaaatgtgattcatgcttaggtcctcgtaggggtatcataactgattctttatccaggtaaaattttatttaaaataccaatttgtgtaaaatgtaattgttggctatcatttagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggacccccagcaaccagcccagcagcagcagccagcccaacagcccaagaaaccctctccgcagcccagttctccccgacaggttaagcgagccgtggtgagtgggctaaagcaggccctgggtagagcaggctttccaggtggcggcaacacctgagcactgttcccatttctaagcgagcacagggaacaccggaagcagggggtgttcgccgaaactcgcagtccgactgcttgtcggtggggagcctgaaaacaaaggtgctccaaggacaggctgcctctgagaaccaggagggggctctctgcccggctccagccctgctgcctgtttcatccctgccagggttctgaagcctgtcggtgtcgttgccgtgtcctagcagtgtcgttgt

SEQ ID NO: 77883 - DNA, 1336 bp, Homo sapiens
tttagagactatttacccccatcacagcagcaggagtcctctcccaagcaccaagccacagcagatgcgggggggcagtagggggtggtgtgctgcccggacagcaccagcccggcccagcccagctgcccttgcaggcaaggcctctttgaaacacacttgggttgaggtgctgtcacatgtctagaacccaaagttagttcatgtcaatattggaaataaacagaaggagtgagcaaaattggaacaattacaaaacagaaagttagaaatgttttgtcacagggtcagtccacctatcatactgaactctttgaaggcacagaccctattgactcatttgtctttctttgttacttggttcttagttccagtagttcctggttcttagaaccatgttctcggttcttagttccattcattaaactgctgtgaaatcttccagttatgatagagctactttttttttttttccagtatatttgagggaatgatgagttcagtacaggtgaattttttttttttttttgagacagagtttcactcttgttgcccaggctggagtgcagcggtgcaatcttaactcaccacaacctccgcctcctgggttcaagcaattctcctgcctcagcctcccgagtagctgggattacaggcatgcaccaccaggcctggctaattttgtatttttagtagagacagggtttctccatgttggtcaggcaggtgtcaaactcccgacctcaggtgatctgctcgccccagcctcccaaagtgctgcgattacaggcatgagccaccgtgcccagcctacaggtgaattttttaattagcttcaaattgaccgacattaaatgttagacacaagaacgggctacactccatgccacatgaaatgcaattgagttgacgtgcaggtctgtcagaggcaggaaacaaactatatatgaccttgaaggaagagttgcatttgagcagcgagagcagagggggaggatggagcaataagttggaagtacgcaagtgagcaaaggaattgagaatcaggggaaatggagaggagtctttctggaatgtgatgaattgaaaggcaatagcttctgataggatctaaaatgtgggttaggaccagatcacagagtttacctggaggactgtgagtttggcagaggcaagggaagccattggagatttagcaggggaatggcagagtctaaattcatttgagaaggagtcccctggcagcagtaaatagggcaagtggttaggaatggggagaatcttgctggcactcatgggaaacatggtggcctcagcatgctggctgcggggcagg

SEQ ID NO: 77884 - DNA, 1085 bp, Homo sapiens
tgcattaacagagcaagactctggaaataaaaggaaaaaggataaaatttatttaacccgatagatcgaaaattttatttcaacatgtaaccaatataaagctttactaatgagatgtcttacgttctcctttcttggaaatctctgtgtattttgcattgtcagtgcttcagaatttgacccagtcacatttcgagtgcttgcagccctctgcagccagtagccttcggcatggcacagtgcagctgagttcctctataaagcttcctccggatctgcccttcctgccccgcagccagcatgctgaggccaccatgtttcccatgagtgccagcaagattctccccattcctaaccacttgccctatttactgctgccaggggactccttctcaaatgaatttagactctgccattcccctgctaaatctccaatggcttcccttgcctctgccaaactcacagtcctccaggtaaactctgtgatctggtcctaacccacattttagatcctatcagaagctattgcctttcaattcatcacattccagaaagactcctctccatttcccctgattctcaattcctttgctcacttgcgtacttccaacttattgctccatcctccccctctgctctcgctgctcaaatgcaactcttccttcaaggtcatatatagtttgtttcctgcctctgacagacctgcacgtcaactcaattgcatttcatgtggcatggagtgtagcccgttcttgtgtctaacatttaatgtcggtcaatttgaagctaattaaaaaattcacctgtaggctgggcacggtggctcatgcctgtaatcgcagcactttgggaggctggggcgagcagatcacctgaggtcgggagtttgacacctgcctgaccaacatggagaaaccctgtctctactaaaaatacaaaattagccaggcctggtggtgcatgcctgtaatcccagctactcgggaggctgaggcaggagaattgcttgaacccaggaggcggaggttgtggtgagttaagattgcaccgctgcactccagcctgggcaacaagagtgaaactct

SEQ ID NO: 77885 - DNA, 1091 bp, Homo sapiens
atgttgaaataaaattttcgatctatcgggttaaataaattttatcctttttccttttatttccagagtcttgctctgttaatgcaggctggagtgctcctttttcttgttaaagtggttcctggcacacttgtaatcccagcactttgggaggccaaggcatgctttgagcccaggagttccaggccagactgggccacatagggtgaccccatcactacacaaaacttaaaaatcagctcggcgtggtggcgccacacctatggtcccagctacttgggagactcaggcagcaagatcacttgagcctggttggttgaagctgcagtgagccatgattacattactacactccagcctgggtgacagagcgagaccctgtctcaaaaaataaaatggctcctggaaagtttaaaattgtagatatgtggctctcagttatattgctgttggacagccctgatgtagacggctttagctaactattaccagctgtggaaaaaggcaggaggtgggtccctgaggtgagagtaatagcagttataggatacagaggcaaaaggtagagtgtgaggtgctgattggtgggtctagggatgggccatggttttggtggcaagatggacgctagaaatgtaggtttgtagttgtccacttagagaggggctttggactctgaggaagagggtgaagagagaggaagtccctggaacttaaattgagcctgtatttgagatggaggaaatccagagaaagaggccagtgatggcagaggagactcagatctgagtggtgtacaagccagaagaaagtacatttcaggaagaaaaagcctcagcatgcaaacagaaaaatagggttctttttcagttgtgatgtgcacgctgccttcttaaacggatgagattggacttcccttgggctgccttggagacctagtgctgtcattgtggattctggctgcgtgccgctgcctgaccccggaagggtgggctgtttcctccacctcaaggggtcctgactgctgggcttttgtgagcggcacattcttcctgccatcagtgtgtcaacctccagagctctgctgactc

SEQ ID NO: 77886 - DNA, 1053 bp, Homo sapiens
gcttcatgagcaaccacaggcatttaagtaaggttcatattgaattgggggttttgggatttggccccaaagtggaaaatgacgcctctgttctcccaaagcacaaacactatcatgattgagtaggaacagaaatgtaatctgtggcacatctgttacgggcacacagtgctgtcagccccagtgtgagccacgtgcaccgaccaacagtgagtgtagcaggctggaggagctgctgacagaggcttggaagcctccggagtatcgaccaccttttggagagcaagcacaggtcactctggccttctctagcgcatcaccttctgaaatggtgccacaggtaaagaatgccatctactttacagcttttctcctctattgccagcggtatcagagaggctttccagcttaccatgtactacttgttgagaacttttcactctttcatttactctctgtacaattgcttattcttcagaatgcactaagacgacacactgccaataggaagcaggtgtaggggcggccggagcctagtagccacagtaaccctgcctctatctcagaaggcggggtttggctttctttcctaaaactgattctaatacaatgtgtagtttagcatttctggatgtgagaggtcggaaaatattcagatatacttaacaatttacaacattctcaaaatacctggtcaaaatcagaactttgagacacggtctccctctcacccaggctggagtacggtggtgcaatcatagctcactgcagccttgactgcccagggctcaaatgatcttcccatctcagactcctaagtagttgggactacaggtgtgtgctaccacacctggctaattttttagacagggtctcactttgttgcccaggctgacctcgaactcctggggtcaggtgattctcctgcctccgcctcccaaagtgctgggatcaaaaacacaagccattgtgcccagcccaagaacaattttgcaaagattcctgcctgtggctgacattgtcaatctgggccccagtctcccttttctaagt

SEQ ID NO: 77887 - DNA, 1031 bp, Homo sapiens
ggcagcctggatgagataacgtgagccttttttccctctttgtttttttaacaagattttctaatcgacttgcagagtagttgaagtgggtaagcagcagggtaccttgtataatgcacgacagttgcagtatgggaagaatggaccgggcccctgggataaaatcagagtggtcctcacacctagaggacggggacaaccagctttcagagtagcctcatcagtgcccttgcagtctgactgtgtacacttggttcagctaatgtctgagagtcctgcactgggttactttatactagtgaggacgttaaccagccatattggctcaataaatagcttcggtaaggagttaatttccttctagaaatcagtgcctatttttcctggaaactcaattttaaatagtccaattccatctgaagccaagctgttgtcattttcattcggtgacattctctcccatgacacccagaaggggcagaagaaccacatttttcatttatagatgtttgcatcctttgtattaaaattattttgaaggggttgcctcattggatggctttttttttttcctccagggagaaggggagaaatgtacttggaaattaatgtatgtttacatctctttgcaaattcctgtacatagagatatattttttaagtgtgaatgtaacaacatactgtgaattccatcttggttacaaatgagactccttcagtcagttatccaaataaaagcagttctgaaactatccctttctttgttatgggtggaaggtggggctccaggccttcgcagtctgtggcttataaaatgtgcagaggccctccttccagaccctggggacgcgggagaggcctggctgcagctcacagcagccacagccaaccccactgcctcccaaggcactctgggtggatccgcacagctgcctgccaagccagcctgcccccatcctgtgcctgccttggtttcctttggaggacctggttgagttccaaaccagtttgaaactttgaagccttgctgc

SEQ ID NO: 77888 - DNA, 1030 bp, Homo sapiens
ctggcctcagaacatgctgagcacattttgtagggtggcacctttttatccaagttactagctacacatcagtgtttaaagagaaaaaagtgacctttcattttttttttcttgaaacttgaggaaacaagatacatactactgattttttttttttcttaaaactaaatgcatgactgcagagcggtagaggtgtatatttttcatactgtggggcaaagtatttgtgctgctttttggagatggactggaacgtctggtttctgtccccgggcccggcagctacgtctattttctgtagaaggtgccacagtgagacctggagccaccccttcctgccctggcgccgtttagagctgggagcccgtggactcccggcctgtttctaccttctattcaaccactctgacgtggggagacaagaagaaatagaactttttgatagtgtggtaaaaacattgatttgaactattttagtaaaaggagtaacaaacaagattgtgatagtgtctactttgagctagataaataaaggcctctttgtgagcctcctggctgggtgctcagtgcttgtttctgtcgtgggtggcagggtcagcaggcagagacagggccaaggcccctcaagcaccgcagatgggggctcagtcggggccccttccacagacagagccgtggcccctcaaggtggacagtgaggccgctgctcctccagctgcctctgtctcatcacaggccagaagtggaaagggtttcaaatccaagcccccgggttcctgtgtgcgttctacgcagcaaggcttcaaagtttcaaactggtttggaactcaaccaggtcctccaaaggaaaccaaggcaggcacaggatgggggcaggctggcttggcaggcagctgtgcggatccacccagagtgccttgggaggcagtggggttggctgtggctgctgtgagctgcagccaggcctctcccgcgtccccagggtctggaaggagggcctctgcacattttataagccacagactgcgaa

SEQ ID NO: 77889 - DNA, 1029 bp, Homo sapiens
gctccgtgctcgacccagctgagcaccatcggcggtctccttgggggtgcttgcaggagccatcggggaaggagtttcatagggtctgaacccaggacttaaagggggggcgagaggctctgaactgtgcagcccctcccccgcatcacctagtggggcctgtggaccccactggacagctgcaaggctgagccacaccccagcagtgacctgctcaggcccgatagttagcgcggcatgcaaagacctggtgtgggtgtctctgggcctgcagtggcctccgtgtccctcctggccccatggctctgaggacgtgggtgattctgccgtgatgaggcggcggatgtgcataggcggcaggtggacgcgggtgagtcccaccactcacatctctctcctctccacaggtggtctggagaaagctgggagatgcagccagctccaagccctccatacggcagcacctgtctgggaaccagttcaaggggcctttgtagggccactcttctgtggacgtggactggccctgctgggggtccccagggggagtttcaggccccagacacgggcaggacctccagcccagcccctgtcttcttcctctgtggtgaactgtacataggacgctgcccgccctggcccagctgccatgggtccgatgcactggcccaagccgccatctcccgcctcatacaccagcaacctgggaagacgagacgctgcgactgttcctgcagcagagcggcccggacgcctcattccccctctgggccctgggctccatgagcaagaggctgcaggctgcttctgagatccagcctgggaactgtccaggctcctctgtcctgcctgggatggaggggccactcatcaaaccctctactccccggctgccacccacactggacagagaccaccactacctgggtcttgacgcaggtggcaccacttcttgcccaaatgccgtggcctggccccaggccccccaagcactgggtccccggcatgtggacaaggccactcaccaca

SEQ ID NO: 77890 - DNA, 1020 bp, Homo sapiens
atttcatctgcagaagacctggtgggcgggactggccagactggctgtgggctccttgggtctccatcctcacacctgcctcctctgcctcaccccggtccccttttcctcctgcctgggccctggcccctcagaatgggggccttgtctgagccaccggtcattcctgtgggagccagccagggtgagctgagatgtgtgattgccttccccagggcccggcctgccccgcacctgagctgccctcgcccccctctgctggctacagccctgcaggacagaagcccgaggctgtcgtgcatgccatgaaggtgagggccactacccgctccctcagaagtcctcagatgctgggtgcactgtgagactgtgggacctttgcacctaggggtatccaagtggcaggggtgggaggtttcatctgtgtgtgggtggctgggtgaccatggctgcctggagcactgtgaggttgaactcagaggtggcagtcataagtgtgtcacctgtctgccatccctgagctactgcacctaacaagactgaggcctggggtcggggagggcaggcacccaactaaggccagagagagaggggcaggagtggggctagaactaacctcaggtctgccaggcccagcctctgcaggtgcagactggtgagtccgatgggctccggttcctccaggctgtgcacacctgagcacagtccccactcccatgccccccttcctcctacgtacgtgccccatgacatcccacatgcatgcacggccacgcctactcacaccccctccacgtggcgagtgcccactcatctccagcgggccctgggttgcagtgagtccacctgtctgagggtcttccttgcccagcctgtctacttcctcccgggtggcccagccatgagctgcttcccttgtagggcatccagtgtcagcagggtgagatgacaacctgcccctcagttttttccacgcttgtccccaggggcccagcggctcagggtcctcagctttggttc

SEQ ID NO: 77891 - DNA, 1023 bp, Homo sapiens
gagctaggggtacatctctcaggagaggtgacccagagaggcatgggtggctctgatggggtggggggaggggtgtcactcatggttgggggagggtgagtgctgggcctaggggtgggggctgtagcctcttcctctttttggtacctggtgggtggggagggggctttccttgatctgacctccacctgcgggccgtgagtgcctctagttaacctaggcagggtcagccagggttaatgccgtggtcagggcatggcagtcccatttgatggttcagggctgtgcccaaggcccccgtgctgagacccctttgtgatgctcgccagggttatctaaaacccatcacactttgggggccctgcaggaaggttggttcccacttctctgtctctcctttatgtccctccctgaccttggaccacacccaggtcctccctgaggcccaggaagcagctcccagcctccagtgcccggctgccctggctgaccggcgtctggtgggcgtgggctatttaatgaggggagtcagtgccggatccctgctttcctgtcttggctccgtgggagctggtaatagagcatccacttgcctcctcacccccgcaggacacggctgtttgctggcccttgagccaagctcttgagacctcccagccccagtggggggcctggccagggctctgatggggctgggagaacacaagagctggacctcagtgaggctggggcttgtgagaagtgcggggccaggtccagcttttgagggaggcaagcagggtgtgtgtgggatctttcacagccaggccgaggggctggtgagtggaactgggaccccagacatggctgcagcctgtcctgccttccttgcccctgccccagcccagccccagcctgggcctcccctgcccctgcagtttgtttgggtaactcaacagcctgctgatttatgggacattccgcagggttttatctgcccagccactttctctcagttcctttgaagtagaaaagggtgtttcg

SEQ ID NO: 77892 - DNA, 1121 bp, Homo sapiens
gctcagcttctgtttggactccggcgtcccttcctccacatcctctctggccctcgaccaaatgggctcccacgtgctgttaccgaaaacgcaggtttgtgctgccgtcccctcccctcccccagataatttccctgggaggagatgtgtgtgcgtgagcgtgagggaggtttttaattagctgcacgcaattcccacccttgccttcggtgagcctctataaacatttgcatgtccatagaactttattagcaagccacaaagccaggcaggaaaaacacacaatctctcattaaggggcaatgtgactaatggcgcatcaaatgagtaaccattattgcacttaaatccaaattaaaaatcctgctatgagacaggtcgctgcctttgcagaatgagattccctaggatttccccgaggaggggaagcaggagctgaaatcacctgctgggcttgttctgcacacagagaagagccccagctaaggaaggtgctggcccttcctcagggggaggcagggggtccactgccgctccccagaaacacccacctgcccagtcttcctcgggtggctccctcaggacccagggagaagggatcttacacacagagctgccagctcagagctcaaacaagatttcccgaatccttaacagggtggggccagccctgccaaacactcagcgtggccccttccaccctggccaggcccaatccgcattactcacttctagagcctccagagggcagcatgagtgtcctggactagggaggaagagacccaggaggttgcagggcctccttttccactgaggaccggagttcaggacacctccagcctgtatccagggccttcactgcaacactgcccaactcagggcccagcgaggactcgctgggtgaactccagttgttccccagccctttctgggcctctgcagtgcggcccagccttctccccagaggggaaccccgtcctgcagcgaatgcctgcctgcaaagctgcagggggcctatgtggggccaccctggggtgacccctagggagcattgtcagaggggatgctgaacagaaagaggataagacatggaaacagagcccacccaccccagcctgccc

SEQ ID NO: 77893 - DNA, 1049 bp, Homo sapiens
cccatgcccgagctgacactaaaaagtgtctgtagacactgcgagttgtcctctgggggcatcacccccatttgagaaccagtgaccaactgtgtgccagccctgggcttgggctgggaggtgaaccacacctgtccagccatgcagacagacgataaaccaacaacgtcattacacagtgccaagtctacctccccttccagagcagcccacaggcatgactgacggacgtgtggacacaaacctcctgcgtgccctcgtgggaacaactctggtgcagttcccgtggggtcaagttgaggcctgtcttctgtggaggcctctgtgctacgctgcacagccctgacccctgccctgtcctgcatcctccctgctttctctgcactctccctctgaggatctccgagacggatgacagctggatctcggtgggctttagtttggggccggacagtggagcccaggctagtctgtggccccagctgcccctggagctgctggggcccctggtgggagaatggtctccccaagtcacgcattcgagcctctgcttccaggtgggtcccccagcccagccagctgagggtgcactgtcttccagcacttcctgggtggaggtgtcagcctgataggccactgaggccctgcgtttattactcggcacccagaccattgattacgcatcactgaccaaccctgggagctcccacagtgcttcgtcttcctggagggaggtcgccaggtcttggggacggggtgttccctgggccctggccttgcccccacttcctcttcctggagggaggtcgccaggtcttggggacggggtggtcactgggccgtggccttgctccctgggtctcacctctcgcctccgtagcccctgggatgatggcttatctgtgggagtgggattggtgggaaatgtgaactggaaggagctctctccagctccctgtcctccaacctggctcccatcccagcctggggactgcacagtgaccacggggacctggagaccatcttagcacacgctcagggcagaggca

SEQ ID NO: 77894 - DNA, 1073 bp, Homo sapiens
ctctctgagctgctgggatcttggggtgcctctaggccggggcaccccatcccagggcttctcaaaggtttgcttttccctgggagggtagcagggcacttggggtggctccaccctggtgtgagttttggggtgggctatggggggtggtgggtgctcctagggacccagtgccgggcacatggcaggtcttcagtgagtccttgtgaatctggagtttctgaagacgtggagctcctggagtcgccttggcgagccccaaccctggccttcggtgtgggaaaaccactccggctcagctgaggtcctggtggctttgggctaatagatgtccagggaaggcactgggcagagtgatgggcatggttggcatttactgggtgacactgttctccttccttctagctgccccgcccctacggccgcccgagaagctggcttcaggtagagctgcctggtgggaggcgtgtttgcagtggtgtttgtgggggtcgggaggctgctttgtgtgctgtgcgctgctgtgtgctctgtcccctactccccagcaccctcccgttctttcctgggagcacttccttcccaggctgcgctggccctgcctttagagtcttcttgggatctgccctctcctcgagctggcattactggcgaaacttccagttttgcaaaataatagcaagacagtgatgcagcgaccgcccccgagggctctccgtggtgtgagccccttctcacgcaccttgcccaggtgcccggggtcctcccgcctctgcagggcggcagggctggtgctaatccccactttgaagtgagacacctgcagtgcacggagggagaagaggcttgcaagtctgcatgagttagtggagacgaggctggggcccacatgcccacccagctgtggctcccggtgggaagctgcctgggtccttgagggaggtctccagggctgctgagctgggtgggcactgggctgagggttctgcgtgggttgcacagttctgagggtcagcatgagtcaccatgccaggcaccctgggctgcagccagatccctgctggacagggcct

SEQ ID NO: 77895 - DNA, 1057 bp, Homo sapiens
tggcaagttcaggagtctgtttccccactgtgtagaggagggggctccccggaccccgaccctggggtgggctgtgccctggctgtgtttgtgagagctccatttgagcctgcagcatcttggaagctgaaggaattgctccagggcaggctggcgaggccacccccacaccccccacctttctacaggtcctgaaggtcctgagaagggctcagaggcccacagcgagggcagcagcgggtcctgcaaggctggcctctgtgtgtcgtgccttggtgtcaggtgccctatggccggaagcctttggccacaggccgtgctgtttccacagggcgggcgagggctcggaggggctggggcgtcacctggctgtggggtgggactcctcagacccaaaccttccatgccgggtctggggccagtcggggttgcgcaatggggatggagtctgctggaggctaatgtcccccttcctcttgtgtccttccagatccctcatccacctacatcaggcaactggagagcaaagtgaggctgctggagggtgacaagctcctcgcacaggtaggccggcttcgggtggcgctgccttgaggaccgcgacccagcacccacccctccagctcacccagggcacccttccccttgggacctaggctgtccccccaactgctcccactgccacctgtcacctcctggaaagtggggtcagggacctaaccctggctcccacacctctgggcttccctctgcccaaccttccatgctgactgcccagtatgcgagctcctcagggctggcccagggcctgagagggtggacaacacccagttgatgaagaaatgggctgcttcactcctctggcagatgggcagatccaggcaggagatggggcagactcacacggaagcctccccgcctctgccgtgctggactcactggccggtacctccctgggctgggttcccctcctccctcctgggcccgacctcacccacagacagatgaggctgctacccctgtgcagagctgggcagcaggggcacggcgtgggagg

SEQ ID NO: 77896 - DNA, 1075 bp, Homo sapiens
cggggtgaggggagcttaggtctggctcctggacacaagaacgttgtagggagacaccctcctccccggttggcagctggatagggaatcccccagaattggtccgatggcccccagacgggttaggggagcaccccaggggaccccttggccaggccagcccagggtcacctccctcattttgccctcaggcagccaagctgggaaatgatgtcccctcccctgtggctccagcactcattactgtaaaccctgggattaacttaattacccgctcatctccaagaggctggggcttgcaggcacccagtgggatcacgagttttgaggctgccaggaaggacagtcctcccggggagccggcccttcccggggtctcctgccctccagcccccgcctgggagtgcccagatcactcttgttcttcctgtctgaagagtgcctgctcctgacccaagggtgactgacgcccggctcactggctcctggcagcctggagagctcttctagggagctgagtgtggggagagggtcagggtggtgggtttaaaatgtccattgcttcattgggtggccatgcatgtaatgtgaaggtgcaagagtttaatccgttcccccccctttttttttaaagacagtctcgctctgtcgcccatctggactgcagtggcgtgatctcggctcactgcaacctctgcctcccgggttcaagcaattctcctgcttcagcctcctgagtagctgagattacaggtgcccaccaccactcccagataatttttatatttttagtagagatgggggtttcaccttgttggccaggctagttttgaactcctgatcttaggtgatccgcccgcctcggcctcccaaagtgctgggattacaggcatgagccaccgcgcccggccattctttttttctgaaagaaggatttcagaactagactacaagtcgattatttgaaaattaacaagaaacgatgtgaataaataaaaacccactggttccctcatctgagcagccgcacagtcaggatttctgtggacttccttcctgaactcacgtcaatgcc

SEQ ID NO: 77897 - DNA, 1003 bp, Homo sapiens
aacaacacacatttattctcttgcagttctggaggtcagaagtgccaaaatcaaggcatcagcagggctgcgttcccttctaggggccagaggggagagcccgcttccctgtctgtccagcttctccccttccccatcttcagtattacagtggccaccccaccgtggtcacatctccctctgagctcagcggggaaaggctctctgtttttaaacattcatgcagttagattgggcccacctggataatccagactaatctcctcctaattttgagttccataaccttgatctcatctgcaaagtcccatttgccaggtcagatagcattcagagatcctgaggattagggtgggggcatctttgaggggttgttattctgctgactacggttcacaagcccaggctgagaactttatccagaacaaggcccttgtgttgtcatttggggaaactgaggcccagtgtgtcatggagggcgctgccagggctgggactcctgacccagtttcttcccccgcactacactgcctcttctgaacagagatcgcagcagccctcacgggcacacagcttgtgttgtttgcattgctcagcaccaattatctcctcttgcaacatgccctgcgcatgaaaggagctggtccttctccacggctggaagaatgtgtcctccccaggacctctgggaggatggcactattaagccaggcttgttgatgatcatttcggtcaacaatcaccctgctgttagttttatgtgaaacgcgggaagcccaatttgctgtcctcaaactgagtctatctcgcttctaaccgggcaggtccactccgctctgcctaatttcggggacagtgtctcgcaggagacccagttgcgttcctgtcctgccctctgagtcctctgagttatctgggcctcctgccctcatttctctggggcctgggaaagggaaggggcttgtccaaggtcacagagcaggttggggcaaagagggggcct

SEQ ID NO: 77898 - DNA, 1035 bp, Homo sapiens
atctggcggggctattgttgaccatacaaaggatggaacgcggcagggcaggggcccaggcccgaggagtggacggagaagcaggagggaggatgcctggcctcccagtgcacccagtccctgccatggctgaggcatctgttttattgcttcttgggttggggagtggagggggcaaaggatccccctctacccttccagaatcttcagcttggatgctttaaactctggttctgagctgatttattactctgctaagatgcaaaggccgttttatgtactaggtaattaagtggcattatagacggctcgagagtaagtggctgctgttttaataattaaaataaatgacccctggactgttccccagctcaatactctttccgcagtgtcaagaccctggagagacagagtgagtgtgtgagtgtgcacatacctgtgtgtgtgtgtgcatatgggtgtgtgtgtgcatatgagggtgagtgtgtgaatatgcacttgtgtgtggatgtttctgggagcgtgcctttgtgtgtacatgtgggcatgtgcatacatttgtacacacgtgtgtgcatgcatgtgtgtgtgagggtgaggtgtgcaggagggatggaggaggaggtggctcctttgtgaccttctgtttccgtgagaacccttgggacacacctctcacccaggttgggggttccctgtcctggattaacttttgtttcacccagaggccaggccaacctaggcaggtttcggatatcgcctcctgtgtgggccagccctggttcaaacccgagctctggccctatgtggctgtggccaactgcccttcctcagaagcttggtttttgtgcctgtacagtgagggtggccatgtccatctcatgcaccatgtgcctgatgtccagcagcgcgttactgttcctcagtgattgtgtggcattgcgctgtggctctgtggcacttggttagggcttgtggaggtagaagggtgaaactggctggccactgccctcaggggtgccagaggagggaggg

SEQ ID NO: 77899 - DNA, 1042 bp, Homo sapiens
acaggccctcggggatgcacacaccagccagctggggcctgcccccctggggggctcagagtcaggtggtagagacattacaagatgagatagaataaaaaagaactagaggtgctggcgcccaggacagataaacggtgtcgtgcaactcaatagggaaatcaggaaggctccatggaggaggaggcttcagaaaagtgcggacgtgctcctgctgaccaaaaccctaacatgctgcaaggtgggcacaggcatatggggcatgtcctggggtcagctgggccctgctgctgctggcttctccaccctcttccatcttgtgggtctggggagggtgcaaggaggagagtgcaagaccctggtgcttcttggttatcaggaccagagagcagcaaggacgcagcagtgggtgcgaagaggtctccacctgtctgtccccttcactgcgcagaacaaacaacaaaacaagaaacttctgtggagagacagtgctctcttccatggctaatgggagtgaggtccagcctctatggagcgtaatctggtcatttctagacaattgcaaaggcaagtccccttcaaccagcaatcccaccacctgtgtacatgtaggctggaaatttttcctgcaggaaaacgggctgcttatacacttgcagatggtccgtgcccaggctgcttacttgaagcgatgcttgaaatggccaagtttgggaacagcccagggttccattgccaaggacctgtgcccaccccctgccccacataccctggaggccgtgctcagagggcagactctgctagcccatctggctcgtgcccaggaatggcacagtgaatttattccttcctgcctatgccattttgcatgtccccttgcccacagagaggcacaagggatgctggcacatggaggccagcacggcccacgggagtgggtgatttatgtctgccggctggtgagcgccatgccgctgccttctgcccgcctcgtgggaagcatggtgcctgacatctccctgcctgctctctcaccctccca

SEQ ID NO: 77900 - DNA, 1098 bp, Homo sapiens
gccccctcgttgggagggaccacgtgatggggtggttcatgccaaatgctgcccaggtgccatggtggccagtggacgtggggcagagtttgcttacaggccttttcagggtagcaggtgcctggtaggaggtgggcgcctgcccagacactgattccatgaggctgtcctgatgtaaatgggtgcagagttcatggggccaggcagggagaacaggcatttgagacctgggggagccgagggaccttggcaccttgcacacactggaggtcagtgtgaacctgaagccccacctctccggatggaggggaggggaggagaggtgggaggccaggggtgtatccctgaagatcccggctgtgagccagtcagccctggattcaaaatcttaggctaccaggaaccattcttggtgagtacgtaatttacagcactgtccagagcttcggtttccccacctgtaaaacagggcactgatagtgcttaccttggaggtctgagatgatccatgcagtgtgcttggccctgtgcctggcacatggtaaatgccaacaagacattggcagtgatgctgactggcaggagtgagtcgtccaccgagtgggtggtcaggaaagaccagtttccttttcaagtagcattcagtacgattctggagcgtagggctgggagagcacagagccccttgcagcttccttccctagtctcctgtgaccctccataatgttgcctgtttgctgtcagagttgtctccatcagttggcctcatggtcagcggtgcccaggacatttcggcgctgcgttacgacagctcattgtgcctctgggctcggggctggagcagacgggcgcagcagccctgcggctgaaagccaccgtcccctgcattggtggaggctgctggcatgccctcgtgtatcatcctgcctcttctctggggtctccccaccctcctccctggcctggccttctggaaacccatttgtgtttgttgctcttctggagtcttttctgcttgggttggggtgtccactatagactcttccatgaacccaacagccagacaatgagttattaggcaggtggggtgggggccgg

SEQ ID NO: 77901 - DNA, 1058 bp, Homo sapiens
cctagctcaatgaggcaggaggctggataggtgtgatgtcccaggccacccatgtgccaagaggtgccagaaagcaggaagaaaaggggcaggtgggatttgttgttctgatcagctcactggagacaggctcttgtcacagggggcattgaactgggcacctacctgcctgaaatatttacattggcaaaggcccggacaggccacaaattaccctgtgcatgtgattccatttcccagccactttttttctctaaggagttgctggcatcgtaaatcttactgcaaacagtggggaagaaaagaatctgagattctacaaagcacatttaacatccatgactgtgtttgatctttccagtggtggaggggcccgcctgctcccctgcagacgtggctgaacctccccgtcagggtagcccagtgctgctgcctgtgggcctttggtctgcgtctcagccttccagtggggcctacagaacggcacggctgtgcacctctggcacctgcacgcccaaaaggcacttggtcatcacagcagctggagctggggggttatcgtaacttggtagccattattattattattattattattactactactactattgctgctgtggctgtgcctgttccagtagctctggcaggcaggccttggcgagatggcctggggagggagtttgtgaggcccaggttagagtcctgcatgttggttctggaagggacttcttgtctcccagcccctcccccatgatccctgtctccggctggcccctcactgcactgcctttgtcttcctcatcctttgtcttcattcctccttcccgtgagggtggggtggtctgctgaagagggagtgtccctggcaggtggggtcacttgggcacaggcaggggtggcagggctggccggacagtaggtgggagtgggggaagctccagggctgactttgtgctggctgtgagttggagaagcccctcgtgggatctgggaggcaggggtgggttgccttcccccgcctactgggagggaaggaggcccctttccatttcctg

SEQ ID NO: 77902 - DNA, 1999 bp, Homo sapiens
actcagtccttctcctgggccagcttggtcctgcatgtcagagcaggaaggggtgccttaagctgtgtggcctggggacctttgggaccaccctcgaggggccctggccctggattttagatggggtcagagggtgggcttcgggaggcctgtgtgcaaagcagccatgctctgagttttactgaagggctcttgaaatcctcacccaaggtcacagtttgacttgtggtctgtttatgccttggatgtacccctggccctctttgtgggattgtggctactttttggggatggaggaagatgtggccattagtgtgagccaccctcattagacgggcacagatcggtgaggtttggaggagtggggtggtcacagcagcgggtttcccccgggttttctgttgcagctcagtttctggaagggagtggatggggtgtcatctcagcccacgtgtgtgatttggcctggtaggtgatttggattcctgatgtctacctctgccccctgtaggcagctgtgaaccacaggcggtctgtgggggttagtccgtgtagcagcgcaccagcttccagcctgggtgtccctgggtgggccccttgccctggaagccagctccctacttgtcttgttttatctctgacagctggtgatggccctggtggctcagggcaggccagtggaagcctggagaggggtgacctcatggcctgctcatccctggcagcctgcaggcccagcacatgcaggtccgctgtgcgcagaggcacaattcatacagggtcctccggcaggtgggacatacagggctgccaccctgttgtccatttaaggggaagaaagttagtggtcacatatgtttgtgggtgatttcctttggtgttggcagcttgcatttttgtggtgctttgagctcttgagagagttttctccctttctcagcaggtctttctggcaacccttcgaggtgtgttaccaacagaagggggtgagggtcgctgagtgattgctgggcgctggtgccagctgagctctggatggtagacagtaggcggctgaggccctggcggcagggggacccaggagccacgctcatgagtcatggggcctctcccaggttcctgagggccttggcactcccctggcgcagtcactaatgcacactaagcatcctaatgccctgcgctggctgagggccaggacgcggcctcaccccacgaagactcctgtgtacgggaactcaggtggaacagggctggatcctgggggcagggccagccagcaggaaggaagagcaccctgaccatccccgtggaggctgggaccaagccccgttccagatgccatccaaaaggccaccctctggctgcagtctcgaccctccaggaagtctttctgcccctccttgaaggcatttgccctgtgaccttgaccagtcactggcttctcagggtctgtgggtgcaaccctgggggtgacccatgggatggccagcgtcccacagaatggcttctacagcctgtccctgggtggggatctggcccctgacctccttaacctcctagaatcccctgcaggccatccaccagtctcttttgcagatgtggaagcaggttcagtaatgtgcctgggtcatagctgtgagtggtcaggccacctgacccggctggtgcccctcgggcggacacaaggaccaagtaaatcagatggtgctcatgaagctccttcccagcaggctaatgctgtcagcaccactgcctctcctctccgctctccccttatctccctgcattccctaaattcctcgcaggccaccctgcctcccctcctcacaggccgggagttccccacctcccttagctttattgcctccctgcccaaggtctggattgaacttggcagggttccctgtgcctcggcctgtgaggagtgagtggggatggggtgaggggagcatgtgggagggtgaggggagcgtatggggtgtgacaggacctgttt

SEQ ID NO: 77903 - DNA, 1157 bp, Homo sapiens
caccctttctccagaaaattaagaagctagtttctccctctttcggcaccttctgtcctggctggcaggggaaggctcccctcttctccccctcgcctttgcccagcccctcctgggggacctccctccgcttccgccattgtctcctttctcttgttccttttgggtctgtcctctggctccttccccacaaacaggctcacgtttcctggtccaaagcaacacagagcccctcctgtctactgctctgccccttggccttcctccctttgccagaggataaaccctagaggctgaggccacctccttccccatgtttgctccttggccctgggcaatcccaaaccctgagaatggtggctctggctctgtccagcagcctcttctcatctcaacttcctggtggcatctgatttccccctgggattgtcttccagaatggggtggtgtgctggtcacctaggacctctttgagcaacttccagcactctctccagcccctcctgcccagagggaaaacatcgccctgggctgggctgagcagtctctccctacctcttgctcctggccttgaggctcaggtgtccagattgctgctggtgactatgctattcaccttgtgtcttctgggtttgggtcccttcctctctcccctgcactcctgctcccctgcctaacccacgacccctcagagtcaaggtttcctggctctaaccccgagtggtgtccactagccatatgtagctgcttcaattcactttcattacaattaaatgacatgcagctgtaccgaccaccctgccttcgcatgggctagtaccgtgctgacagcgagatggggaaaattccatcataaagggaattccgctgggaagccctggtctagacgattcttccttgggctttgtgactcctacttgtccacggaaagaaacctgaaagctggctgggtgtggtggctcgcgcctgtcattccagcactttgggaggctgaggcaagctgatcacctgaggtcaggagttcgagaccagcctggccaacatggtgaaacctcatctctactaaaaatacaaaattagctgggcatggtggtacatgcctgtaatcccagttactcgggaggctgaggcaggagaatctcttgaacttgggaggt

SEQ ID NO: 77904 - DNA, 1545 bp, Homo sapiens
catgcccagataatttttgaattttttgtagagactggatctcactatgttgcccaggctggtctcgaacacctgggttcaagcagtcctcctgccttggcctcccaaagtgttgggattacagacgtgagccactgcacctggccttggctgcctttggtagaggtctggtctgggctgactggacttgggactgggctgtgcgttgctctagtccagtgtggcacactgagacaggtaaaccccaacaccagaaagtcaggttctccttcatgaactgataggattttcaaacaaaagaattttcagttctttttccagctgcccctccgcctgtctcctgtgccccacgacaggcaccatgcccccctcctgcccattgccaggcatttccttccctcccctgataacctgctcctccacggtccactcccctttagccaacctggaggaactaggattctagcaagcctgtgcatgagccccatttactttttaaagttcggattaaaattttgagcttctcaaaatgagacaggtttgttctcctgcttgtgtttttgttggtttaagagggaggatggaacggggtggtctgggcctttagaaaaagacagagcacgctaactctgaataggtcttttctgtgcagcagctcggctaataaggctgcttttcctaaacccagccaagctcaggaacaaaggtcagtgaagacaatggggtgggttagataagcctttccccctccttccccagcctgtcccaagggatccatcaatggccttgggatgctgggcctcagaaaggagggctggccttgagaggctcccaggcaggtgacccaggggtgggtaaactgtgcccagtgcttcacagtttgccacaaacagcatcccagtcccaattccattctgttcagagcttccaaatggtcccaggagggagaccttagcatctccatatcttagatggggaaatcagggcttggagtggtggtgcggtgacttgctctaggtcctgtggggctgattggggggcctgggatgcgtcttgggtctcctgtgtcagaattctgagcccatggccctgtgcctgctgcccagagagttccaggggagcggtgacctctgccacagagacagggcacctcctcccaggatgccaggcccggggcctcattcctgtctccctgtgtcctggcatggaggagtgggggaaggcggtgcagggtgggccaccttccctacgatggctgtggctccccatctcttggtttctccttccctcacttctctgcacgaggctggcttgccaccgcagcagtcgccccaccagacctcttgctcaggcctggcctctgagttcccaggaccagcacgtgatacagaaggaaatcagtggttgctcctaatctgttttccgccggtggggattttccaatccatgcttgttgccttcatttgcgcagagaattggaagtctgttaagcaagttcctgagcctccatgggcctctgttttctcttttgccaagtgggaaaat

SEQ ID NO: 77905 - DNA, 1854 bp, Homo sapiens
ggcgcgccaggaggccctgctgcgcgagaacctggagctcaaggagctggtgctgctgctggacgaggagcgcgcggcactggcggcgacgggggccgcaagcggtggcggcggcggcgggggcggcgccggctcccgcagctccatcgacagccaggccagcctgagcgggccgctgtcgggtggcgcgcccggcgcgggggcccgcgacgtgggcgacggcagcagtacgtccagcgcgggcagcggcggcagccccgaccaccaccaccacgtcccacccccgctgctgccccccgggccgcacaaggcccccgacggcaaggcaggagccacacgtcggtccctggacgacttgtcggcgccgccgcaccaccgcagcatccccaacggcctgcacggtaaggactacacgggccgggcagcgcgggtctccctggctgcagcccttttcccaggctgcggcgagaggaggtggtccctggctgtcccactcatgcggccgccactccagactcctccagctgtcatggatcctgggccaggggatcccgcactcacccaaagtggggctttgggcggtggtgggccggttcagtggtggagcgtctttttgtccagctcagaacctgctgccggtccggtcccagaaaagtttctagcgggtgtagttgccaaaattagggtctgtcactgctgggctggcggtgggcgcctcatcccagccttggaaatccttgcctagtagcgggaagttctaaacagcaaaggatacaaggccccttgagcgcaagtgaatttcccctcttgcagcaacaggtgtcctccaaaccaagcagcgtccacgtgtgtgcggtggctggagttctgcagtggggtgtggggattgggaaggtgcacaggcagccgcttgagacccagaggcagttggggagaggcctggggctcagagcctttcttgtttgccataaattccgcccttctagtcctgggacctttctcagccgagactctaagactttcccgagggagatgtatttggaacggattctagcttttctcctctgtgtgcctcagtttctttgtctgtgaaatggagatgatgacctctgcctcgtgggtttgaggtggagataaaccttctgaagggatttataaactgttgatcgccttacaggaagtgccgtggtcatccgtgaccagggtgtgggtgggaggaactttggcctctgtcagcttctgtcttctacgcccatgttactgctgcgcccagtgcagagggtggccccagcttggggctgtgggagcttgcagcctgctccctctcccagccccctgctcagcccttctgctccctgccagctttctcctcctcgctggtggatccggggcctccctgttcttccacgttttttggtagcttggcttccagttctgctggtagttgcaactgcctgaactttttgcctgaaggtggagaatgaacagctctttctggttccctttaaagcctttcctaattcagagaaagtgtgtctaagcctgcaataactgccctccccagaacccctcagcctgagctggggagggacgttttctccttagtttggtggccaagtggcctctgcagacgtgttggggtgggggctggggtgggagacatacccatggaggtggggcaggggcagtgcagcatgtttttcctttatttaccatcctgagcctgtgggttcaaggcaggactgggtttagagggatattttgttactgattagcaatctatggctacaactcaggtttctctttgtaacactgtatccacccccacctcccaccacaggctgcttcagggca

SEQ ID NO: 77906 - DNA, 1072 bp, Homo sapiens
ggatgatggaatacagcttcacaaaccctgccttgaaaagcaacccagagggaggacaccaaaatgctaacagcaagggaaactgatgcattcagtcggtgcatcagaaatcaccgctgagaagggcatgttctccgcactgtctttaagcacattacagatttttcccatcacgcgtcacttttgtcatgagctatcctccttagctgcttggagcttagggctgcacccctctgctctctccccctctccccaccaacccgcacgctggtgcatttggctttgattgcaatccttcattcactgactctgcacttaatggtcacctactatgtgctggtcacagtgccgagtactggaagaaaactgtaaatacaagtcattttttctagtggaattttcaccctataccacagtccgggaggactgaatggtctgagcgggaccactctactattacagttgaggacaccaagattccacagagtgtgtggtaaagagcttgagtttctgggcccaggctgtctgggctggatcccagcggtgcggcaactgggcgatgttatttgagctttctgagctccgctgccacatctgtaaagtggggatcatactaggacacacctacctaaacgactgttgtgaggacaagacgaaatagatgatgtgttgtgtccaacgcatgggacaggcctggcgcacaggaaggtgggggatgcatgttgagtgaatgaatggttacccggctgtaagtagttaaggcggacagcatcccagggtctctggccccacagcctaggctcaccctgcacctggctcagcggtcagccggcgccccagcacctgccccgcggagcccgtgagccctggctcagggcgaccccgagccgcgccctctcccaccccgcccgcaggtcggcgctgctgggcaaggtgctgcgcatcgacgtggaccgtaaggagcgcggcctgccctacggcatcccgcccgacaacccgttcgtgggcgaccccgcggcgcagcccgaggtctacgccctgggcgtgcgcaacatgtggcgctgctccttcg

SEQ ID NO: 77907 - DNA, 1936 bp, Homo sapiens
cttctgcatcatccccatttttatataatatgtaagaattcaaagcttggaacaaaacctttcccttcaccctctcgttccctgtagctgccgccccctatggtaacccacctggctgactgcctgcctttgggcctcccttttctcccctctggttctctctgccccatacctctccaccaaacttgctgggggctcggttcccggtgatctccatgttgtcgcacccagccgtcagccctggatcctcgtctgacctggcccccagcagcctgggcagagccgatgccccctccgccttgtcccgcatcctcctctggcttctcacccaactctcctggctctcttccctcctccccagtgctcccgctcagtccacttggctggctgtccctatgctcccaacttctcagtgatggcttagttcttggtcctcttctctgtctgtatccattcccttgtggcctcatccaatcactgggctggaaataccacttctctgctgtgggctctcaaatttatgtctctagcctacagcccttccctgggctccagatctgagtgtctaacttcctgctcaatagtccaccacaaaccttaccggtcccaagccaagctcctaatttcatctgcttgtctgagattggtccccccaaagctgatcctgagataagaaatgaagtgtaagtagtttaggaggtgggggatgatcccagtttgagcagtgggaggaggagagtggataaagaaggtaaacaaaccaataaaacaagttacctcttggggaaacaggtgcaattccctgggaaccctggggacttgtgtagagcacatgcccagagctaccccagaagtggaggggctgaggtcattggtggagggctgctcaaagtgggttcatctcctgtgggcagagccagagacggccctggcaaattgcagggggtgggcacggtggctctgccaccccaaccagctcctcctcatcttggtagatggtcgctccatccattcttccagcagcccaggccaaaaacacagagtcatcctcacacccccatagccaaacggcacgttccagtattccgcctcacagagcattcagaatctgacctcttcttatcattgcctccgctgccctgctctgttctgagccctcgtcacctctcccagtccttccctgtcactagtgtccctgcttcctcccctaccctggttactctctgcactgctgcaaaacaatccattcaaacccaagtcagatcccatctctgctctgctcaaaaccctctagtggaccccagctcaccaaagtcaaagcaaaaatctggaccacagcccacaaggctctacatgacctgcccccagtcttggtgacccaccttgtactctgtttccctcaagtactctgcccgagccacactggcttcctcactgtccaagcacactctgacctcaggaccttggcacctgctgttcccattgcttggaaggctcttcccccgcttcttgcaggtctcatctcacaagccaccctcttagagggacactgcgtgccctgcctgcattaacccatttatgcctgaggttgcaattttttgaatttgaaaaatcagaccttggtgttgaccttgagcagtaggacataaataacttccacaagcttagcgttccaataatggaacactaggcataaatgggttttaaacggacacccacacactcatccccagcccttcctcttccccgtactctgttctctttttctcctatcaccctctgacattgtctttacttgtttatttactctccgcctttccctgggagaacgtgattttgttgtcacccattggggatgctgcattgagcttggtaggaataaagtcatacaggagacaggaagtcatgggccccttggaatgagcttcaggatgac

SEQ ID NO: 77908 - DNA, 1020 bp, Homo sapiens
gactcctcgggcaagggccgtgcccgcccacctctgctgcccacggccacccacccttctcccctgccccgtcccctgggccacccttcacgctggcttccagcgggccctctgccgaccgcctgcttcacacccctcagcgctccctgtcgcctgcggactccatggcccttcctggactggcccttgcccaactcccagccaccaccactgtccctaccactgagcccttgcacaggccacttgctcagacgagacaccctaactcttgctcactccctaaagccctcttcaggggtcacctcctccaagaagccctccttgccaccccccgccggcaggggcccctcctctgtgctccctcggtcacctgtgctacctctaacaccacactgaccacactgtatcgtgagtgtccgttgacgtgaccaattgccctgccaggctgtcagcgcctcaagggtagggtctgcgtgtgatttgtctctgagccccctgtgcccacccagggcccggcacagagtcgatgctcaataaatgtgtgttgactgcatgaatgacctggaaccaggccatgcgctctcgcctcagcttgctcgtctgtgaaaagggggagatgcggaggctggcacagctttggaagccaccagcccgcagatgccccgcagatgccctgacaacgctgccttgggagagactgccccaggttaccagcctgttccctgtgctgtattcacggccatgcccctgggtgttgtgtgaggttgggcctgggtgggtgactggctctgagagctggatttgagaggtcagagaggcccctgggcctctcttgggagcagcttggtggagctgagccccgtgcctgtgggcacctgctgccctcctgacctggcaggggggcagggcaggtgagactgcatccctcgtggtggtgatgggagaagccgtcccttcctctccagggccgtgtcctctgagctcatccaaggaagaggtcctgccctgagtttctccttc

SEQ ID NO: 77909 - DNA, 1046 bp, Homo sapiens
cccaattaacaatcctgctaggacaggaataagctcttaaacttctccctctgcccacagcatatagcaccagtccttactaacccatgcactaaccgtgccgcacgcagagtgacagagccctgtccctcacctgccatctactgatgtccaagctgggcttctggaaggacaggcctctgagcccaagcgagacctacgagttttcctaattttaacttactcagttcttatttcacctactctattcaacctgcacaagttagtacctaccatttcagattttggcatggaactgaattatgactgatgcaacaggaagtgtaaacgttctgcagtctctttgggaccaagctcattcttgggttagatgatccattttatatattctaatttattgcttcccactcgttatttggcgcatctttacttactttactccatgggtataaaatgcgaaccattaacagcatttatacgtgtatggcctggaaaagttacaaactcatagatctatgtgtttctccgactgcgctattttctcctaactcttggtgtctttctgatgtagaataaatactgatttccttagtcctgtagcaagttaacaagcctgtaacgtgacagatctgtatcccaggggctgatcatagagaaaccacaaagcgatgttttagctgcgtcgagtcctcaacacgggggacttccagcctggtaccaggatagcctctctggcccagtgtgagcgaaggttcgagctgacttgccagtcccgtgctaagtctcactgaggcagggccttgctgccgcggaaaaacgtgtggacagaggaacgcgccggtcggatgtgggccacagtgagccgcggcgtggaaacggccgaaatgtgcgggcgcgttgtccatgtttggtcgtggagctgcccgcgggcgcgggaacagcgcgtcgggggcgggtgggcttgggtgtccgtggcggaggttaccccgggccccacgcgcccgctctctcccggccttggtctttgtccccgcgcccccgcaagg

SEQ ID NO: 77910 - DNA, 1037 bp, Homo sapiens
tagtatagagtcatgggaacggttttgctctccagtaggttaaatagattcctcaattaacattttgaataggttccttaattgacttataatcaatcatatttgaattattgtttttgatctaaaaagtagttatatgcttatggtagaattctccctatgcttagttggaaagatatgtggctgaaatttgtattaaatgactttgaggcatcaggtcttacaaatttaatctgtgggcgtattattgacagcttgatttgcgatatgaaaatgagcctagatatttttattggagcagttgtttggggcctggtcatactgttcctaaatagcagtttagtcatgaagttgacctacacgtctgttcatgaatgttttcgttttctgcattttccttttaattgccagcctagagatattggcatggtattttactggtggtgatgtccagaagaaagtaaaaaccaactcttatattttgtagaagtattggtttaaagaaaaaccaccttaactagaatcaaacaataagatcactttataactattgaattacttttctcaaaaagttctcagctctgtatttgttattttttttttaggttgtctaatgaataaagtttaaagcaagagtggcctatggggcagaagtcaatgttaactggtgatgtcttaggcaacagatgttttgatgtgaaacattttaagaggctttcattaagtgaagatataaatgaatacaagtcagttaattactatgatgattcaattaaagcagtggatcacagaaatgccatttcactaggaactaaattaaacatttggatatttcattagctacattggcaaacaattttttctttttaaatgagagacttacattacaatggcaagacagcagcataatacatgaactcatacattttcatatgttcagtatgcgtcatgctgttaatagtgacagaaactaaaaaatcatggttacagctttagaaaatataattcacacatattatttggatgactgtcatagt

SEQ ID NO: 77911 - DNA, 1088 bp, Homo sapiens
aataagtagagacgtttgcaaaaagcatttggtggtttcactggcttaaaacaaattattttcagccaaagtaattgacacaatgaagtggtttttggcaactccagcatttttaacagtaaaaaggatttgacttaaatcgccccccaaaaagttatgtaacatgaattttaccattcttagaaaaatatgttccagttgagaaacgattgaatggaattaggactctcttatactgcagcattactgtgcactttagccccagctgtcttcatcacaaacacttgaaaatccttaggaatagaacttagtgatgatgctttatctactattgagtcgcttatgcttaccaatcctgtatgcaaaatgtggcagccgctcccaggggactgtatggagctataataaagataatgatctgttagctcggcttcaccgaattagtcctttagaaagtaattaagcaggattgcccacactccactgctcccaaagactgaaatctggcttggtgtgtcatttctttgccttccttgaaaatggccttttattgagttgatataatttaattatataaaaatacgtgttcagattgcatcttgtacttaattatatcttacgccacggagttatttcccagccagagcttgtgctgttagaaggtggggtccatgtctcattcatgcgtgtatgtgtgtgtttaggtgcaggagaggaggggagagaaatgctggctttaaagagtgctcaccaagcatcaggtgttgggctgagcatttttaatgtattcttttgtttaattctcacaacacccttttgaagtgggtcctattattgtctccattttgaccgacaaggaaacagaggcccaaaactttgagtaacttgttcaagattgcctggccagtgtgtttcagagctggggtttgaagccaagcattctggctccactgtccatggtatactaagtactcagttatgctcgatgagtgaatgatgggaaaaaagatgggacagctatagacctgaaagggacttaggagattgttctggtctgcccttgcctgtaggagaggccacacatggtt

SEQ ID NO: 77912 - DNA, 1039 bp, Homo sapiens
gctagtgagttccttgagggcaggggcgctgtgttgtctttttctttcgtttgcttctttcccctgctctgcacagtgcctcgcagggagtttgtctccagtacattcttgttgaatgaaaaatcagatgctgaaattatgcaaagagctgtgttatctttaaattattataagagacaaggagagaacttctggatcctgagaagcttttcagtaataccagaaacatttcttcattgtgtacggtaataaaataacacacagtcataggtggcaaagcctcctaattactgtaggttggagtcagagtgtaagaacttccagcattcatggatcacatatattatatacgtatttagtgaaaaacaatatatattatttaattttgtttatttttctatttttgttcaaaatggtctctaaatgcaggccaaccacggtgtgtatttaactccccaaacaggaatctattccagtcttggagggatttgctgagagatgatacagtttacacaaaaccacgtatgctccacactgtggactatctggggaatttttcaagagtaatttcaacacactctattttccatccaattcactgcccttagaacataaccccaatataaaatgatctcctttctaatattttacagtttttaaagcaccttcagatctgtttctcacttaattctcacaaccaaactctaaggtaagtaaaatactactttatcatatttatcttacatgtaatcagggaagctgatgggtgctgagtaacttagccaaggccaaatagttcagtgaggaccacatctcgatcctaggtctcccgaaaaaaaccccaggtttctttgaactataccaagtggctttctatttgttgtcttcatgttagcatccgtgttgacctggtaatctatacctttataaaaagagaaaatacgctatagataattgaatttttgcaaattttgttatttttttccctgcaccttgaaaattgttatgccctgctttaagaaaccccgacattctgtaa

SEQ ID NO: 77913 - DNA, 1033 bp, Homo sapiens
gcaggtggggtagggaggggagtcagccttcctcctctgcagggttgcagaaagtttcaggggtcaaggaaataataaacacctttgaatagaggctcagaattgtttgtttggagttcccagtgactagtatctcagctgccaacagctttggtgcaatttacttttctttagctgaacattcttacgtggttttaaaagcaagtaaacagataaagtgtttctaagtgtaataattctctttcctgatgcatagctaacaagcagtgagcaggcagaggggccctaaaccaaaggctctctcatttactctgtaaaaaatctgttccacactgcgtaacctccacatccttctcctaaggctgaataaattgggtgccaccctttgaaatgtagtactctgtttggcccaggaaccgtagttagccgtctttcttgaggaaagctgattaatcttgttttgccaagcagaaggattatgggtatggctgaaccagttttgtacgctttgaaatatcagccctgtcaattttgtgtttctcagtgagggaggaacaggggacggtctcacgcaagagaaatcctggcttttgatttaaggaaaaaacccccagccacttagctttttttctttttaatcattatcttcaagacaaaaattcaaataccctaacatgtacaattatatagtgtttttgttgtagaaaatatcatttggtagattatcaagactgacaaaaataactatctttacctattaaaaacgattgagatggccaggtgtggtggctcacgcctgtaatcccagcactgtgggaggccgaggcagaaggattgcctgagcccaggagtttgagaccagcctaggtcgcatagtgagacccggtctctataaaaatttagccagttgtggtggcgtgtgcctgtagtcccagttacttgggaggctgaggtgggaggatcgcttgagcctgggaagatagttgctgcagtgagctacaatcatgccacagctctccagcctgggaggcag

SEQ ID NO: 77914 - DNA, 1042 bp, Homo sapiens
agagagcagagatgttattctatgtgacactctgaaaagctttttgatctccgttgctaggcctgtcttttgaatatccatgtggaagtatgacgttctatgtatatatttgtatgcttagcaataaaataaagtcacgatattaaggagttcactgtcacttccattccacccttagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaaggtaaggacgtcttatctctcagttcctgctgttcagatatgttagtacggcttgtccccagagaggagtcagaagatcccctcatattccaacaagctgggagtactcttggagaagaagaccttctcctcaggtatttataggactaatcaaacagccatttgagggcagctgccaggcacagttcacacaaactaccgtccaggtggaaaaactgtcactcagattcccagcactctcatgtagacataagtagttcctgagaatttcttagtaccaagtacctagaactggggaagccattctgaatttctacctgagcaccttcgatttctagtacactctcctgacctttttaagttcattttaatggactgctttaagtttgtcagcagtattttctgagacacagtggctgaaaagttgtaattttatgatttatcagaggctatgtttcatattgatgctaacaccagaaatgtgaaccatttttctttatggtttcatgaaatacgtggactccaaatttttgagtttttctatgaggttagtttgtaatggattatgataagtatcagtgaaactaatagtaacattttgttcctgaatgctgctttttggcattttagcagcttgttttgtgtctatataatatatttatatctatataatgtactttgtaaagaaaatccagtttctctatgtatttttacctaacattgtactttg

SEQ ID NO: 77915 - DNA, 1097 bp, Homo sapiens
gacagggtttcaccatgttggtcaggctggtctcgaactcctgacctcaggcgatccacctgcctcagcctcccaaagtgctgggattacaggcgtgagccaccacacctggtctgttaagctcttaatattatttggtggtgaccatcttatgaatttaggcatggtgacaccttagcaacaaaacagactttaaaagaataacccatatgtgagattccattttacttgtcatttttcatttctaaaattcagacacatttagatgcacaaattaaagtgtcagttcccatggtactattgtcaaaaattggccattcaaattctaaaacttggtagacctctccttactgttaaattatcaacaaggccctccacctcctgaagtcatcgggaatgttttatttacataaaaaggcagactcctgaaatgcagaaaaagatcttttgttttgacaaagtccgagttactgcccaagtaatcttgtagcttcaaggtaaagacacatgtgtatcaccatcacaattgatggctctgtgtttcttttctgaacagcaattgcccccacatgtgcgcatctgggattctgtgacattgaatactctccacgtcattggaataggtttttttgaccgagcagtcacctgtattgcattctcaaaatctgtaagtatgtgccctgtggatattgctgtcttcttccacaggaagtagagaatcaactcagggttgaagagggggagttgacacactcgatacctgcctgggtgtatgtacagatttggactctgaaacattcctgcttcccagaacccctcagtcagaggtcatatgcatgtctcatcagggacacacacttccttccaatcagacatctccagccacatgggtttggtgatgaaaacaggcccccagagatatcgtcctcactttccttaaggcagtttatgtgctctggccttgaatttcacctgcttctttcaagggtggctccagcgtgtctgtctctgccatcctgctactggaaaggggtcccgatccagaccccaagggagagttcttggatctcttgtaagaattcaaggcaagtccatag

SEQ ID NO: 77916 - DNA, 1035 bp, Homo sapiens
cttaggctccggggggcctgcggcggcctgggaggcagacccccgcgggcaggtgtggccgtgtcccgaccgcgcgaggaccgaagttggcggaagcccctgtgcggtgccttccagcccggaggaggctggcctgaagcccccaggcgttgccgaagcctccccctgccagcgcccagagccgcgtttgggcttttacaggtgtagtttcccctcgacttggagcccgtcaaccccttcgtctcctaattctcaaccccccttttttttcttcttgcacgccagtaaagtgcaaggcccccaaatgtaccgctcgttgatgtatcacccagctcgggagcctgctgattatcaggccaagaaataaaaccttgcttctgccagaagcccggtgccctctcccagtcgctaaaccctcccttcctctccagatcctgtcgtgacttttttggggtaatcactttttttttttccatttgtaattttgctttctgaacacgtatctcgtaaaaactgtagtttgtaactatagtttcgttttgcctgttttgtattatttatgacaatgaaataatacagtattcttttgtgtctggtgtttttcaagatgttttcgagatccattccgttgtaatcgttatttgttcatttttattggtctatagtattctgttgtaagaatataccacagtgtacgcattctactgttactagacattttagttgtttctagctttgttggctattaataatgctgttatggatattgttgtgtatctcctggtgcattcatttcgattgggtagatatctagtagaatttttaggtcaaaagataagcatatctttagcattagcggtaaacaccaagttgccaaagtggttctacgagctgacattcttaccaaaaaatgtgtgagagttcttgttgcttcacctccttctcaacacttggtattgtcagtcttaaattttaaccattctggtgattatgaaatgatatcccattgtggttttaatctgcagtttcctgttg

SEQ ID NO: 77917 - DNA, 1021 bp, Homo sapiens
tgacctcaggtgatcaacccgccttggcctcccaaactgctgggattacaggcatgagccaccgaaaatagtttcctgtaaaatattagaaagcttacatgtgttttcccttttacattaagatatatggttcaccagaaattcatttttgtgtgacataatgtgaaaaaggggttaaattttatttttacttaacaccatttttttcagcaccatttattaaaaagataatcttttccccataactctgttgtaccacctttgtcatcttccagtcttcgctttggagttattttctttctgcctgaagaatactcttcagtattctttagtgcaggtctggcaacaaattcttagtgtttgtcgaaaaacatcattatttattcttcattgttttcttttttgtaagttttattgagatataattcacacagtaaaatgtacccatttaaagcctatggtttagtggtttttagaatattcagttatacaaccattaccacatctaattttagaacttttttccatttgtgaagtgtctttttattagttttatagaactcttggtttgccattgatttcttttagcattttaaaaatttaattcactttatttttcttgtataaaaatcctgcattgtataatagccatagctggagcctgggttctctgcagtggagactctggtcagtgaattcctagtttcctaataggtagacttggtgaatatggtctccttccagagcttggggatcagatagctgtaggtctttgagatgacattaacagtggccttggtgaagttgcccagggtggcagtgcagcccctgactgaggtgtggcagtccttaatgccagccatcatcaacagctttttgggcacagagatcaagatgaaaccattgtctctgtgtgtagagatgaggtgtaccagcacagagttgcagtggtctgtcaccttgcaaggaatgccgtggggcttgccagtgttgtctcctgagatgcctctctgcaccggga

SEQ ID NO: 77918 - DNA, 1681 bp, Homo sapiens
tccatcacccctcctctgctgtatataatctgctattaaaaccacccattgagtttttaatttcagggtttttaaaaattatttttaaatttcttttttgttttttatttttattatttttcagagtctcattcctttgctcaggctagagtgcagtggctcagtcatgactcactacagccttaaactcccaccttagcctcccaagtagctgcagctacaggcacacgcccccatggccagcttttatttatttatttatttatttatttatttatttatttatttaagtgacagggtcttgctgtgttgcccaggctggtctcaaactcttggcctccagtgatactcctgcctcagcctcccaaagtgctaggattacaggcatgagccattgtgcccagctgatttttatatttctatttgtttctgttttatacttccaagctatctgccaaaattatcagtcttgtcttttacctcctttaacatagtatgtgtaattatcttaaagtccatgttcaattatggcaatctgttagttgtttccagtgtctgtttctgttgattttcattcatattgtcttgtctccttatgtgcctagtgttttttttaatgtgtggtaaacatcatatttgcaaaattatttgtaggaataatttgaggcctaagatgatgcttttttcttccagagataattaatatctgctgttataaggcacatgggagcacttacaattggcgttgccttcagtacagtttcagggattgaaatatctctaagctgagctgcagttcttgtgaagacaaacctgttctgttcacttttcctcctaatgttctcttcttcaccagcacctttactctccaccccagcgccaatcttttagcattcccttcagaattgataaacacccttcaggaaaattagcctcaaacactgagctcactttctcaggctctgacttgctttcctcccccgtgcctccaagcaggtatttcttacatttttcccagcgtttctagttctttttagatggaggattgttctgattgttctgattagtccacagttactatcagtaaaagtccctgatttttgcattttcaggaacagtttgagtcaatattcaattctggagattcatgctaccaggttatggaagctgtagagaacagtgacacctattttcttgtgttctgtcctaattgtattagattatctctgccagtttgtgaaatgcttttggaatcaagataactttaagaataagtctttaactcctcttaataaataattaattgaaaaaaatagcagtttagctcaggtcattaaaacaaaagatttggggggcaggtacttttatctcctttccatggttcctttctcctgtcttgatttccttatttatttgataaaaattatgctctaaccagtcctcctgaatagaaatttaatttattttttatttttattttttagatggagtctcactctgttgcctgggctggagcacagtggtgcgatctcagctcactgcaacctccatctcccaggttcaagtgattctcctgcctcagcctcccgagtagctgggattacagacatccgccactatgtgcggctaatacatcgtattttcatccgccactacgcgcggctaatattttgtattttta

SEQ ID NO: 77919 - DNA, 1065 bp, Homo sapiens
atttgcattgtattaggtgttataagtaatctagagatgatttaaggtatatgggaagatatacctgggctatatgcaaatatgactccattttacctaagggatttgaacatctgcaaactttggtatctgagatgggtcctggaaccagtctcctgtggatactgagtatgactgtataacagttttaaaaattcattcttcaaatggtctgaaatatgagatggagacttaaattatatttttctcaaaattgctggtcagatacttgatcatatcagtagtttatgtggtagagataacagcaacattttctgggttggacggccgtgcaggcatctggatcccaacatcccggggtgcatggttgtggctggtaatgcctacatgagtgagaatcacctctaattctcagaaagttacctgcctcccccggggccagccttgtacatgtgaggcatggccagtccagcctgtcaacaggtctggttacgagccaagaaccgcttcatctgggccaagggcactttattgatattggagttctacagaatgcagtgtgattacagaatacagtataaaatacacaggtacaaacagtctccatttctcacccttagcctatactagctatcacagttgggtccaaatatatttctgaacccagtgctgcaaattgcaggtacggggcatttcctaaggtggcttttgtaagggctatagggattccgtgtgtatctttccaggctctcttgttctgtctgcctgtttttaggcctatgccattaccatatttaccttgtgggcagtgattttaatttgagcggcatcattgattaatgttattttgaattttgctggtttggtgattttgtttgtatttaatttataagtttgttttttgcttatctagttatataaacataagacatttaaacttagttttatagttgtgtatataagctgggtgtggtgtcacatgcctgtaatcccagctactcgggaggctgagcagaaggatggcttgaggccaaaagtttgagaccggcggcggtgggcaacata

SEQ ID NO: 77920 - DNA, 1146 bp, Homo sapiens
gtgaaattcatggaagtcatgacagaaagggaaacatgagccagtgtgtgcctctccttgggtaataaaggagagacatgccattttatagctctaaaggtgtgtttcctatggaacttaaagagacagtggaccttacaagagcttggttttggcagccgcctacacccttctccagtccttttcccatgtatttgtcctgggcctcttctttaaaaggttccagcactctcaaccattctctgggtcctgcctgctgctctgctgcttttgtggagctgtgtttattgcacttatcttctcttctcccttctctctcaaagaattcttaaataagaaaagatctgttgctaaatcatgcaagttgatctcagtctagctgcttccttttcctctttaccttgctaacttcttagccttcaaatcttatttgaaacatcacttcctcagggaggcagcctttgacccttagcctagctgagggccctttcctgttaattacctttgtgatatcccatatttcctcttctgtaactgtttatatgtatgtaattacttaaaatttccctgatctactgaaggctttataaaggcagagattatgcttgttttgatctctgctagaaccccagaaccccaagcactggtacttggcacttggtagatgtttaataaaacattgacactgccacctgtacctaagatggatagttgatcgtggcattcatcccagtttggcatggatccttctaaggacagcatttcaggtggccacccccaaatcgtagaagctagcatccaagcaaaagctattttattatgtgcttaatgacttaatgcattactgaggtgtcagtgatttagtctgttgtgtccttactgctgccataagacatgatttgtttggtgatgtgtggatgggtatttttttctgtgatttctttgtaaggacgttatccactgtaacccttagtatcccagatgtttctcaaacttgaatatgtgtaggaatcactggagggatgtgtatgtatgtatgtgtctttccaaaatggagaccccagccccatccccaaggatgaatgaatgcttttctttcttttttaaattaatagactttgtattttagaacagttttagatttat

SEQ ID NO: 77921 - DNA, 1031 bp, Homo sapiens
gatcagttgagactggttttggtcaggagggcaactcgatgggtttttgaggcatatttgataatattagctaccattgattgtggttaatgtgtgtaatgcacatcacagcatccccacaaaatacatgctgtcttccccattttaggatgaggaaactgagacttaggctggtgagaatttgcccaaggcttctcagggagataggagtagaactggattcagaatcaagtggctttccatagccacttgtggagagaaggtggaagcactatggatccgggaccgagggtcccctggccattggaaagatctttgattgggccatgagaaaagaatagtatttttagtcatgttcatagctgatttccatttgtggctccttgtgtttcatctccacacagcacaggtggaggtgatatggttagggtgcggagtcagtgcagggccatgccgaggggccaggttggcaagtttgagagctgggttgaagcatacaatggtcagattgtgcgggagccaaatgccaagtttgggggctgagactattatgcagacagtaaaaaagaatggtaggtttattttttatatttttatggttacatagtagatatttctatttatagggtacatgagatattttgatataggcagatatgtgtaataactaattacaaatgggacaaatggggtatccatcacctcaaacatttattatttctttgtgttgctgacattccagttatactcttttagttatttttaaatgtacaataaattagtgttgactgtaatcaccctattgtgctatcagatactagcatttgattcttattcattctaactctattttaatagataaaatatgatcagtcccctgcccattggttacccatgaacatccccaacccttcccagcctctggtaaccatcattctactctctattctactcacaagttcgattgtttcaatttttagcccctattctaatttttaacttaaatttaatttttagctctcattcttctc

SEQ ID NO: 77922 - DNA, 1171 bp, Homo sapiens
ggttgcttccaaatcttggctattgtcaacagtgctgcagtaaacatgagagtgcagatatctcttcagtatactgatttcctttctttggggtatatatctagcagtggaattgctggatcatatgaacactttagttttagtttttgagttgtgggttttttaactggcaattggtagggttgaaaactgtgcaggaagggagtaagacaggcaggagatcaggtagaggctagaagggtcttaattagggttgtagaagtgaaaccagggagaaatgggcctctgaagacactgttgaattcctcttattaccgctcagccccctggccattggaaagatccttgattgggccatgagaaaagaatagtatttttagtcatgatcatagctgacttccatttgtggctccttctgtttcatctccacacagcacagaagtgaatgtgcatattagtaaatgttgaaatagagttctttttttacttgattggcacattagattctgttcagatgctcagtccttattttgcttcacgtccatcatggctgtgtgccccacagcctaaaaaagtggcagaggaaatgttgattgtaaggtctcaagtccacgggacatcagggccttaaactctctgtttattggcctccaagtgaactgtaatgagattcagtactaacaaatcataaattccttttcttggacagttgaccatttcgtatgaaaagacatgggttgcaaaacgaaggtaccggttaagctgaggacacttgtttaaaatattctcatttagctttcccacattgtcaggaacccagggccatttcctgttcatgtttgtgtttgtatcagcgtctccatgtttgtttctccggagaagtcccgggcagctcacatgtccagtaactgcagatgagtgttctaccatggtagtaccgctggggctagggagggtattcttaggaatgacactagaaagaggaagtgaatccagattaactagggtgagtgtgacagtttgtagctgggagagccccacagatcattagcgccggcagggactgccagagtcatttaggccagtgtgttcaggttgagcctgtcctggtagagagagggaaggccttgcagcagggactctagggcccctccaccttcttcagctggaa

SEQ ID NO: 77923 - DNA, 1562 bp, Homo sapiens
ggggggtgtggaaaccccgcctcatttttctgcactttgcaccatctgactaactaaatggttgtcctccataccaaaaagactaccacacaatctaaggaaattgtctctgactaggtcatgtttgcatttgaagaattcaggtatgttctgggctttctacatcagtctgctgctggctttttgttctcgctaggtttttgctgtgtaatgacagcttaggctctggctggttctcacaaaaaaaacagggttcttttcagcttgtggtggggtttatcccagtcatgggggtgggaggtgcagaggtggtgcaggtcaggggtgtttactgtgtgcagaagtgcagcgtggataattggtctgatcatgggtgaatttgtccaggaccccaccttgtgccttatttgagctgctgttgctggtgtagagttgtgaatacagaatagcaactgtgtgtccagaatgagtctcttgctatcttttgtttttcttcctttgtcaactcatgcagtctactgctctttttaaaaaatgctgattgtagcagtgaaggtgaaaaattctacaagtctgtctgcatagttgagatttgattttggctcttcttgtcttcattatttttagtagtaatctcatcgccggtctgttttctggaaagtgccctgatagtgttttgttaacagggctctttgctttcgtatgcttttcagctgctgtaattattagtgctccaaattagatcttttgtgaatcttactccctctcttctccaggaatctatccctgtatataaatgtgggaagggatgttccaatagaaggagtttctaagaaatgaaaataaaggaggcggaatgggagggtcatcagattcttcttgtgcatatttccacctctctggaacatatggaagagagtgtgtgtgtgtgtgcacgcacacacacacacttccgacttctgaaagcttctcatttttcaaatgcaatttttgtgcattttagaactgagcataaattccatattgatgggcaaagagtgattgtgcgggaacctcagttctacctctatgggccttttttattcctccaaatgttgctgcggtagacattaaaacaataagagaataaccacctttcattcttctaagagaaaactacagacctgttagccagtcaagggagtagataagaggatcattagatctccacaaagaaaagtcggaccgtaaaggtcgtcccctgcccttttcagtaaacttgatactttggattcaggaagttatcctttgtttagtcgtgtgtctctgcattatttctaatggcctgggtttgcgacaaagaaattctttttatgtggcagtgtgctctggtgacatgggcccctgcccttacagagtgaccagaacttttataatagccccattagatgactaacaagaatttatataatgtctggcgtgttacagtagataggcccctgggttctaatgtctgtttcagaagtagcttttgtgatccttgtgagagttatggaagcgttctgtaatttgtagaaagtagc

SEQ ID NO: 77924 - DNA, 1155 bp, Homo sapiens
cactctctgtcacccgggctggagtgcagtggcacaatctcagctcactgcaacctctgcatcctggattcaagcaatccttctgcctcagcctcccaagtagctgtgattacaggcatgcaccaccacgcccagataatttttttgtatttttagtagagacagggtttcaccatgttggccaggctgttcttgaactcctgacctcatgtgatctacccaccttggcccccagaagtgctgggtttacaggcgtgagccaccacacctggctggccacattcgtttttaaaaggaagtctgattttgactcagatgcatttacttattggactatgaattccatgagagcagaattcataaaaacaacagaatcctgcctgtttttgtttccttggcacctacaactgcttgacacacagtaagaccttaatgagcagttggtacagtgcattttaaccagaacttaaggaaaagcaagcaagctatccagctagctcggcacagtcctgaggtcggtgccatggtgccacgtgggctgttttgtgtgctggttcaggagaacgtgtggaaaagctgataactgatctcctgagaaaagcgtggtgtcctcagcacaccccacttgctggagtgccagagaagtcatcacgtttcattaaggaatccctgcagatgatctcactccactgagcactgatggttgtgatgatttactgctgcctgggtcccacgcctagagagtaataggagcttgagaggttgggccagtgttttacagctgcctaggggatttttgtctgccattgcctacaagactattgttctaccaccaggcaagctgttctagctggctcttggggtagacacaggtcacttgtccttttgcccttttttttttttaattttttttttttggaacacagtctcactttgtcacctgggttggcgtgcagcggcaggatctcagctcactgcaacctccacatcccaagttcaagcaattctcctgccctagcctcctgagcagctgggattacaagtgcccaccaccaagcccggctaatttttttttttttttttttttttttgagatggagtttcgctcttgtctcgggctccagcaattctcctgtctcagcctcccgagtagct

SEQ ID NO: 77925 - DNA, 2060 bp, Homo sapiens
ggatgtgggagggcccttttgatactaggataaccattcattgaacaaatacttccagaacatctactcaatataagccacagtagaaaatgtaaatatgtgtaatccttagtcctgcctccaggaacactgtcctcaagaggtgtggaacagacagaccaaaagcatggagtagcaggtagcaaagataatactaacataggagattgggatagattccatagggatacagataacgtgctgtggccgggaggtggacacagttttgctgtataaaagttaaaagagattttcaggaggaagcatctgtgggagtgagccttggagggtataggattggggtggatgaaaatcaagacaagggctgttagtaggtgtgcgggagctgaggtataggaacagggggacagtgtgctcttagccatgctttagctgattgaggggagagtttttgctgtcttctcagggtataacccaggtccattttgtcctttccctgtgactggtgacttctctgccctgaagttggctactctgcagagataaacattttcacctctggggaataagtagtagtgatgggaaatcctactaggtgttttgccatgctgctagcaccttgacttttcttatcaccttgagcaattacttaagttctctgtgccttggttgccttacctgtaaaatgggactattaccaatctctgacagttactatgctaattaaatgagattacctttttttttttttttgaggtggagtttcgttcttgttgcccaggctggggtacagtggcgcaatctcagctcactgcaacctccgcctcctgggttcagtaattcacctaccgcagcctcccaagtagctgggattacagacatgtgccaccacgcccggctatttttttttttcttttgtatttttagtagagatagagtttctccatgttggtcagcctgctctcaaactcccgacctcaggtgatccgcctgcctcagcctcccaaagggttgggattataggcgtgagccaccgcgcccggccgagattacctctataaagcatttagatactcaataaattaattcttttaatttactgtaagcagcaaagcattttatagacacttatcctggattagaaattgcatgggagccaggaaaaaggctgatacattctccagctagagtacttctagtcttcccctctccctgagcgttcagactcagaatgccagaaatcagtccttggaagataatcatgtttgctactgaaatgtttatgacacagtgaacgaaacatggtgtgactaatcagctgagagcttggatcttggcttggtttgcatgcaaattccctggtctgagagattaataagttccttgcagttgacaaactgggactacagtgttttctggctaactgtgataatacaaccagagcccaccaccaagtgacccctggttctctgagtctgcagtgcttctgtactcaggccacagcccattgcattattcattgttgtacgtttctccgtgtcctatttcattatccttggagcctagtgtgatcagtaagtgtctgttgaactaactaggactacacgggacaactatgacgtatgaggtctcttccgtgtagggaagagtgaattacaagtgagaactcagtgaagagcacccttccaacaattgtagctatgatgtgatacattctggggtggttctcctggacagcaagagaatcaactaaagagctttcaagagtgactttcaacttgggaaatctatgtaatgtttctcaactgggaaggcccattgcaatctaaagacaggtgcccaggccactcctcaaacctcttaagtccaaatatgtgcaggtgaaacccagacatgtgcactgtttaaagttccactgatgattctgatgtacacacctcgttggagttcacgggaagaacctgagcttgggaacctggaaaccctaggttctaatgatgctgcgttagtttatgtaagtcacataacttcattgggataaaataggaataatattttat

SEQ ID NO: 77926 - DNA, 1036 bp, Homo sapiens
cccagtactttgtggatataaaattctgtccattgccaggacggcttttcattgttttctacaggtggagccctccatggtctggctgcggtctcttgaagcttggctccttccgctccaaaaaaatgatttagtctggatctgcactcaccactttgcttccccatttccaaacctttttttctttccatgaaatcctctaaaacccagccctgtgcatgcagtatttcttcaggaagccttttctgacctctacagcccacaaaatttctcttttttctgaactctcctataacacttaaggtatataataaacaatctgatatttaatttcctctatcttatcctcttaactagattgagggttacttgaaggcatctgtcacagttgagcagagctggacacatgttggcttctcagcactctttgtttattcatttttattacctttttttttttaacctcctgcattatccttgtcatgtcacaggccctagaagaggaaatggcagtaaagaggacagttgctgcctttttgatgtctgttcatttctaagcatgaaggcttttggggattttgatggaagtgctgaatccagtgagcaacatctgtttgtggatgggaaagatcagccggaaagactaaaagggccgaatggtagattttcaaagctgtagggattgacaaaagggtttgagttagtaaaaacccatgtgaagttttaaaagtccttacatatataaattaagcacttctgattcttctagattcctatacaaacaaggtaacacactttcaaatgtgcctgctgtactgtgggcacttttgttatcacatctaattttcacagtaatcctatgaacaccagtcaaaagcagattctagaggcaggtggttacattattattaccattttacctaagaggctcctaagattcagagaggttaaatcacctcctcaaagtcacactgcttaagtggcaaagctaggatttggatctgtatcttctaactaaaaagtcaacatttgtttt

SEQ ID NO: 77927 - DNA, 2104 bp, Homo sapiens
taaaatgaagtcactcaattagaaaatcagaacctatgtttccttcattcactgtattgtaccctggtttggactgttaaggcagtttattatgtgttttttttggcaacaacaaatgttttgcatagttccaagatggtaatttcattcaacagtgtatgtgtttttttttctttttatatgctgctcactccctcagatggggccatctgttttctcttttttttttttaataggaatttctaatgtaccaccctattgatgtagttactcttactgtttctatgataaagtctagctctaatttattaagaattgtcaggaagagaaatgtgctgccgttttgcataccagtgtggttttcactgatggggagagcgctgagatgtacaggtgcgtcatttaccctctttgagacatttgttttctagcacctggccaaagaaacaagtatcagtttgagattgttccaataggtaagacattgcacaaagattgagaaatttaaaagaaaagacattcaggtcatttttagcacacctatttgtctgctaggatcacattattatttctagaaagatacgtgttttgccagcaactggttagttgggtagaagggagctagcattttctattcaacagtaatctgacctaactacctgtcatgtagtttatgtgggtctaatcccccacctcacctagggggcagcacatgacccagacctggccagaccaagactcaatcccctggctatggtgactggtttaggggcagttttgtcatctaagaattctctatggcaggggtccccaacccctcaggctgaggaccagtaccagttcgtggcctgttaggaaccattccacacagcaggaggtgagcagtggtgagcattactgcctgagctctgcctcctgtcagatcggcagtggcattagattgtcataggaccagaaaccctactgtgaactgtgcatgcaaaggagccaggctgtgctcttcttatgagaatcaaatgcctgatgatctgaggtgggacagttttgtcccaaaaccatcccccgatcccaccccagtccatggaaaaattgccttccttgaaactggtccctactgccaaaaaaagttggggaccgctgctctatgggacttgagctagaactattataaaagatactgtttggtttcttttttctgggatcaagagctgtcaagatcatgaaagcttcaaatcattatttcccatcatgtggggaagactaataagccaagagaaagggaagtagagttcagtaatgacaagagagcaagttctcatggcagccttgaccatgtgcactcaggtatttaacttaagccaggcttacccataaacctttttttttgttttgcagtatataaacaacaaatttcattgttcatgtctgttacttgcagcttaaaaaatcctgaataatgcaaaactgcaagaaaaataaaaaagcagactaaaatgtgtatcattttacctccaaaggagatgaccatcccagtcatcttcaaaattgtcagaccacagctgcagtgttatcttctgtctaggtgtttaacagaggaccgtggcactctagggcactgttacggactaaattatgtctcccacaactcactggttgaagcccctgacctcagtgtgactttattcagagatagggcctttaaggatgtaattaaggttaaattaggtcttaagagtggcccctagtccaataggactgtgagaggaggtgaagacatgagggatgctcatgctcagaggaaaggccctctaaggacacagtgagaaggtggctgtccacaagccaaggagagaggcctccagagaaggcaaacctgccaacaccttcctcttgggcttccaaaactgtgagaaaatacattgctgctgttaagctgcccagtctgtggtattttgttatggcagcctgagctaactaagataggtttttctttcaaaagaaagaaagaagaagaaggtgaggggactcaagaccacatctgaagggcagtccgttgaagagcctggaataaaaggctctggagagacaatcactgtctagtcta

SEQ ID NO: 77928 - DNA, 1140 bp, Homo sapiens
acagtaggggatggtaagtagtttcctagcctggaattggtctatatcttcacccactctgttctctctggcttgtgtgtctgggtggtgtggctgaccccatgagctgctttttgtttttaatagagacagggtctcgctctgttaccgaggttggaatgcagtgacgcgatcatgggtgtcacgacctcctgggttcaagtgatcctctcacctcagcctcctgagaggctgggaccacaagtgcacaccaccacactgggctaattttttaacttttttgcagagatggagtcttgctgtgttgcccaggctgatctcaaactcccgggctcaagggatcctcctgccttgacttctcaaagtgctgggcctacaggcatgagccactgtgcccagcccccatgagctgttgatctttgtggcttctgtccctttgtgtttgcttgtggcacttggacagccttagcaaacggctcaatgcacagtgatcctgttactagcactttgctgcccttactacagatttttaccagctccttttgttccgcttttttctctctcctcctttctttatgcatttttaacattactgtattttttctcttgtgaactcttccttgttcacaatctaccatgtagctcttcccctcgccctgtatcctctcctcagctcagattagcctcccgtctagtctacattcaagctacacgttctctggacttggattagttctttttgtcattgtttccccatgtttttccttttagcatgggagcagagagaaggtagagtgtggctgctcgtctgcccctcagaaagcagccatctgggcaggacagaacggagcctgactgctagtcagcaaacgcagttcaacctgagaaaggaggtcttcctttcctttgcttttatctccccagtctgcaccaaagggtttatatattgaatagtgaggcaccttccctgggatgtgagaccaggaggagaggttttgcctcagtatgtctccgtgtctccatttaactcttcatgacctttattgcctgtgtttttggtctgtaagtagctctgagagctttcataaatcacttagctgttgtatgctgcagtttcatcctctttgaaataagaataat

SEQ ID NO: 77929 - DNA, 1011 bp, Homo sapiens
atgtgaggattaggccaaaattcacttctttttgcataagggtgtccaattgttccagtaccatttgctgaaaaggctatactttctcactgaacggactttttacctttgtcaaacatcacttggcatttttgtcgggacctatttctggactttctacccacgtgtccaagctctctgtagggtaacttgtaaaaacaccaggctaactcacaatctgaataatgaacagtggttgggtacctggtttattccgtgatataggttgcagaatgtgtaacccaggctacacaaatgaaatatttagatcagtttttgatattacaatataagcaaggcactgccaacctggaagcattccttgacggcaactaagataataaggcaaatagaaatcataacatctgacaactggctgaggaaagcagggctgtctgtcccggagcaatggaaagagagtgtgagctctggctctggacctgtgcaacggagctcagtggaaagaacggatccttctgtgtgatccctagggagacgattctgcccaatgactagaaccaggctctgtgcttgggtacagggagtccagagatagataggctatgcttcctgctttcagagggggaagctacaggaaaactattttggtttgccattggccatctagccaatggtaactatagcgcccgtctactttaggtaagagactggatcaaaggacttgcagggctctgattgttttcagattaaacccaaggacagtttctgtcctaggtttaacggcttcctgaagaaactggggtcaggtaaaaaaaaaaaaaaaaaaaaaaaaaaagagagagagatctgcccaaggtctcaaaatattggctgcaaaactgagtttagaaatcaaccctcctgctgggcgcggtggctcacgcctgtaatcccagcactttgggaggccgaggcgggtggatcatgaggtcaggagatcaagaccatcctggctaacatggtgaaacccca

SEQ ID NO: 77930 - DNA, 1037 bp, Homo sapiens
cttttttctttttctttctctttttcttttggagacggagtcttgctctgtcaccagactggagtgcaatggctcgatctcggctcaccacaacctctgcctcctgggttcaagccattctcctgtctcagcatcccgagtagctgggattacaggtgcatgccaccacaccctgctaatttttgtatttttagtagagacaaggtttcaccatgttggccgggctggtctcgaactcctgacctcacgatccgcccacctcggcctcccaaagtgctgggattacaggcgtgagccaccgcgcctggcccacgttgttttcgtatcagttctgtttggaacgctgttgaccctttcagtcttgagctcttacatctttcttgaattctataaaattatctgtcatttcatcttttttttaattttttttttgcttctgagatgccttttacttctgtagtccctgtccctttttccctacctgatgtttttgggtcaactctttgaccctattctaagtttctcatctttgcctcttctgctgagcatacttactgagttctctatttcagcaattatatttttatactaaaaaaaaaattgcttggttgttcttccttatggcttactctcacttaatgttttaagtatcttcccttgtgtctccaaagacatttattatacctattggatttttaaattctgtttcccatggtagaggttgcttcatttgttatctgtcttttaagtttttcttttatgctacttgcatttctcagagatgttataatttcctcctggaaattagtaatgatgtccgtagaatattcagttgccttggctagcacatgtggtctacttctgctgcggatgagtttaaccaggagtgtggttggaagggagtacctcagggcagggtggcctgatattggaggctagactcagcaaactctaagcttgaaaaaacgaggccctatctgtccccttttcatatcactagtaatttgtgcacttcttgagtcccagtcctttcaggc

SEQ ID NO: 77931 - DNA, 1092 bp, Homo sapiens
gttgagaataccagaatctctggcagatccaatttccattttggtttttggagccatagttgaggttctaggagtcaaataatgatagcacatataaaatattatatttaaaaagcctaatgcagcattgttaataggatttcataatgtgttagagactgtaactaattttgggtagccatttctctgtcctccttttctctactcccaggacacaagggctttgtactcaaaacaccctgccttcttaacacaaattctcatgaaatgtcattattatacaaacataattcatttcttgttagtgaaagaccctttcattcacaaacatcccaatgagaaagaaagagaagtgaggttagtctgtttacagaaaagaaaactaaaatccacagaagaaagttgactttcccaagtcaccacagcaagtttttgaactagatctcctaagtagagtgtcttctagtatagctctgtgatttattttcagcccactctgccttctcttggagtctggacacatggaaagcacatcttttaattcaagtcaacacagttgttgtttattgagcatttactgttttcaaaatccaaagccaaatgccttaggatttaatatcagtatcctgtgtgagtgttgatgcccgtcttcctcattcattcattcattcatgtattcatctatgcatagttattcatatgatcaccacttacactgtacctactacctaagcagtataccaggtgctgagcgcaattcatggtttcacattataagatgctacctcaaacaggatacgtttcttaacttgctcactaaattgcgtcacaagtgccaacagttcctattctatctttccaacattttctattgccctgacatgaacgatttaggaattggtaccactcctgcagtacatggttatttataagatcattttttttttcatcggacctggagacaccagggtcaaagtagagacctgaatgcccaggaacatacagcatgtcaataacaaagcaagggttggaatccctatctcatagcaccctactcagaaagcttgccacattttttgcttcttttcataa

SEQ ID NO: 77932 - DNA, 1027 bp, Homo sapiens
acagcactcacagaaatgaggaggcgactggctgtgaggaccctgcagcacagagagtaataagcatagacaggaggggcagtaagagttgagaagttggggactgtcagggaagacctcaaagagaaagtgggatctcaggtgaactttgaagaatagggatgattttttagaaggcactggcaggcatcacaggcaaccagtcacccagcggctgctctgggtgctagggacacagtggtaaacaagacaggcagtcttgtcctcaaactgagggcagagtcgggaggcagaatatagtcaagaaaccatcaacaagagacgtgaaaacaatagagcagtgtggtagagagtgactgggccacgccttaggggacatgtggggacatgaggcagccatgctaaaatctgaaggttttggggtggaaagggcagcaagtatcctcagctggggacgaggccctgagataggaatggtttggtgggttcaagggtcaagaaaaatacagaggctggagcaacatgaagaaggaagagtgaaggcaaataagggcacagaaggctttatcaggcccaacggcaaagcctgcgagctgtgctgaatttagcgcgtatgtcagaatttagttaggggaagcctttggagggagggtttgaagcaaagggaaagacatctcatagaagcttaagaaaatcactctgggccctgtgtggataatggctggcagtgtggcaagaatggaggcaggatgacctcttgggaggctaccgcagtcatccaggtaagaggtgagggtggtttgggccagcagtggagcagtcagggtaggcggtgagaagtcaccagattcaggaagtgccgtggtgctgtagcctccaggactatctggtggatcacacatgggcgtgggggaaacatgagtcagacatggcttaggtgggtggtgattcctttcaccacgctggggcagctggggtgctagctggaagaatctgtagaggtgtgggcctagcagcacaggttccc

SEQ ID NO: 77933 - DNA, 1043 bp, Homo sapiens
acatccccttcctgaattcatcttaaaacccacacagcgtttgcttcagaaagcctccccaggcctggcgcagtggctcacgcctgtaatcccagcactttgggagtccaaggcgggcagattgcttgaggctgggagttcaagaccagcctgggcaacatggtaaaaccctgtctctactaaaatttaaaaccctgtctctgctagaatttaaaagattagccaggcgtggtggtatgtgcctgtagtcccagcttcatgggaggctgaagcacaagaatcgcctgaacctgggaggcggaggttgcagtgagccaagatcgcgccactgagctccagcctgggcaacagagtgagactccgtctcaaaaaaataaataaataaaaatttaaaagaagaaagcctcccctgtccccccctcccccgcatccctccaggctggataaggtttataattactcatctgactgccttactagctgtgagctcactgagggcaggtactgttctacccatctctctttcattaatgttttttgactcactaccatctactggtcagactaagcctggaatattgtgcccagttttaggacccagactgattagttactgggatggcgaggggactggtagctttgtcgtgtggctgatggaaggaagcgctcttccttcagctatccggtgggttgtcacaggctctgcagagcaccctgtgtgactctggagagaagcgagtggcatgtcactcagaacaaggaggggttgtctaaattaaaaccatttacaaccaacgggttgctttggagagtagtaagttaagtttcccatcacccaaagctcagtgtggacttgtgagggcagcttcattggacacaaaagtggattagtgtctatagttcttttcagctctgagattatttagtgagcatttattaggcacctgctctgtgccaggttctgacacaggtcaaaagtctgcgaaaggagaaaggccaggaaggatggactagaagcatctcagaccacatcacagtgctga

SEQ ID NO: 77934 - DNA, 1035 bp, Homo sapiens
ctatcttttttttctggagacagtcttacactgtcacccaggctggagtgcggtggcacaatcacaattccctctttaaaaaaaaaaaagaaataaacgagtattgcttttttaaatttgggaattctaatatgctagagaagatgttaaagattattaggtttatgaagagccagtgggctccgagagacttcccctgaataccgtggcaggagttttagtgtattaattttagtaatgactattttatcctttcaggggcttctcccctgcttctctgtcatactttgaacaaatgaggttgctttactacgtaaatgtcttcagcaaagtatggtgcagccatctatttattttgatttatgttgcatttttctttagatcaccaaaatacttcattgcctacatagcttatctgatgctaccctagcataataccataaatgaagcattttgttggatgttgcaaagaatattatctatgtcatatgctctagagtcagacagaagtggttggaaatccccagtgtaatcactgaatacgtgtatgaacttgtatacatctttgcaagtctctgagccacttttttctcatctaaaaaaatggagaatggaggtaataaatagctgcttcataagtcatgaagcttagatgctttaataatgcattctctctctctctctttttttttttttttttccgagacagtttcactctgttgtccaggctggagtgcagtggtgcaatcttggctcactgcaacctccatctcctgggttcaagcaattcttgtgcctcagcctcccgagtagctaggattacaggcatgtgccaccgtgcctggctaatttttgtgtttttagaggcagggggcatctcaccatgttggtcaggttggtcctgacctcaagtggaccaccagcctcagcctcccaaagtgttgagattacaggcatgagctaccgtgcctggccacattctcttgtttaatacagtacatggaatgttgtgaacagttggcaaattataattgt

SEQ ID NO: 77935 - DNA, 1176 bp, Homo sapiens
tggatgtcactcatgtttgctgtcctctggctttaccttatccagcagcacagcagtgtggagcaataaaggaaagtgataaatcagcatagagagcgttatccccaacctcagatcacacagtccttgcaaccttaaagccagacaaaatctgagaaatcatcttgtacttctaaagcaaaatcctttccatggcgtctctaagagctggctctccggcctcatccagactctgcttgcatacttccattcgtagagatcttcatatttctccattcagtcactggcagcctaccttgtgccaggagctgtgtcagttactttctcatatataatttaatcctcacaacacactgtgagggtgccatgccatagccatatcacattcttctccatttgacagaccagaaaaccgatcattcataagtgtcatgatgttagatcatctgactccaagctagaagggatgggaagcagaatgagggctccagccccagcatcttttcctccagggcacgacttaggaatatagtcttaaagtactttgaaataatcttcttttaaatctctgaaagagcagaagtttagaggtcaggcagacctggtgttgaatcccctagcagcttgtaagcacctgaatgtctggattctgtcgtctctgtatccttccctgctgggcctggcattgctcctggcagtcagttgatgctttttgattgagtaataagatatgaataatgctgtatacatgtgtggtacataaactttcccaagttattctttcgacacatagcccacttattaatgcattcaaagtactagacactatgcagagggctataggaggcataaatatgaattatagaagacttgcccttaggagctttatatctagaaggtaagctataaataagatacgtatcacaatgtgatcttcgcagtaaccccattggattggtaaagccagaattattatccccatcttataagtggagaaactgagccccagcaaagtgcagtgactgccatgagtggagtggctgagaggcagggccaaaccagagccagggaacctgcctcccagctcagctgttcatctggaggttgtaactacatagcattattagttaaaggaaagaacaggttttgcaaaccctcactgttctatagattatg

SEQ ID NO: 77936 - DNA, 1065 bp, Homo sapiens
ctgaaatggcagtgtcagaccagacaagaagctctcaccagagacaaagtggaaacggagagctgttggcgatttaggggacagcggggacaggtgcacattgcaatgtgcaggatcatcctgcgcagtgaagtcttgtcttgcgtgtcccaccaaaacatgcagttgaaaaactcaagccagagcttgctctgttttaagaaaaagcacttatttttttaaccaggtttagtatgtgctgaattttctaggaatttgactactgcatccgtcaaaagaaaatcatacttaattttgtttgtaactttaccaagagttgttttctgtttcgtaaagtcctatctccagcatcgtcactgtgacgtttcagtcatccatagacctccccttcgtcacatcccatttgcagcagcagcactcccagtgggtctgtgggtaggtgcaagcgtggaccgcctccgtctcctagtgtagctgggtctggccctttatgtgttgtaatgcacattttattatagactgcttctcttttctctctcctttgcagtacatgtaaggcattatatccgaatttaggtaggtaggttatgtaatctatgaatttcacttcaggataatgcaaggatcattacaaaacattataataaaaagaggaccatcgggcctgagagggttgaagttttgtgaaactcgggctggttccttcctgcattgcatctgtgtcttgcctggttgtcgcttaacagtgccatggagatagcacagtgtctgtctcatttcacagccaggaaaactgagccccagagggaggaagtttgtacttggcccaaaccacttcctgatatgacccagtcaggaagagaagccaggatgagaacatgctcctcttctcctccagtgcctggaagtgtggtgggagcagcttggtctagcaggaagagtgcatgtcctggagccgggctacgttgggtctgtgtgaccctgagcaagtcacctcctccatcagcaggtggaatgacaccacaggcccgtggcagttcacatgacacgaagatgcccggtgcc

SEQ ID NO: 77937 - DNA, 1122 bp, Homo sapiens
ctggcggccactttctgaaagccggatatgtctctttgctgacccacccctgttctcaccccagggctccagatgttgtatcaggcagggcctttgtacgcctccatgccaacagctacccaagtcgcaccgtcagtcacactcttactcaggctctcctgtgcccctggcccttcttcccctctcacttttccccacacttctaaaatctcactcgtcctgtcagaatgtggctccacagatggagcctttcccagccgccccgctccctgtgactttgcactccctcctgcactcccacggggctttatttttgcctctgtcctaacagtcagctgccacttggcctgtcctgctattcccactgcatgaatctagtcaggttggaaattcagaaagtggcctctttgtctctggaccccaaaaacccacacatcgtctgccttataagctctcagtatatccatccctggctgcaggaacacaccaggacccagaggctgccgtgcctggagccctgtctcctgactcagcccaggccccagctcagcatcgaggtcctgtgggaccatgtccagcagtgaaggctgtgcattggcctgagcccctggtccctctgactcactggctcccattttcaccacctgcactgcatattctcaccgtctctcccctgacactctctcccctgaagtgttgtaatggggttgtaacccatccaccttctcttgtccttcttcagtctgtcctccctgggctgcgtctaaaggggccccgcccctgccctcatgcatgttctctccatactcctggtcaccttctgctcatcctttgccctgctgttgtgaagccttcccagtgccccagaagacctcaggcaccccttcccagtcctcgcacactgttggtgtcccatttgtttggaccctgggtttgtttgtctagactgtgagctcctcgagggcaggtgtctgtttctgtgtctcgggagccctgaagagagactgacacatcagaggtgtctggtgactgaacaagctcccagcttgcgcccatgtcatattgtgtgcctctcatagcctggcacttcctgccattgcatccttctctgcagactaagat

SEQ ID NO: 77938 - DNA, 1012 bp, Homo sapiens
atgcctcacaggcattctctgcacacttgctcccttctgacgccacacctaccctgttccatcccattgcccacagggttaagaggagtgccacctacagggtatctcttggcagacacctggtgtcaccaaggcctgtgagctgagccccacaaggggtctggacagtcctccagggccagggccctgggagcttgctggagtcaggtgggcaggaaggttctgataggttagctgagcagcctcattaaagattgaggtggggaagcccacttgatggctggaaggcgtatcagttacccactgcaccagccaggcgacagaggagaagaggtaagtggcccagtacgagaggtgcccccggcctgtgccgcggagccctgcccgtgatggtcagcagggagtgggccttccactgcttttgcttctgccactgggactgcaccgtgctttgcagagtgagctgtaggtgatgggagcccctctctctcctccctgctcctcatgggcctctcctttcactcccacctgctccgggggtgggggtgggagtgctggatcttggggcgagtatctgccactgaccaattacagggtttgcaatgacatccttgcggaagcggcagggtggaagcagcagctgggtactgggaggcctgagcttctgttccagcagcaccgttcactggaggcacatgacctcgggtagcttttccgagcctcagtttccccacctataaaatagggttaataagcccagccatggatgattggagagattagtcacaaaaaaaaaaacaatgcagttatgctcagtaaaccattaagcattaagatgtggcagatttttattgctatttgttctgtttgaggttcattttaaggttagttttgtgtcctgaaataagcatattaggaagacagaaagaatattctgcagggaaaacaactcccctaaggaacacagcctagtgggcccaaacagtgggggtggggtgtcctggcctggaag

SEQ ID NO: 77939 - DNA, 1039 bp, Homo sapiens
tcttcaggaggaggggtcagtagttcctcgccttgtctgcctgcctttggctgtataaattaatgcattacctcagacaggagccacaccgctccctgcctaccccgcgcccaccatacctcgcggaggatggatcgcagagcagggattctcctccgtagggtctcttagacatttatttgtttagaggtagtgcatgatttggaaattcagagagaggaatataagcccacaatcccgagatagccactgtgaacattttagtatatttcctcctttgtcctttagagttgtagaaatttggagctgatgatccttggttccacgcttctcactttatagaaaatggaagtccagagaggagagagactcccacacacctaacttactggcagagctccagcacagttcactctgaaggggattcgtacaatccagaaccgtccaggagagcacagccaaggcggaaagggactggaagacaggacggggaccaagggaggcctggaggggagtgcaccagggctgccaggccagcacagagagacggtctttgtggtcctgacagaccactgggggcagtcctggcaagacagatttcaccctttgggaagaagactttgccagtgagaaccacccaccccagctagggcctcgcacttgaggtcagaccgggtggctcctaaggctctctgtacagccctgagaacctgtccagctcctgggatacctctcccggtgccacgtggatgggcattgaggcagcaaggccattgggtgctggcaatgtgccacactcctgcccaagaaggggctccgccagggggctccgagccgcagcttctcacactcgcaccagggctgggctccccttcttgctctccctgtctctgtgccccgcttgacccttcttcctccatgtgtcctatccccctgcagtcttggtgactctgtggagggctttagagtcctctcttttggggttgaagcctggcttaactgttgactgttcagaggccacaaagatgctacttcagtt

SEQ ID NO: 77940 - DNA, 1016 bp, Homo sapiens
tgctggggggtagctggtgaggtgtaagtgatcgtggctaggccagttaggagactctgacagtccaggaagagatgataggggcatgcaggaaggtgttgaaggtgaagacaaaaaagacaggcaggtacccagatttagagaactgaccaggctgacagttataagaagctggtgtcagggatgattccctggtttctgggctgagggacgaggtgggcagacctgtcctgagatgggagctaaagaagggggcccctgctgtagctgaggaggctgccaggtaggcccatcacagacaggtgacagcctggccacggcccattatcacacctcagaccagctccatgcttgatgggcagctcatctcaagttgaaaagccacagaagcgtatctctgggaaacactgagggtctgcctgcctctgtagacctgggaggtcagcagataccactgaggccaaaaaatatgggtgaggttttagagtacatgaaacggggattcatactggggaggtgcacgaaccgactcaagggcgtcacgtggacctattccagggctcctcttctgagcatttccaggctctgagtggcattctagattggggagggcgtggctgggttaactgagttccaagacacaagggccttagagtgacacaagaaagtgtccagtgtcccgacctgtgggacagactgcagcccagagagatgcctctctgtcccgtgtggccaggccttcagtgtcctggggacagagcgtgcccgcctcccctccacgcctcagatgctacagctgctgccagtagagctaaacagacatagaggcatctcgccctctctgcctagaccagttttgtgtcccaggccatgaccacacggagggcctggacatttgcctgggcctggctcctcaccagacggggcctagacaagccgcctccttcacgccatcgttttcccacacaggtttatctgaggaccggggtgagtctggcagggtggaggcagaagag

SEQ ID NO: 77941 - DNA, 1028 bp, Homo sapiens
tctgtctaagctgtggcagatgggaggtagttaggagagtatgatgaggcttcgcaggggaggaagaccccagggttggttgttcattcgacaaacatctttgcagcacctgctctgtgccaggcctgtgctcatgagcacagcgaggagagacaggggcatcaggctgccctagctgggcagaggaggctcttgccagctgttcgcgtgtgtctctggggcatgctcaggttgggtgtcgcctccctgtgaaactgcacgccatgtcctctcctcctaagatttttgcctggtgtcttgatttgccaggatgcataggttcctggctgatgaacgtgatcaatacccctgccctgtttgcttcttccaacagcccagtgagtgggctacgtggttcccatctgtgtgcaaagtggtttgctcaaggccacacacctgggacatgtctgtagccccaggtctagtgcctgcaggcccagcgcctgtcccagaaggtggctttgaggaaaactgcctcaatcccaccgttggtccgcagggtgccaaggcttagctctgggccaggcagctgccccactaccccctagagattttgtcttctgcctctgcttgtcctgcacagtcaacgaattcaagttaatgcaacaaatcttttggagtagaacaaaatataatccaataccacttaaaaaagacaagccagccagaatgggacagagccaggcgcagcatgggaggcagactaaggagcccctcagtagcaggtgccgggccgaggggcctggccgccacaccacacgtgggagcaaggctgtgctgggatgtccggggaggtcgtgcttgctcgccctgtggctctagtcactgggtcccttaccagcaggctcacattccagagagacctggcacagtgaagggctcagaaccagatcacaggtcagggtcaacctgacctaggccatgggggactgagaacaaggtgccaggttttggcttaactcaatcagaccttcctgccacggggctct

SEQ ID NO: 77942 - DNA, 1056 bp, Homo sapiens
atcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtt

SEQ ID NO: 77943 - DNA, 1011 bp, Homo sapiens
gtgtgtcaggagcgcgcctccaggccggtgtgaactctgcaacttcacattgtgcctcctgccgccgctgctgcttccccgagccccaagctcaacctggagcatgagctcccaccctgaggaggaggctgtcaatactgtgtttctttccagggaggcaacgggtgggtgcgatgttgtcacttaagttgccacctctgcataagagctctctgatcagaaagcagtttctttgttgaccccagccagccttggctctcgggttgggaaatacagtcacggtatccatggagacctcttgaggtggagacgggcgttaaatccttctcaggcagtctgaggtggccagagtctgaagcaagcagcctctatggagcgaggggagcaggtgggcccagcctgagcggggcctctgcacagccagctttcccccacacctgtctccagccagggcacccacaggccctttctctcccaggatgaagcctgctgggagcgtgaatgacatggccctggatgccttcgacttggaccggatgaagcaggtgagcatgccctgtgcccttccctcaagaggctgagggcagccagcaggcgggggaccgtctctgaccagcatggccaggcaggccctgggggcccacatgtagctgccaaaaggccagtcagggagcagccacggcagaaagggggtgcccaagcctgtcctttgtccccagcccctgccatcaccagaactaggatgtccctcaacctttctgggcacctccctcaggcctgcctctggggctttctgccccgaggaagcccttagtttcagtggcgtctacctgagggaggtggcagcaggattttcccaggcctcccatgccgtcccccctcagcgtgggaagggggccacgaggagacaagggtgacagatgcaactctggagaggcccaggagaccccaagccctttggacatggcccagcccaggccggcttttccgtctccactgcctgtcccttca

SEQ ID NO: 77944 - DNA, 1046 bp, Homo sapiens
agcccaaagacccaggcctcctcccccagccggcccacccttgtttgagcagagagcactcagttcctgtttgtccagttcccccaaaggcctgggctggggagataaggagttaacaaatgaggggaatgaggcagcctgggcgataggcaggcactcagccaactggtcacaccgccttactgctgggtgccgtctggccccaggcatagctgggtcagaaacccagggcccaccacagcctctccacctgctgtgggtgcagccccaggtggaacccaccctggctgagagcccgggggtaggcatgggccataccaggggctctgagaagcagctcccatcccccagcccccacaaccttctcctggctgttggctcttggcccagcaaggtccatccagagagaggcctgagttgacatagaggagggggagtccgggaggggatggataccagaggaaggagggaaaggcccaaatttgggaggccgggggttggagcactagcttggggtgatgaggaagctggggggaggcaagagaggaccctgcctctcctgaggagtgagcagagccagggcagtccctggggtccagggccaagatttcctgctgacccctgcaggagctgggagggcagagcctcagcctccactatgttgggggaagggctcccgggcccccggcacctggacacccacctgtccagagcctacagagaccctgcgtccccacacagcagctcctcacaccagagttctggtgcccagcactcctcagcagcagtgaggccacaggcagggcacaggcctctgtccctacgccaggtcctcccctaaaagggcagtggcagcaggggccgccgcagaaggaatggcagatgagacccaaagcctttggtcatcaccccagaggtctatgccaaagcctgggtggggctcccaggagatggaacagggacacataccaggcaggtccacgccaggggtgcggggccctgatgaggaaccgggctgcactggtcatggctgcacctgagccgcc

SEQ ID NO: 77945 - DNA, 1009 bp, Homo sapiens
ccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgcaccctcgggctcaggccctcgcattggtccatcacgctccgggctggggatgccccttttcagagaagggcccgggaccacggtgaccaggagtcgtaggagcaagatggcggtcttcgacaggaagctgggctcagaacattcccaagccccgggaaggtggggtggtgtcctggggctgggcctcaggtcctgcctgtagggaactccctacgggatctccaggaagatggtccctcaagtgcaacccacacccccgaacctcagaggactccacgtgcattctgacgggcagggccctgcgagcgtcctgttcaggggagggatggacttggggcttagcaggcaccaggcaaatgcaaggcagctttgccttctcctcggccccacaaagtctcctgggaggaccacctggcctgcaatgggctgtcccaggcccctgccctgaggcagcagccagagacagaggttctgaccctcagcttcaaggaaccagggccaccaacaggcaggccttgagatcctgtgaccactcatgcccccagttctcccacatgacctcctgcagccacagagcagtgtgcccagcagcccccaagggccatggcaggggagggagccggcactgcctgctgggacccagtggctgatctcaagggccggctcctagcacactgcacgttgttgggcttcccggcagccctagcaacaggaatatga

SEQ ID NO: 77946 - DNA, 1026 bp, Homo sapiens
tgataattttcttatttttagtagagacggggtttcaccatgttgcccaggctggtctcaaactcctaagctcaagcaatccacctgccttggcctcccaaagtgctgggattacaggcataagccattgtacccgacccctaactatatactatatatgtttatatggggtttttttgttgtttttttgagatgaaatctcactctgccacccaggctggagtacagtggcacaatcttggttcactgcaacctccgcctcccgggttcaagcaattctcctgcctcagcctcccaagtagctgggattacaggcacgcaccaccacgccctgctatttcgtttttatttttagtagagacaggctttcatcatgttggccaggctggtcttgaactcctgatgtcaagtgatccaccggccttggcctcccaaagtgctgggattacaggcaccatccaccgcacccagcctcctaactatatgttaataggtgaaatctcacgtctataaagctggcaccctttatgtagtattttatgtccttttataagaccttaattaaattctttttcttaggccaagtggtttattacaatgattgaacctgattattgcccataaatataaagaaagttgaaatctttagtaatagattagcctctgtttttctctgctttgctagtataacgtccctccaaagaagaagctaaatcaacttaattgtactgaagttgctcctactgcccacccatcccaacaaatatggaatgcacaattaaacagaatggaatttttttttttttttttgagacagggtctcactcattgcccaggctggagtgcagtggcaggatctcagttcactgtagcgtcaacctccccagctcaagagatcctccctcctcagccctccaagtagtttggactacaggcatgcatcatcacacccagctattttttgtagagacagggttttgccaaattgcccaggctggtcttgaactcctgagctcgagggatctg

SEQ ID NO: 77947 - DNA, 1035 bp, Homo sapiens
ggcggaagcgcccgcggagccccagggccaccgttgggaggatgtccgttattctttagtgacccgcggaaacctgagacgcagccgttgggtgcctgtttccccgtagatcttagaactacagggtcctggcggctttctaaaattttctcctgagcttccccttctttgctctccagtcagccattgtttcccttgcccaccctttccccctatttgtcactttcataggtgctcctttttacgcccaccaggttttgcatttgtctcatttaaaattccaaattttttcagccgtgtcctccattgtacctgcaacagagcctagatttttttttgtggcacggattagcggcaagttaaaccttcctgaatgagttacattgcagcgaagtgtttctgctcttatctgtccttttggtcgacctgacaatttgccttaaagcaaaacaaagatttcctgatttttaaggaaactatgacaaattgaagagttggaaaggtgtgtctttgttgtactcgtttggccgatttaacgcctctgtgaatttgttcaacttaaatattatcaacatttactgttttgtaatagtgttcatgcagttgaggcccatgattttctgaactgtacgcaatacattaatcttaggctcaacttgttaaaacaagtagactatacattctcattaaaaggcaactttataaatcctagtcccttcttattgctaaatcgcattggacttgacttttgagaatattagtgtaaggagtgacaaattagatcgttttctctttgaatctgagctttgaaacctgaataattccccttggagtactgcacccactcagtttggaaaagtcaaatctgttgaattaagtcatctctggctttatagcttataaactctgcataaatatttcatgaatggaaaccagttgtgggagaacttttacatgtcttaatgctttttaaatttcactttccccactctctagtaattgatggggaaatggcactgcaagtagttgatactt

SEQ ID NO: 77948 - DNA, 1638 bp, Homo sapiens
ggcggcggcgagatctgggctcgggttgaggagttggtatttgtgtggaaggaggcggaggcgcaggaggaagggggaagcggagcgccggcccggagggcgggaggaggcgcggccagggcgggcggttgcggcgaggcgaggcgaggcggggagccgagacgagcagcggccgagcgagcgcgggcgcgggcgcaccgaggcgagggaggcggggaagccccgccgccgccgcggcgcccgccccttcccccgccgcccgccccctctccccccgcccgctcgccgccttcctccctctgccttccttccccacggccggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcaggtgagcgccggccgcgcgccccggccccgggatgtttttgttttgaagggaagccatgttttatgtgtgtgatgggcgccgccatcttcttcgccagggcaagtatggcggccccaaaagatggcgggccgtgcggcggcgggggcgcggcggcggcggcgggcggcgggccgcgaagatggcggcaggccgcgggggggaggggccggcgccgcccggctaggccgcaatggcgtagtttctccgagagggggaagcgccgcgcggggcggagacggccgggggaggggccggcgcgctcgctccccgacgccctcgctccccgcgcccgcatcaacgggcgcgcccgccggcccgttgtggcggcagctgcgcgcccccggcccgggcgggacgcgggaggtcgttggcggggctgcgccgcggcctcgcgggccagggattgctgcctccgggacgcgcgcccccgcccccgcccggcgctgccgttaccccatcggccgctggagggcgccgcgggcgcttgccccgcccgcccccaacttccccggactcccaactgctc

SEQ ID NO: 77949 - DNA, 2762 bp, Homo sapiens
gtagtttaattttaagcctttatggtttttactttgtagaaaggtatctattttccccatgaaaagaacgataatagaaagcgggtttttttgagttttgttttactgttttaatactacttttaacgaaggcctgaaaaccatctagagcaaaaggatcttatctgcctgtgtaaaatctgtttttacttcaaaggcaattattaattcaatgctggttttttaggtcagtatcctattagtatattcatatgctacctagctaaattgctgagatactaaatagactgagaataatcctgccatcgtagttaatctaatgcctgtgatgattacgtttagtactccatataagcggtggaacctcttccctataagtactttaaagcttcataaattctcagaactgaatggagactcaaaatatggtgacctttgagtattaaaagatcgttaaaattcggaggaatgaatgaaacagaaatgaaaaggctggactgaaaaagctagtttgtatctggtgaaagcctcaagatgagacaactacagctgggtggatctgtgattgaaagaggcctgagcaaagggatctaggagctgtcaaaatctaataggaaggtgctaacaggcgctgtcctgcatccagggtgccttgtagaattcatagcagtttgagtttagcagaaactatgtttaaatgaaacatgaatactttagtacttaatggttatcaaaagataatttccatgtattttggtagctcaagagattacatactgatcatgttggaactaaaagtcatggttttggccgggcgcggtggctcacgcctgtaatcccagcagtttgggaggctgaggccggtggatcacttgaagtctggagttcgagaccagctggccatcatagtgaaaccccatctctactaaaaatataaaaattagccaggcgtgatggcgggagcccgtaatcccagctactcgggaggctgaggcaggagaatcgcttgaacccaggaggcagaggttaacagtgagccgagattgcaccactacactccagcctgggtgacagagcgagactctgtctcaaaaggggggggggggcatttttttttgttaataccaatgagtaagggatgggggttttagttattgatgaatttgcagaattcagaatacgatttgaaataagatatttaggtaaagatacattaaccacaaaagtaaatttactttttctcatagtgtgtggaattagaggaatttagaaaaccgacatatttttacatgatctgcattttatcttaacaaattgctggtccacttttccacatccagagaagctggtagtgtacggctttgcttgctgaagtggtatgtatggagtcagccagttaggggagaaagtctgaggggcttgactgatggaagtcaatttacaattaagtgagcatttacaagtgtgcaagtggctgttttgttttgttttttgttttttttttttttttttttttttttttgagatggagtctcgctctgtcgcccaggctggtgtgcagtggcatgatctcggctcacggcaagctccgcctcccgagtttacgccattctcctgcctcaccctcccgagtagctgggactacaggcgcccaccaccacgcccggctaattttttgtgtttttagtagagacagggtttcaccatgttagccaggatggtcttgatctcctaacctcgtgatccgcctgcctcggcctcccaaagtgctgggattacaggtgtgagccaccgcgcccagccaagtggctgcttttaaggtggcacagtttggggttgttttcacgtccgtttcttttcttctcttttctttttttaatttgagacagagtcttgctctgttgcccaggctggagtgcagtgtcacgatcttggctcactgcaaccttcacctcccggattcaagggattctcatgtctcagcctcccaagtagctgggattgcaggcatccaccaccacccctggctataatgtccatttctttaaagcgctggttgtctagctagtgtggtagagtacgctgtgcataagggtagttataaatatttgatggcagtaacataggatggcctgtttctcggacatgtgttttgtggtaaactatcccccttacttttccttgtgatttggaattattactaaagagaagctaaagagcttatggataactctgcatttcccaagctgaaattctgaaggtgatttcatcttcagaactgaaatgacgtgatatactcagtataattccataacaagtggagaaatgaaagtgggttaattgttgggtaaatctgtatgtatgtgtacatatgggttgagcatggtgggcagcattactgctttcgtgtacttgatctcatttgatcctaggcatgaaggttttaactacactttagtttcactaaaatagccccttagtttggaatgaactgtgaagtaacagttttgcataagccccaagctgagttacttgaagtccttataaaaatagttgtacatacagggtattccccgagggtctagttacttcttagaccctcttggtttaaaaagcaaaaagatcaggctgggtgcagtggctcacacctgtagtcccagaactttgggaggccaaggcaggaggatcgcttaagcccaggagttcgagatgaaccttggcaatatagtgagaccccgtctctgcaaaaaaacaaaaaaccc

SEQ ID NO: 77950 - DNA, 2082 bp, Homo sapiens
tagttgccaggaaatgtgtgtggtgtgagtgaaaagccgaaatctaggctgggtgtggtggctcatgcctgtaatacgaggactttaggaggccaaggcaggaggatcgcttgagtgcatgtgttccagaccagcctgggtaacattgtgagaccctgtctctacaataaataaaaataattagctgggtgtggtggcacctgcctgtagtcccagctactcaggaggctgaggtggggggattgcttgagcccaggagtttgaggctgaatgagccgtgattgtgattgggccactgcaccactgcactccagcctgggtgacagagtgagaccgttctccaaaaaaaaaaaagggagaggggagaacaaattgagctggtggctataaatcaccccatttaagaagttactggtgaaagcagtttttgtagtttttaaaatctatttactcagctaaagataatctcatgatgtgtttcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctaggtaagttataagaactttcctttcttttaattatagaaagtgcttgagtcttgccagctatgttttcctgtgcctaagtcaaaatggtggtttgtattctttctctagggaaattcctgaaaacaaaagcagtcagttttatttgtttgttttttgtttcctttttttgagatggagcctcgctctgttgcccagactggagtgcagtggtgcgatctcgactcactgcagcctctgcctcccgggttcaagcaattctgacagtcagttttatttttagtagtaactatgctattaatgtgagtggcagcattttagatccttgcagtaagatgaagcaaatacccttaaataggcattgcatttgagtaaataaaattgcacgtaatttgttttggaatagatatcttccacactgccttatggcttcttggtacacattttattttttatttttttgagacaagagtcttgcttgttgcccaggctggagtgcagtggtgcaatctcagctcactgcaacctccacctccctggttcaagcgattctcctgcctcagcctcccaagtagctgggattacatgcgtgtgccaccacgcccagccaatttttgtgtgtttagtagagacagggtttcatcctgttggccagtctggtctcgaaccagtcctggcctcaagtgatccgcctgccttggcctcccaaagtgctaggatacaggcatgagccactgtgcccagcctgtagtacacattttaaatttgggtgtgttgtattggtctatgctgctggagacctgggtctgtacttgactcatccagctgaccactggaaaggatttcataaattcgtgtttgtcttgtcatcagttaagctcctggtatgttaatttaagctggcatgacaggaggagatcaagtatttatggcttggacatggcgagcagtggagaaactctgaacccattggttgggtgtgtttgttttgcctaaagtgggctgggttcttatagaagcctactttttgtgttactttctagtactgtttggcagtttgtacaaggagctgaaaataccacaaagatgtaaacttttaagttaaatgaactaataaactctggagcagaaagcctaatgcctttccatacctgaggttggttggaacctggaatagctcaggaaatttcggcaagggcaggatcaagaagaaagaaatccttttgatcttgcacattctaagaacagagtgggttgctttttttttttcttttgagagcagagtggtagaggtggagaccgttcagtgtcctggcttccttcttggccctgccgaaaacaaggtgggcagttcctgccacctggagctcgtttccccacctgtcaaatgggcgttaagaattccattgtggtttgatacatggaggttctcactgtgt

SEQ ID NO: 77951 - DNA, 3239 bp, Homo sapiens
gatttatttatttattaaatatgaaccatcatggaggggtgtgagaggggtaaaactagggacaaaaagaaaatctgtttccgagatttaaatttattctctagtttttttaggaacgcttaatttctcacccccctaccacacacagatctatagggaatatttggagagaaagttttgacaaaagtccaaagcttgattcagtggagaagcaggtaggtaagttaccaaaccaggaggctctctggacagtaatttcacctggggctctgccagacggttaccacattaccaggactcttggtacaaatgagaacttccaagcccccatccagaagtagggtaacagtatgagagtatgtggtgttcccatctgtccaccaggccctaggagctctctccccaaagtaactggtgctaatggtttgtcgtgtgtccttccagagatatttgatatttaatatctataaatcttgatttaaaaggactcttctgtaccctttaaaatgatatattttaaagatcattcgtgtcagtactaattggacccatttcgtgtatagagatggatattttaggacactcctgtgttcaccgcttctttttcataaggcaccttcatcatcgcagcagctgcctttggaaatcttcccttgcctctcacaaggagattcatctgattgtctgagttgattttttgtgtttttttaaagggtttggagttaagaacaggtatgtgaatcacacagatcatagtgccattctaagctgcaccagcttattagctatgagactgtaggcggcaactcgatgtttctagcctgagcatccttatctgtaagatgggaagagtgcttcacagtcattggtacttagtgaatgcaagttgtctcatcctttctgcttcatggaaatgtatcataattttagtttgggtacctataaggaaagcattttagggactatatgatttatgccagttgagtctacccactcctacaaatctgtctgtctctctttttcttttgataagaatgaagccaagaaaaattaaagaagatgatgctccaagaacaatagcttgccctcataaagtaagtaatgctagagggagagtgttcattaaactgttgatgaagttttagagagttataagaaatttgcacttttgtttctgcttgtgataatttaaatgaagcaaggaattagaatcttcggtttctaaatccaagagatgaagttttgttatttagtaaaggcaactttttaaatactgttaaatgggatgactgcagggagccgttgcttgattactgtgtgttgactctactgttagcgtttcatttctttttggattatattaacaagtccgtcttaagatcctgggttgtgtctcacctattgacctttatgggaatgtaggcttgtaactgaaatttgaaaattattttggatgttgctaaaataagccaaataaagacttaataattgtgtgtgattagagaggcacttaattgttttcaaatgtagttagtctttaaaataaaaggataacctgaaaagtacttttgagatatttgttgggggctattttcaaacttaattggatatgagactaacagaaaaatcaagtatcacataggtacagagaacaaagtaggagagattgagtggaataaagaatgttaaaaatgaacaatcggagcaggctacatttagtttcacggtctcttccctgtaatgactgtgcactagcaagtccttcctgttctttgtcagcgttcttgatgtggcgatttgaaatgtaaacgtatctccattagggccgaaataacaagcatttgaaaacagttaggctggaagtgcctatgccatccctttagcttctctgaagttttctttataatggacacataatacttgtacatatttatggggtaccgtgtgatgtttcaatgcatgtatacattgtgtaccagttaaattttttaaatttccattttctaaatggaaattcaacctaggggtaaaggcggaaaaactggggcttccctctcccttctgcctgtgagctgtctagtgacttgtgctgtccttctgtcatgctgtcttatcatttccccattcactccattactgggcaacaactgcagaagaaattgttgaggacatgcttctcgagcgccacacatccatctgcctttcccgccctgcactggtatcaatttgcctgcttcttccttttcctagtgtctcacaaaataaatttcttctgtagttgccattccttggagaccctcttgcttctttctctgtcaagaaggggaaagaggcaaagagagaagagggaacagtaggcgatggagaatgacagtccattgttgcagcacagaatatggggccaccaaaggtagtggtggactaccgtcattttaactccatttgcttagcagtgcttctgttacttcattttgggggacatagtcgggtgaggtggctgtggtagagctggaagccagggtgttgggttctattcccagtttggctactactagtagtgtgaccttgggcaagtctacttaaagacatctctaagcctcagtttcctcatctgtaaaactagggtttgcattgaatgatgactttttcagctgtctgctttttgtcttaaatgatattaatgttctaccgtaatactaagtaaaattaaaatggggggttggggaggtggttttgttttaatatgtcagtaaaggctgttaaatggttgaatcctttctaacagtttgcaatgtgaacttctaagctgctttctctgttttaagggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcaggtagagccagttccctctcttccccacactgccttgcctgtctgaacactgcaagtgtaggtggtgtggtgatgaggcaggaggcgccagcccagagactcagggtcttattactccttggtgagaaacaaaacttctcctggggagtcgcttagaagggttgccggggctctggacatccttgtctatactctgtggtactgggtacgcaatgtattggtgttgatggagtacactttatggcaggaggagaac

SEQ ID NO: 77952 - DNA, 3611 bp, Homo sapiens
ggctctccttgggttttcggggttgtccaacctgcctgctgattctagactatatccacaaagttcacccagggcaggaatgaaaagtgtttggtaaaataaataggctgttctctagcaaagcagtgagctcctgactcccagggtctggtcagagttgctgagtgggttgatctctggtctttccttgacagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcctttattttgcactcaattacagtgattattgatgaaagcgatgcatggatattttaatacttcctacatgtcctgacttctgaaagagagtaggtaacaggcatcccgagttcaggaactacctcagaacaccccaggccaggttggtcataggctgtgattttagcccccggcaagtgtgagtgaagcatctgtaccaccgcgcaggctgagcgcctgcgcagggtaaggtgccacctggcagtggggcacacagagggaagaccaggcctgtccatcagccggctgccttcagaggcagctccagcaggaccttggcttgtctgacaggaaatgcttgtggtcgttggttatttggtttgagagcccttgttcctccatctagtggagtccttattaaatgctagcaatgtggcaattgagtgccagtagcttaatttcatgtttctaaatggacactgggtgcaaatcggcaaggtgattagattattagaaaattctgctcaatgagtacctctcacattgtaacctcttaaatgtacgattataatgttggatcttaggtcaaataacagacttgagaatactttataaactgccatgatacagcaaaatctcatttattcaaagtgcaaacatactgtgtgtctttctgttttgtgtatgcttgactgcaagataaatgacaaactagctaatatccgagatttatttacaaatggccagggaccccatcaggtgaaacacatagcccattgtcttagagcttctccatcggtcctgtacaggaggattggtgacctactaacagtgaccctgtggctctgtggaattttgaagtgccttttgtgaatcatgaatgaaacatttaacttgagaccctttaaaaaattcatccagaatctgttaccccttgggtagtttgatggaactgagttaagcagaagaccccagctgttttctgggtaagccaggctttgctgtatctggcagtcaggagagaggtcagcccatggtggaggtcttcagtgccgagggctcggatgagaacgtgtagttctttgacttggacctgggcagcgtcttctatggatgcctgccttgtgagcacccacaccttccctccccactgtcgggttgagtagccccagcgtggctgtgttaggagtcctttgcccaacattgtgctgcactggagcctggccctggcactgtcctcaggaccctgcccaagggcccaccgcagagcacacctatgctatggggagccctgctggcagccccgagagccatgccatggcctgcaggagccaggctcctgtgtggatgaagtccctcttcctctgtgccttgatcccttgggggtgcctttggtcatctcttctgtcctttcctgtctctgaaatagtcatcactccccttgactctctctgttcacgtcttctcagtctgcagagttaacttctgtaaggagtttaatctggggttccaagaaaacaagttccttgttaacatagcactgactttgcaacaatagaaaactaacaaatgagcaacaatataaagagtagaggtagttctcattgggtgtaacttcaacccattctgcttgtggttagaatttataattttgctaacgatgtaatttactaaggtttgaaatggtattctaacagtgagtccattgtcttgaggattaatctgatttataagtaatactgatagacatattttcgtacatctgagcagaaataaatgcatgtttctagcatatgtaatataaaaactccagaggataagtttacacttaacaagatgttgttttctatttttgaatttcttattatttccccctttttggtagtggagttgagagggggagcatactatttgtataaagaactgtcaccccagagtgacatttattttccaagatgaccctgaactcatgctgttggtttcatatggtgtttgtgtgctttgcctagattcaaggcctgaggatttgaggaaaatcgggattttttttttcctatttggttttcatgtaaaagttctaaatgtcacttattttgctaaataagaccctttcacaggatagtgtgcgcaatacctgtccgtgtttccaagcagagttcaagttcatgtcttcacaagtagatgagagtcacttccagtcgggggaagcccgcctgagcagtgttttgagagtgcgtacattggaggactgccccacgtccgtttgcact

SEQ ID NO: 77953 - DNA, 1973 bp, Homo sapiens
aaaaaaaaaaaaggaaacctgacaattctacccacctccccccacccccgactataggcaaagagagttgatcacttccagggtctctgacttctgtgacctggaaatcagcctggcttgggaaattcatgttgttgatctttaattatttaattattctttaataatccttctattttcttgacatctgacccccagcaagagtaaggatcccagaggtcaaaacagtggtgagagccaagctgctcacagacacccacttgatgccacagccatgccatgaggcttcctcccagctgctctgctggcttgctgaagccagctctgagtcacagggttgccttggaccctcggctgtagggggcacctgtctggctccgggccctttgtcctggatacactgacagtaatgtgagcgcagcacttcagagttcaggcccagcaggtcctggcaagtgcattccacccgaacttttaacccaagcggtggggaaggaagccaaaactccaagctgcactttcttggggttctggccatgcacttcttagccttctctctgactttacaggacaaaaggtaccccacgccttcagaatcatgcttacctgcacggcagcatctgactggatggctggctaggtctcatccaccccaaattactgacccttgatttatgttgttactgctcaggttatgctcagatgccctggttgcctgaagatggtttaagtgcaggcccttcagacaagtcacgtcaggcaagagagggctggcctctgacccacaagagggcagatttgtggccaagaggcttcctggcatccacccccaggcccaagggatcagtgtggtgccagagaggatctttaagctgggactgtactgaggcttgatgggaagtatgggcagcatgtacttgacacgttatcacccagtccccttgtaaaatctggaatggagcgtttaagctgagcgttagcatcaggtcagcaggcaaagcaaacctcccacaaactgggtgccgtaaggtgggaggtgacacatggagagcttcgtcctggccgagcaggcacccagccccatgtcccccgccagcattctggatgtcagaggagggtgcgtgtgatggcgtcacattcatctgaagcacactgattgattttccacaaggtggcaagtttgatcaaattgaccgcttttcatgagacacccagatgctgtaaaaaaaaaaaacagcactgggatgtgttgaggagggggcagtttgctgtgctctgttctgtctgctgctctctctgggggccgcacaatgtccgcacacatcacggaggggagaaaggcatcagtaccaaacggaacaacctcttttttctacattgtccatacccggacatgtgaggctctattatcaacaggtggtgagaaaaattatgtttttattcgctttctggtaacttctgtaggccctggctcaaggacttagcatttcgtctcatgtacatctttttcttaagtgttctttgccatttctggaattgtccttggtttttccttagctcataggtcatagatgcagaaatatagtatttaaggcatccgcatccagcatcagatggctttgcatccagaaaaacattgataactcagtttgaagcaccaagcatgtgtaatatggctctatacaatataataaatgcataatgttaagctttttaatgcctgtggttcttgtttgttcctcagtcctctaagccacttctttagtgtttcactgcacatgaaaccaggccatgagcccttcctggtctaagagttgcctaaactgcccggggcagttcttgcggcttgctttctcacacacaggactgggaactcccaggatttggtctcacaccagcaagaaatgcttctgtaacctttcagctccaaggtgggctcaggagcaagagggcgttttaaagagagcctcacc

SEQ ID NO: 77954 - DNA, 1012 bp, Homo sapiens
ggggtggtgggtgggtcgggcgagccggtgtggggcaccttctccgaggcgcggtcgcggctctggggttcctcccatgcagttgtccccgggagggcccgggcgggcgtgcagtccaggctctcccatgccccgaccgtgggcgtcgggcacggcacttccctgttgggcctctggcttctctgcttttaccttgagggttaatttattcaccaggatttagatgtcgggggcgggggagggtggttggcggcgggagttgctgagagggccggccgcttatccctgtttggtcccacttttctcccagcacctgcccttgttcaccgcctcttcatctacttggatttggctcgaataaaccctcagctcccggccagcgctgagagccctggcggaagagtgggtagcggtggccttaagtattaaatctgtggcgtcggagcctgcttcttgggggagagactcgttgaaaagggagtgtgttggggaggtgttgtgcgctgaggggagttagaacttcccggtcggttacccagtgggaagctgcggggcacaaagcccagaatttgctgctaatcgctgggtgccctggagacagagggggcgtgtcctctgcggattccattctcaccttcccctcccgcttctgatctcgctgtttgctccacccttgctccccacccactatcagctccagcgggtgggggtgaagggctgtccccaggccaacacctccttccaggctttggggagtggggattctttccccggatgggcagagttccttctgcagtggcgctaccgtccgtgctgccctcctggaaacaccggggtttggggcaggaacacttcacctgaaagcaggcctgcttggcgcctcccggcacatctgtggtctcctctgcacgtcgctcgcgcagcctccttgcctggaatgtccttcgctgcccatcctcataggcccacctgggagagatcatatccatgccccctgccccaggtttgtggg

SEQ ID NO: 77955 - DNA, 1078 bp, Homo sapiens
agatgaggagtgcgggcccttagctgtgcactttgcaaggagagggcagggttctgggtgtgtgtgtgtggtcgggggagggctgttggatttggggactaaggtcaacatgtgggggacagtggaggactgggctctgggacagatttgcctgacctgacccgccaagggagcctcagctcccttgtgggtgacagggggctgccttcagctggaagtaccctgagggcaggtcccaggtctgtccccttcatcttggtgtgcccagggcctgcacagttgacactgggtgggggacattggggagggggtgaggacaggcactggaaagggatgcgtccacacgggtgtgctgctgggttactaaactttgcaaaaccacatcttcctgagcaccctgtttccctgctgcctgggaatcatgcactcagtcggcgcactgccctgtgccctgtgttggggacaagacagacacaaatccctgacctccatgtcagggctgaggagagaccagaaaggaggagtgaaaaagttggtgccaagtaaatgaatccgtatgcctacatcttggacacttgggttcagtgtctattgttttatttcatttcctgaggataaggttacagcacagaatgtgctttctcaaactcccatgttccacagagccctggacctcccatcccagaggaggcagggctctgtgcagccctgaggaccccagccttttaaggggcagggcagacccaaggccagcacaggacagcaaggccggagggactgtcacggggcaccgagggtcaagccagctcactggaaagggtgtgttggagttttccctgtgtacagcttttattctcacacaagacaggttcagtgtggagaaatcagaaacgccagaaagtaaaaaggaaacgcaagtctctgtccccaccctggaatcttggagctgaatgaccccctgcaggagctgtttgggccaggacttggggggggtggctgcaactcaggctgccagagggcaagttgagggggagaggatgaggcaccagctgtgtagaccttcccaggagttaggctg

SEQ ID NO: 77956 - DNA, 1052 bp, Homo sapiens
aaaactcgacaggcagccttggtttcatgagtagagggcatgggcggggcgggctgcggtccacgggatgatgacgcggctgaggccgtgcagatggacagtggtgaagggagctgaacgtgaatttaagaggttgacacacaggactggggactctggatgtggggtggagagagagaggtgtccagggcaattcctgggcttctggctcaggtgctatgggtgggtggcacttgctgcattggatgctctacaggaaacatggatctgaatggtccctgttctttcagttagacacagtgcttcaaactccctcagcacccaaggtactggcttcttgagtgcagcatcagcaatcaaacccaagtctcagctgtatttgccctgcccagaacaggccagccacctccttccttccagactctatgcttctgttaatgcagcattagcatttagctggccactctcacagggacacgcccggactttgccctgcgtggtcgcagatatgaggcaggtactctcttcatttcatggatgcagaagctgaggcacagagtggtcaaggggctggcccacggtctcagctgtgagtggcagagctgggctttaaaggcaggcagccagcttctaaccagatgctaagcttcatccccttgagggccaggactagcattgggactggccttggatgggccacttcccgccctttgccctctgccgtggcagctggcactgctcatcctgtgtctcccacttgcctataaatagccgggctggcaggggggctgtccctccatcagctctcagcctgctcaaggccagcctgcaggtccagccattagaggacaggaaaacaggtagacaaagagcctcctggccttgccacctgtcccgagggctgcccagatgggctgcctgggcctcatgcatcaacacctgcccctcccctatcctgctggcattccagtctgtggggcactcacttagattctgttgctcagcagctgtgtggccgaggtacctgcacagcctccctgagccttggtgtc

SEQ ID NO: 77957 - DNA, 1056 bp, Homo sapiens
agggcctggctggaaccagctttcgctcagaaagcgggtgggtttgggatagggtggtgaggacagtaagtaccctgctaaacagccccctgcggcaggactcagcaccataggctaggccccacagcccagaaggccgagagagtggagcccgccagagtgccaggcggggtttcagtgtggccatctgcacagtgggagcaccagcagctcaggtttcgagggctcatccagcaggaagggagcaggacagggccacagccccacacctcccaggacgggtgggcaggcctcacagggtgcaaagctgctgggggcagggaacagtcagcccacggccatggagccacagccctgaacatcctcagaaacattttattgacaacagttcccaacagagtctttggggtctttaagtggcaggtgcagcgtccacaggcagagtgagggctcctgaggaacctcaccccaaattccctaaccggccgaggacggccaccccaggcccctctcaggtgggcatggcagtcccggcagcaccccctctgagcagcctgctgtggggaagaagccgagccgggagccctcagtcgtggtgccagcccagctcatgctccccgccccgaggcccccagcctgtgggaagcccctgcctgtaagggacagctcgtgaagacacaggaacagtggtgggggtgagggtctaggaatggggcagagggtggctgagcacacacctgactccctggaggggtgcttcaaagacatgggaggcgagggccatggggaggctgggatgaacaaccgactccatgcaactcaacgctctcatcaaagaggcccactcctccctggctcctgccaccctaggccaaccctggctgatggctggcgggcccctcgacctgaggtcagtagctgggcagggcgagctcaggcctcggccgacaacactgcagggaggctcctcattctcctgggcaatggccctgtggggtcccgaacccagccacactaccccttgcctcctccagccactacgacctccagcagctg

SEQ ID NO: 77958 - DNA, 1694 bp, Homo sapiens
actgccctccccattggccctttcactgtgagaggccaagtcatggctatcgtcagagccaggtttctagccgttttaggaaaagtgtagctgaaggtataggttattgttgtggtaacaacagatctcacttctgagtgccacccacgtgccaggctctgcatgggtggtgtgggctgagctggtgcccgaggcaggaaggagccactcaggacatgtggagccatctctcacgtggctgtctccctccgggcaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtatatggaattgaaatgtcattattgtaacctagaaagtgctttgaaatattgatgtggggaggtttattgagcacaagatgtatttcagcccatgccccctcccaaaaagaaattgataagtaaaagcttcgttatacatttgactaagaaatcacccagctttaaagctgcttttaacaatgaagattgaacagagttcagcaattttgattaaattaagacttgggggtgaaactttccagtttactgaactccagaccatgcatgtagtccactccagaaatcatgctcgcttcccttggcacaccagtgttctcctgccaaatgaccctagaccctctgtcctgcagagtcagggtggcttttcccctgactgtgtccgatgccaaggagtcctggcctccgcagatgcttcattttgacccttggctgcagtggaagtcagcacagagcagtgccctggctgtgtccctggacgggtggacttagctagggagaaagtcgaggcagcagccctcgaggccctcacagatgtctaggcaggcctcatttcatcacgcagcatgtgcaggcctggaagagcaaagccaaatctcagggaagtccttggttgatgtatctgggtctcctctggagcactctgccctcctgtcacccagtagagtaaataaacttccttggctcctgctcttgtcattgtgctctgtctgggaggtctgaggagggagcagagacccctcccctcacccttctgtggatgaccttgagtctgctggagtcaaaatttggggatgaaagcgcacagtcccaggaaccccatggtgttgtgccacagctcccaggaatgggcttgtgctgggagagcccttagcagcatc

SEQ ID NO: 77959 - DNA, 1617 bp, Homo sapiens
aaagctggcatgttttctggccgccctcatcagggtccttactctccccacaggatccttactttagaatgacaagggacgtcgcccccaggatcggctatcctaaaccagccctgctgcactccaccttcttcccagccctgcagggcgcccagaccaaaatgagtgccagcgaccccaactcctccatcttcctcaccgacacggccaagcagatcaaaaccaaggtgagcagtggcccaggcagagggcagccagcgggatcagaaacatgccctggggggcacacgcacacacacaccactgcgcagtgctttgggcctcagccacccagccaccgtagcaatgctgaactccaggattgccaactttgctccctgcagaactcaaggcagcctgtccttcccacatgaatcaggtgaatttgttttgtgtcctttcatttaggtaaaattttgaattttttttctttttttccttttctgcttttcttatcagcactgttctgcaggcaaagtcatggcaatttccttaaagttataattagtgtggatgttattaaataatggaaaagatttgtgtatatttctcatcatcagctgtgttccagcggctggacccggtgccttatttatgttttctcatgtttcattctcactgggaggtggtggtgctattccctttaaagatgagatgatgaggcttagagaagcccagccacttgaccaagtttccaccaccaggaatcagcagcactgctctcctggccctgagcagccattaccaagcaggggttatgagctggtcttctcccagagagcgttctcactgagagacatagaacggagaaacgtccatccacgggacagtcctgctggccccaggagggatgcatgcagcaggcattcagcaaacatttgacaaatcactagagaaactaaaaggagaagttagtttgagcttccttattttgcatggccccagttctgttgcctggttcctcaacagccagtgtatatataattgcctcactgttacacaaagcagttgacattttctttggaatcaagtgtgtgtttgcaggctagaagattgcagtgggaatgctgggaactgtatttgaggcatgtcacatgccctctgagtcactgcccctgaccgttctggaaagtcccaagcaggttctggttgacaatggggaagcctttcatatcaaaacttcctaagacatgccctccaccaactctccccactcagttggaagctggtataattgaagacttttctttccctttcacttctggccaaaacttccggagcacagggtgcagagtggggagggaagcgccattggaaaagtccactgttttattttgcttctgagaagttgtttggaaaaagttgtttatggccaggtgcgatagctcacacctataattccagcactttgagaggccgaggcaggtggatcacctgaggtcaggagttcgagaccagcgtggccaacatggtgaaactcctgtctctactaaaaatacaaaaattaaccaggcttggtggcaggcacctataatcccagctactcgggaggctgaggcaggagaattgtttgaccct

SEQ ID NO: 77960 - DNA, 1050 bp, Homo sapiens
tggagtcagccaggcctgctcctcttctcatcctgctccctgtctgcatggccatgggcctgctacttctctgagcctaagtttccacatctgcaagatgagaatgaagatacctacctcatagaactactgtaaagcttcaaaacaaagtgtgtagagcagctaacacagagcacacagggccacctggtcgataaatggtagtagaccttatcattatccatagtcaaattcatatcacaattcaaattgtgattttgtaggcaaggaagttttaacatacgttgtaagtaggagctgtgttttcagatgcacgatggcgttcctccacaggggagatgagacgtcagctttctccccctgtgtttctttaggtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggtaaggagaaaacgtctggctgccttttcaataggtagaggaggatgtcaagttgtcatgaccacagctaaattcgaaacaactgaaatggtcttaaggcctagtaaatgttcttcttcctttattaaatgctatgagtggccagccatggtggctcacacctgtaatcccagcactttgggaggccgaggtgggcgggtcacgaggtcaggagttcaagaccagcctgaccaacatggtgaaacccatctctattgaaaatacaaaaattagttgggtgtggtggcacgcacctataagcccagctactcaggtggctgaagcaggagaatcgcttgaacccgggaggtggaggttacagtgagttgagatcacgccattgcactccagcctgggcaacagagcgagactccatctcaaaaaggaaaaaaaaatgctatgagctggtttattggttttatttaccaataattttgaaagtgaaaagctgtgt

SEQ ID NO: 77961 - DNA, 1990 bp, Homo sapiens
tgcagtgtacttcaaagcaaggtaagccttcccatagataattggatagattatacgtactaaactgttattttttgcaagtactgagcctaggtactacagaaatgagatgggtggaacatacttaactatctaacctgggcaaacatctcatctatgaatcgtatccattgggttactgattccacaaatctggctcattttaatgatgagtctcagataattttgtagtttgaaacacagattactccagaatcacagtcctttatggcccaagtgctatatctgatggaatagttatctctgaatggaggttggtgtttatagaacattctgtatatggtaaaaggaatttaaggagatttaaaagaaagaatgttctgtataaactgtaagtggaaatgtttgtatttcccttggtaagcaaattgggctgtgtatattctttgtttgtgatctaatccagcaaggccaattaccagaatagagctttagggcatagcatgactaatcagcttaattaggcctgcttttctaaacaccaggcttccaggggtggccactatggactcctgcaaaagagtctttaatacatttccagactacccaagggtacattttacctttgttttttttttttcaagatagtttgataagactccaaaatgtgatgatgtaactatttcccagtgaatccctccttaatttataacctgagagcctacattttttgtccttgcttttatctgttttagttgctcttactatccttagtggcatcattggttaagttaacgtaaatattcatctcaacctgtgtggtatgtaaaaactagttccaatgcagaactccaggaatctcaattaaaggagcttgtcacacacgttctctggcatcagtggtgtttgagaaatctttagcatatgaactttgtcataaatgacagtgtatattgtgtcactgctactgtcccaaagtgttcatggtagcactagaataacagataaaaatgaagtgttttcgagccaatgacttgctgtgattctatgggtaagctcctctacctctctgagtctcagattcttgagctggaaaaggacagtgacaacaatacctgccttgtagggttgtgacactaactaaggtaacacgtgtaaaagcatttaacacagtgcctgccacagaataggcattcagcacatatcagctattagtaatacttttagccatcccttttatttcctctctcaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattggtacgtcctctgctttcttcccagaaaaagctgcaacttttagaagtggtcccattgagttgattccattgatgtttttaaattttgaattaatcataaattcagtgaagcttcaatgccaagaaaaaatggatactaaaatcttttggttgtgcattatattcccaaaggattattttaaaataaaataacaatataaaatatatttcaaaataatgatctatagtagacagcttaatagaaggttttccctttttttgagcacttcagaacttgggaaaggtctattgaaatggccatttataacatttagtggctacaagtcaatcatagattacttaggtttcacctccagtgatactgactatggacctagaaggctggaagtcagcttaagagcagtgacttctcacatcgggcaagttcttactgtcatgcccttccttgagggccttcctgctcaggaaagactgttgccattccattgaagtctttactctgagatcattgctaattatcagaga

SEQ ID NO: 77962 - DNA, 1048 bp, Homo sapiens
gtgcctagactgggggcagtctgcacagttggggcactggcagcacacagagaatagggagcttcggggaaggatcccacagcccagcccttctctcccactcagccgtagaactctggcagcgggactcaccccctctgaacagtggactgggggagctttctctggggaatctcacttaactttaaagaaaagatctaaagaccttgacacgaaagattccccaacaaaaggggagcagcctggtcactctccaggaagtggaacctatgttgataagctcttccccaatgaagagtgcatccagcagctttcagtgcaccccccaaaacaccagcaaatagccaagaaacaccaaacagttgagaattgcctctaatatgaaaggcaggtagaaaacaaattaagatggaagaaactgaggttataaaggatgtagaggacatatggaaaactaccattaagatctcagagagagagagttgagtgtcctgagaggtcagattgctgtcagacatggcccatggacatggacatgagcatggacatcgtaaaatggaacttctagattacagacaacggaagacagaagggacaccattagaaactatccagaagaagctggctgaaaaagggctaagggatccgtggggccacaatgaagcttgaagatacatgggtggctttgcaaagagtgtttccttttttgatgtattgtttaaaggattcaaatggggatttgctgcatttgtggtagctgtaggagctgaatattacctggagtccctgaataaagataagaagcatcactgaagataatacctggaagtatcatagtggtttcttaactctccaaaataagatttcttcactgtagcctactcgtctggtttgtcccttacagaatattagtaagatttaatacagtaaaataagattaaaaaaaaaaatctcagagagaaaagggtggtactgtacctatgagtcagggcagagtgctgtgaggaaacttcagggagcatacatgctcctggaagttaaaaatgat

SEQ ID NO: 77963 - DNA, 1052 bp, Homo sapiens
aagtatatgccttgtgatcatgatcatctgctatttcctcagtctaatttcattcccatgtgcttcttaaatggagttctgatatttatagacacatgtttttccctgcaacatggaccctaaatgcaagtcctgtttatctagctgatcctctagcaaagaaacagttatctattctattgcagtgggagattggctgtcctgggatcactcaggcattctacctggcactttcccctggaatttttaaggataatttttatacttgattgacttcaaaaccttactgctgctgccttgttgccttcacgcggggcaccacattttttggaaggacagggtaaaccaaaaggaattccaaaaatagtgaccaggatggtgggcagatgttagcagagggtgaagaaaacagactaaggttgggagacctggaggagaccccaagagaccagcctggctctccttagatgtgggaaagctcaactcagtaccaggacgttaaacaagaggccatctaaagtccagctgggggaatcagtcttcaactggaacaagtaaagacattctaaggataaaccttagaggaaaaagttgaactagatgactaaggagattcattcattaggtaaatattttttgataagctgtgtgccaggtactagaggtacatggaagaataaacccagggcttacctttgctgtctgctggggaagacatgaataactaaactgcagtgtgagtgctttcataaagttactaaaggagtgtttggggatcacaaaggatggagcaaccaacttgttcccagaagcataggtgtcaggagaggctgtgaagagctgaggttcaaattggaaagataatcaatcagcagagttcaggcagagaagggtgtgagacatttcaggcaggcaggcaggcaggcagcagggagcagcagggattctgagagagcacatgagcaagggggcttgggaatcagattctggcttagctactccctggtaatggagccatcagcctcttgtctgctattgcagggcacatagag

SEQ ID NO: 77964 - DNA, 1467 bp, Homo sapiens
gctgcccgccgcgttctggcactgtgaggcgcggagcctgccaccgacccctcgcccctttcctctgagcgccgccgacccaccccgtctccctttcccactggcacccttcatcgtctccgcctgttcgcttttcccgaggagagaggcccccatttttatttagcgcctgccatgtgccagaggctttgcgtagtgttgcacttagtcccctcaacggtaatgttagcaggcttctccatgcccattccacagatgaggaaaccgaaggggaagcagaaaagtaatgcgacccttgcccaaggtttcgaataagtccaagctgggattgaaacccaggcgtctgtgaccccagaactcctgatctttccactgcactgtgccgcctcggtgaacagatgcggggaatttacagtttctctttccaccgcccacgactacacaaaatcagtcacactgacgctgagggtggggaacgggaagagggtggggaggttatttggaggccagcggggggtgaggggtggctgatgcaatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctgggtatgtattgccatctttgccaggcttagagcttgttcgtgtttttagcaaagtgctgaaaaccttggtttagggggtcaggacttgtgtcttaggattagggtgttatgcattttacttcttccattgacccaaagttcaggtgattcactgctcccatagggaacagagatcctggctgagcagtcgcgggcttggatccgtagcttgcctctcagcaccgtcatgctgtctgtcataattttcactgatgcaccctccttctgtgctcaacatcagaacgtattgtcattcttattgtgacacccaaaagtgtctcgtgcctggcttcatagaaattaatgtctttgccttttaagataatgttcatgctgttatttggcggggaaagcaatctttcttttagtgtttaaaaaaaatggaacatgatgggtcccaaaaggtgtcaagaaatccttgctctaaagaagtcattttcttgtcctctgggaacttgccagtccaaaggtattgtcacctacactctggggccaagatagaaaggatggtattctacctcctggtggtattccagggatccagaaacactcctgggccacattctcttc

SEQ ID NO: 77965 - DNA, 1036 bp, Homo sapiens
cacagtgccagaacgcggcgggcagcaagccgggctctaaggatactcccgggagggccaggccactgggcgccgcgccagcgtccctccatcactccctcccttgtttcctcactccgccccggccttactcccctcgcttaccctgcccagccgggccagtcagcgctcccggctcagcaaccggctgtctcctgggcgtccgtggaaacgccgtccggacggaacaacttccggcccgacggcgccgtcattggctgttcgcgcgggggcggggcagaggccgccactgattggctggcggccgcggcgtcgcgtcggaacgtgactggatggtagtgtgctggccggtctgcctccgggagaaccgagcgcttccggtgcgtgtggtgagcggcgggccccgggctggaggggccgggactgggcagcgcctaaagcgccccgtgccgcttaacgcggtctctcatagccgctcgccttcctttcacttcctgttccttcagaaagcgctgtgccttggaccaaccttacttcttactattgacagctcagctaactcctattcatccttcaaaacccatctctggtcgtatcttgtttgttgctttcatcgctctggggcctccggggggatctgtgttttgtgtttgatttccacccacaccagacccagcatagggcttgacaaagagtacgtaatcaggaaatgtttgttgaatgggaatatcctatttcttttacttcctagcatctccccctcccacccgtttgcattccagaaatatttttagacgctgggcattgaatagtgaacaaaacacagaaagtcctgtcctcatggggctgacttgctgatagtgactgtcagagtcactcgctccttccttagactcttctccagtgtccctgccttcccttccatcttactgtctgttcctcttcgtttaatccctcatctccttccagagggagcacgggcaccctggtggtgggaatctgggtgcatggtgggtggtgcctgggcagaggagtt

SEQ ID NO: 77966 - DNA, 1063 bp, Homo sapiens
tgccaactaaatgctagctgaacagaaagctcttggaaaggaaataacttcaagggacctggcttcacatccagctttgctgcagagtagctagctggtcgaccactggccggctgccttcctgtggagtctagtgtctcatttgtaaaagggcaaaatcatacctgggtcatgtgctcatgtgagaaaaatgctgaaaaagtgccttgcacagagccaggtacctcataggcgctcagtaaatggtggttcccttgcccttgtttcctcagagttctggaaccaactttcctacatcttttctcttgcaaattacattttgagcttttctccctcggaaacattttcttaagtgaagaaaggaagctccaagtatagagatgtctttgaaatgagctgaattgatgggtggcatttttaagtggcgaactggagtcctgaagtggcttgtctgtgctcttttctagcaagactcagagtcctgtgggagagaacgtcatattctctcttcagcctggagttccaggattttccacttaggtctttggtgcttttcctgccattccgggggctgtgaagtgtgcgcggaggcttctggcatccctggcgtggatcacagcatgctgggattgatcctgtggccccggggcttctctgctctccttcccaagtctgcgctgcaagggctggaggatgggaagcccatctggagggttgctggtgggcctgggcagtgtctgactggccctggagttcaagtggtggcccttgtcctccctgtgctcaccttcctgttgaggccttcttttacctgcccgctcacctctggagttctctctcctgatggtgaggggcagacctggggccctgtgggactggccttcgcctggtggcgtgaagtgctccctgggccctgctggcagagtggcagcttgggtcacttttgcctgggaaatttagatttcctaaacagaagcatccccatggtagtttttgagcagagagcacctgagtagaggcattgatttctggccttgtggagtagacaaatgtgccaggcacg

SEQ ID NO: 77967 - DNA, 2290 bp, Homo sapiens
agcctttgggaagggattgtcttttgagtggataaatcatattcgccactagggtgcacagtaagacttaatataagcagctcatccaagcttctagaatgtggaagaatccttgattcaaggtaacatttactgaaaaatgatttctttctgatcaggagaaaaacaacacagtccaacttattaatctaaagaacatggagtgccagttccttcatatccttaaaacgtagcttcggaattcatacatttcaactggacacattacagtggaaagatacttattttaatatgttctaaatgttctgtgagctgtaaaatatgcttttattagttttgaaaaatttacagctagagaaattaagtaaaataaaacaatgactcataattctgcaccgctgctctttcctgacgatcccttcctccccttgtctgtgaacgtgcttgtttttttcatagctgtgatcccagcacggatacccttttatatactcttttcatctcccagtgaactcttttggcttaacgtgtttgaacacccactgcacgtaaaggtagaaattcagactttgatgcctttttttgaaggaaaacatgtacgtggcctgcgttaaccaaaaacacaaccagccgttattgaatgctcccatgtacagaaccctctgccaggcactgagagggagtcccaaaggaataagacctttgggtgggtgacagaagacccaccagggaccttctgtacctgtatgaaaacctgcagttctgaaacacagaaggtttttaaagaaaatatatgaattagatgttgtttatttgctttacagaataatttgctctagaaattctttcagtaacaagcttccttaaaatactttgaaaaaaaaccttttaatttttgaccatgaatgtaatagatgcttattgtgaaaaactttaatgatgcaggaaatatgaagtatgaaggagaaacagaaatcattgataactcccaaccccaagtcagtgcctcattaacatgaggggcctccctggtcgggggccctacattcctatctgtttacataattgggcttattgcatagtatgtgcagttttgaattcttcctctgctgcccaatcttctgtaacgtgtaaggggaatttttctaccttattaaaaacttttccccaaatatatttttataactgtctcaagtttcatactttgctccatcatttccatgttgtttcctataatttcctgcttttgtttaaaaaataatcagtattacagtgaatatggctatacataaatattgtctttttttgctgccttaatgcagttaagatgggctttgaggccaggcgcggtggctcatgcctgtaatcccagcactttgggaggccgaggcaggcggatcacgaggtcaggagattgagaccatcttggctaacatggtgaaaccccgtctctactaaaaatacaaaaaattagccgggcgcggtggtgggcggctgtagtcccagctgctcgggaggctgaggcaggagaatggcatgaacccaggaggcggagcttgcagtgagcccagatcgcaccactgcactccagcctgggtgaaagagcgagactccatctcagaaaaaaaaagaaaaagatgggctttgatttacacccaggcattagctaaagcccttgtgtgtggtgagagtgggacctgattagattggcaaaccttcagtaccactgttgtactccttggctcccatgccaaatcttctgcttggtagctgtgtgactttgggaaaatcacttagcctctctgatcccctagttcctcactggtaaaatggggataattggtaaatggccaccaattaaggttgttgctgtagagctgaaatgagaagatccagcctagtgcctgacaagggagaggctgaggaagcatgtttctgattcccctgtacctgtcttgattagttataaaacaaagtgtagaaaagacaaatcacccagaatcctccaacttactgtaactcttgttttttgtgaatcttttcattgtctctatgcacacgtttttaaagcgtttcaatctcagtgttcttgagataaatacttttagaatctaaagagtttgaggattgtctgtgccaagccattcatgcactcccttttcatgtactgaacacttggcaggtctgtgttggagagctggttccctgtccccaaagtggtcacatttaaagcatggatgagaggatggagagcgctagccattgctgagtgcttaccatgtactaggca

SEQ ID NO: 77968 - DNA, 1033 bp, Homo sapiens
gagctgccgagcctctgggaagagccatgagattctgagctggaatcttctcttcgtgggaagtgaagtttttttgacactcctcctcccccatgtgaaagccgcgacatttctgaggccaacaaatgagacatttcccagttccagttgccttacaatcttgtatcttacagaaaaaaccttgggttgaagaggaataagaaaaggaaagtgtagcagaacccaagctgtgttttctgctttttaataacttcattccatttaacttaaacagttcagtgtaccaagggcggggccttgtgctcgccagaagctgacaggaagaaaacagccgtgtgaaggtgcagcctctgtcctcgagaagcaagcctcattcactctcatcccatgtcattaagggaaggatagagcaatttggaaaaatgcttttaatgtaattgaaaaatgcagattgcaaaattggcgcacttaggagtcgagacagtctagtaaattatttcttgttgcttttaaaactcggagacagtagactcttaaaggtgcttgtctaatgcccagtgatggcctgtgtccaaatgagttgttttagatttaatttgttttatcataaaagtggtaaaattttgggaaaaaatgcaagaaaatggcagaaattaaaagataaaccatagacccttcattcaagcctaatgaccatgaacattttgcaagcagcgtttccttctagtcttttttccctacatatatcaactagttttaatcatatggtaggtactttgtttttgtagcctgcatttaaaatcatagggtggtcatttctcccccagattgttagtattatttcctcttaagagaagggttaggtaagtcattccaaccttttaaggtttccttctagcttctgctgtttcttgtcaggtgttttcttttgtctattctcccagatgaacacagctctcatgcggacccctcatatactggggggagtggagcaagccgggggacagaagccctgaggggcagtcagaaggta

SEQ ID NO: 77969 - DNA, 1099 bp, Homo sapiens
taatatatattcagggaagtgttctgtcatgtttttacattccaagagctgtttcttattttctgaatgttcctttttttaatatagcatattgttttttattgtatatttacaaggtcttttcttagctctttgagttctttgaaagttttcctgttttctgaaatgtttgtctctttcttatctcctttggtctttttttgttttggtgtctgtgttccatgttagagatttcctgctgctcattccaattagggagggaggacctaaaaagctgacctgaccaaaagctgtgtgtgtgtgtgtgtgtgtgtgtgtgtgtgtgtgcatgcacacgcccttgtgtgggggcaaagggactttgtttgcagcgggccggatgtagggttatgaggcagcaggctggcgctcatcataggaacccacttgtgattatttttatgtatttccttgagcctggtcagcttctcagggaggtgtcttctctgggtgggctcttggcctgctgccagccttccggcatctgagctggggaagagggtcaaggtctctgtgtttagtgtgcagactgcactctccatcctgtcctccagcttggttttctcactgtccggcacatcttttcccaccagtgtgcagatctgtgccgctctttttgggggctgtgtagcgctcagtgtctgacacacaccatcatttatgcgtaaaagtggctgcgtcttctcaccctccacagcggcagaattattaccttttgaaaatgtctgctaatttaatggtgtcttgtttgagaaccaagtgagttcatttacgtacagctcttttagaacgggccggcacttcgttcattctaaacaagcatttgttatcctgattcttgtccattcatctcctgtagtcttagcgtttctcttatctgggcaatttacgtacttacaatattgacctttcatcatattttaccctcttcccccccagggtgttgtgtgatgttgagttttggtatttcatgtatttttttttaacagagaaaacctgacatttttcgctgtcaagtctctggccctttccctttgtaattgtccatggctctagagca

SEQ ID NO: 77970 - DNA, 1021 bp, Homo sapiens
tgcctagaattttcccttgaagccccaagggggcaaaggcccttatctaagtgaatgtgatctgtaattatttagactaacaccaaaattgctttcagaacattcttaacctgctgagtttagaattctaatttgaatacatgctagcattaaaagtttcacaagtagcaatttctctctccctactcacagtgtatttacacagcctgacaactgtagggaaaatgaaagagattttataaacagaagtgctctctttctgaactagttgaaatgttattttgaaaggtacaaaaacacaaattaaaacagattttcattgtcacctttgcttagaaaagttgtttgttttcgtcctgggcttcttttcatgttcttttctctcattcaagtgtgttctgatatggttctgatacggttccggtacctgggtgtcctgctgtgttgctgttagcccgggggcggaggattggtggctgtcatcaggtgctggcagggctgctgtgggaggggaacgaggtgtattcgggtttgctcccagggcagaagtaggacagatggtggaaggtgtgtctgtggggggaagaggtcagcacatggtgaagaactttccggtgctcagagctgggcaactcgggcagtagactacttggaaagggagcgagggctgttttgcctggaggggtgtagtgcaggttggagcccatgttgctggagggctgggaagtagatgcaggcattgggtcagccactcagaccttgggctccaaggccgttaatggcttgagtgtcctgtggtcagggccaagatggtggctgtgagctgctctgccctgaaatactgcactttactgcacttggggccccgcctgagtggagcacagcgctccacacactgcgtattcaaaagagagtcaggcacattcctcctctaatttctctgagcttcagcattctcatctgtgaaataattatctcacagggctgtgaggatcagaggaggttagatgtgtgaaaccac

SEQ ID NO: 77971 - DNA, 2088 bp, Homo sapiens
gtttattctgtgattgcctcctaagccgtgttcctaagggtgtgaggcttgcaatccactttgcctccagttgccttgattcgttgatcaaataatccggtgcgcacccagtgaccccagcagactcttgaggagctcaggtccctctaggtgtggcttcttgtcttccagtccagcagtgtgacatggctggcagtggttgaggtggtggacttgggggatggctcagctgatgggccttgtgacgtctccatgagccaggcttctggacttgctgctgtgtggcctgtgaattcctcgggccttgctttatgctgtctctgctgtgagcagagaaagcactcagtggcagtgtcagcagggctgttcctcacttctttcttcatttggtcatctgtatggctgtccagccatcagttaaattctggctctttgccaggccctgggatcagaggggaccagacccactcttgctggtaaaaggtgaatgaggcacagacatcaaagcagacttgagagggatgatgagaaaggccctccagggctatctgtgctgggaacaggaatatatgggagagtgtgctaggtctgtcagtgctggaggcagaggacaagaaaagcctcagggaaggggaaggacgagttgggtcttagaagatgaggagccaggatttcggggccagcctggacaaaatagggaggcctatctccacaaaaaattaaaaaattggctgggtgtggtggcacatgcctgtagtcccagctacttgggaggctgaggcgggaggattgcttgagcccaggaggttaaggccacagtgagccatgattgtgccactgcactcaagcctgtatctcaaaaaaaaacaacaacaatgaaatcgatgaggggcagccaggtgggtggggaggacagccctgtactgtgcatgctgtggggcggggacagtgaggacggccaggtgaagtgcttgggctggtcatcagctttagccctggatggtcagtggcccaaggccagatggcgcttcctgtacttgtgctgggtcaggcaccacacaggggtttacatctcatttgccctcagctgggtaatcatcagagctcagggagtcttatttcggtgttcagtcccagcccctgtgctttctgtgtggcttagggtaagttacttaactctctggaccttagtttccccatcgtaagtcaaggacaataacagcatccacctcagtcttctgaggattaaacaagagaacccacggcagactctcaggagagtaccaggcgtatggcaggcactccataatgcaagctggcagcagcatcagcatccgtatgccccctttacagatgacaaaactgaggaccagaggggcgtattgaaggacatgtagctcctaagcacggggctggcatttgaactcacctttgctgcctctgctttctgggattgttctagtcacttccctgcttgggggctccaaaagtgtagtcgtgtaactgtggcaaggcctttaatctttttgtgtcttaatgagctcgtctgtaaaatggcaggagctctgatataagttccatgagggcagggaatttgttttcttcccttgttttatctccagtttgaatgaatagcacctgctcagtcgaccatgctctttgtgggcctacttgaattttgggatgtagagaatcttggaggggtccaactgcactcccccacccacccctcacctccagtctgtgcaggaggcatccctgtggggattcgggattggttaaatgtcgccaggtttgtgaaagggctttggaaactttgctgggagctaaatcaaagtgatgattgttccacatctgtgaaatgttttttttttttttttttttttgagacggagtctcgctctgtcgcccaggttggagtgcagtggtgcaatctcggctcactgcaagctccgccttccgggttcatgacattctcctgcctcagcctcccgaggagctgggactacaggcgcccaccaccacgcccggctaattttttgtatttgtagtagagatggggtttcaccatgttagccaggatggtct

SEQ ID NO: 77972 - DNA, 1028 bp, Homo sapiens
gttctttctagggtgggctgtggcagggccacaggtccctgggccagactgccagagttgttttgctcttttctgtgccttggtttctctcctgccaagtggctgtaacaatacctatctcacagacctgttgtgaggataaatgttgtggttttggccagggaccttgcaaagtgcttttgttaacctgacctgtatggtctgtgtttctcatggtgaatgttgtatttctcaaatggctcaagtccttcaactcaggtccccgagttcagaggagatgctgctggaggggtggcaaggtggggtctcccctcatgcccttggctctgtccatactgacgttgtcaagtgtgacctgtttgttattgcctaaaaacacttaacgagttcaaagcaaagggaacatactttttaattatttctctgcttgtctccagcaatgctgttgtcaaggaaaccaaaacctttggaaagcttttcagcttctcggtcggaagaggatacttgtacagtgcgtatattgtcggtggaaatggacctgtcgttctgtaacaaaatctgtttcttttaaaagggcttacttccttcacttcttacaaatggactctttttggccttttaacagaagatggaaagttgttactggtattttctcttttaaagaattgcctgcattcttgacatagtatttcattcattcaacatctgttgtgagacttgggtgctagggatgggagtgtgatacagagatgaatatagcctttctggaaaggctcctggctcattgaaagaaacaggtggacagatcattatagcgcagcatcatgactgctctgaagggtgttgggtaaggtgctctggggcataaagaacagcctgggaggggcagtgtcagcaagtcacaggagtcctagaggatgggtagccattgctcagcagcaaagcgatagaaaagcattccaggccaagggaacagagtgtgcaaaggcagggaggtgtacaagagcatgctgccatcagcaaactgc

SEQ ID NO: 77973 - DNA, 1597 bp, Homo sapiens
acggaaacagaagcccagcagaagctctgttctgctttccggatgcttctaacgatgatgacgcagataatattgatttctagaatcagctaagccctggcctgtggcctctggagtcccttcattttccaaaggccaagctgatgccacagctcatcattctgttcagtagatggtcatttttgatttcaaaattgaaacttcaaaattttgagtaatctacttccctgtggctccagaagactgggtgcaaccatgtgaaaaagacttacttgaatttacttacattaactgagggaaaaataccagatgaggagggtacgggtgctgcaggttccaggaataacttaagttacacatgggagagggttagatgcatttgttgaattactgggctgaatgactgcttttaaaggacttgggggaaagagaagtacagttgaggccttaaaaaagatacttaattcaatgaatgttcagtgaggactggccatttctgagacatggggtcaggtgctgtggggcaccaggagtgtgaaaagcacatttcctcctctggaggagtggctttttaagtgacagagctggggcatgtgtgtcctgtaccgcagtgacattccttgatacttgtcatggtgatccagtgagtgcagctgttgtcagttctgccgtacaacccacatggctgcacattaactgggctttgtggtcccctcggagggctgttggcgcctggtcctcagtggagctggtttatgatggtggcagccttgctgcacctttccgggtttgactcaggcccagcttgttggcattagctaggatttggagttttgccattcagccagcaccagctaatagcccagcaaggaagagttagttcatggattatatttaagttagtacttattcccaaaggtaactttgtttaataaaaaccttaagcccttattactgtgcttctgggtatcctggctccagtgtgtaaaaataagacttataaaattcaaacattatttgtgaaaatgcaaaaacattttcattaatacagggcatgataaaaagcaaaaggcactttccatctgtggctaagtggtctttctgcactggggtctttttgttttcataatcactttgcgcttatttaaatattgccctttcagtcgtgaattttaaagggaggaagctttggtgtgtgaataactttacaactacccacagtatttccatccagttgctatgacttaagttgataatggaccccacacagtagtcactaatggatgataatctaggagtgtttttgttattgtttttattttagaagaaaggtttgaaattagcatagtaaatctctgtgggatctttgcaaataaaagaatgttcacgttaaaaacaattttcaagaaagatgtatggtaatgaataaaacatcagtgagtgaaaataagcgtgtttaattattcaagtagaagtagtaatttaaactaattattgcttgcggatttcataattcagtttttgtctcacaataatatttcctctgggcctccggggcgcgtcggcggctgctcgctgttcctggggcgggagagac

SEQ ID NO: 77974 - DNA, 1671 bp, Homo sapiens
cctcaggtgatccacccgcctcagcctcccaaagtgctgggattacaggcatgagccaccatgcctggcctctctgccccatcttataggcaccctggggcctaggatggggctggggtgcaggggatggggagggaggctgggccccctggaggatcagtaactctgttatatgtcttcactataatctcattttgggctgcactctgcttttgtttttgtttgggagcctgcttggaggccagcactaacagaaacatgcaagggcagaagcagagctggccatcgggaggtgggtggcctgcagggcctagctctgtggcgcatggattggtgtgtcagtcgcccttcctggcagcagctctcagtgattaggcttggaggagccttggctttaagttctctttggggaagggcggatattagtgcttaagaaacgccactcccgaggaaacccacctggatgtttttctctgtaactggccatttggagacagggccaggctgtgcataggcttttgagtttctcaggtgcctacatggggctcaaaatgatgatgcaatcaatccgtttcttgacttttgggcctgggtccagctcagaatggaggtgtgctccatgggcttgccttcggagaagatggttagcagggctgtgggaagggatgtgtggtggacagaggtacaggctccccaaggcttagaggcttcagaagcccatgtcaggcacgtggggcccaggttcaaagcagaggatggagaagggagggttaaagccttccttctgacgttgatatgtgtgtctcagcactgggacctggagcagtcggcttcggaggcccgttggactgttgaatattgatggtgtgggtttggctgaggagcataggcaggtgtgtttgccattcttatgtactcaggaggggtatgaagggcaagtcagtggcacaattcaagcaaagtgctgctgttactcgagcatttgctgtgtgccaggatcttcacacggacagcctcagttttcataggagtcacttttaggcattttatctccattttgcagttgaagcaattgatacttaagatggtagtatctttgtttagtgtgaagagccaggaattgagtggggaatgcccttatggcagcaagacagtggcaccaagtcctgcctaggtggcttgtccaatgatcagagtccaaggccacattgctaccaagtggcagagctggaatcagcgctactcagcctcacacattttgctccctgtgcctcttcagaacttcggcctgtcacatgtgtgcagctgtgggagcccagattgtgagttgatcaaggtcagggccacaccctgcacttcctgcctgacacagagtaggtgctggacagacatttgtgttgtgaaagagtgagtgagtgaatgaaagacacaccatggggatagaaaaataaggggcaggccccagggcggttggcagatgtgaaatgtggtttaaagacttggcagtaaatctgtggctaggccccccttctcctttcattcccttcttccttccttcttgggattcagaattgctctctgggcagagggctgcggagcaggagcgaggctgcaggtgtgagaaggaccccgccgtgccagggcagcctcaaggagctgttgagcgagttg

SEQ ID NO: 77975 - DNA, 1068 bp, Homo sapiens
ctgtctcatgactgggccttctcacagggctgcctttgagcttatcaaattggagacccagtgatccggctccagcctctcattttacaagtgaggagttgcaggccactggttaagcgtgtctggcgcaaggtgatgtggtagcttagggctggtcttcatgcgttgtaggcctgcattgccttttagtatatgaatcagttaggaatattggcattttaactttaatgccattgtcacaagctatgtcaccatgcagaggacccccccccacccatcccaggaagctgatcgagggtctttaaagggctctcttttgagggaaggggacacctcagagcacctggcacttgaaaagatgaaaagtaagagccccatcattgctgttaggcacacaaaggaggagaaattgctgtgggtgatccctggttgtatgaatattgagaagaaattaagtaaaggctgtgtttcctgacactgatgtattagaacatggagtaactttctacaggaaattggaacagggatccctttaaattgaatttgaagctgtgaatagcaaacctgcacttggccctgtgtgtcctaatgcaagttaagtaagcagtttcctgggtgagagttaagtactttagggatatgggttaatgttgaggccaatgtggctcaagttaataaattgcctctcgcgtgtattgtctgtgaagatgcagaagagtaatttgcttcctgcagagctgctccagaattctcatacttagtttattagatttttggcccaatacattttttccctctcattggttttgttgataataattactcacccccttccatctctctatggatttctcttggttttaattgttttcagtagccacaaaagtttaccatttcagaaaataagtgttttaaaataagaatagtcttggccaaaccccatctgagtttccagagggagacagtcaaagctctattgttaaagtgattctgggggcagtggccactgagattaggaaaaagccagcgctcccttcgtcaaacacgtcagtgctcgtccctggccta

SEQ ID NO: 77976 - DNA, 1718 bp, Homo sapiens
gaacaagactccatcacaaaaaaaaaaaaaaaaaaaatttatttcccgtctccacaggggtctctctgcggcttcctggggcctcgctccttccgcctacctctttcttccttctcctgctgtctaccctgtgatgtgatagctttctcggggagtgttcagatgaacagtgtttagaattgttgaatgctctgttggaaaacagaaaaggctatttcatgagcagatgatgaccttattaactataattaggcaattcacagaggcttccaatatagtccagcatcttttcttgttgagatggggggaaaattctatggtaatgtctttggagatgtaatagtctttatcacattactagtttaaattattctagaagttttggcagcctggtgttttcatttagaaagccgaggtatagttttacagttagccacattaatataataattataattttgagcaagtaatttcagacactgacatcaagagttgtttttatagcagagaaagatcacaggtaggaaggtggaacctcgcgtctaatctatctaatctgtcacaaataggatgatgttgtgaacacaggcagttcatgcccctggcccatgctttatattatgggacagagatgcaaatgcttagaaactccccctgtattaaatccccagagaacacgcacatttgaaattaatgggaaattgtcttttctaaagaatttggtatgcaggggcacatgatgtggaatttcccctgggttctttgtatcaggttgccccattgccttgggcttgtgtgagagtggacctgggagtgaacgggtgctcgcagggcccacctggtggtcagtctgtaactgtggctatgagcagcctcccaccctgtaggcccctcacaaggcctagttgcctggatctccaggggcatctggaagcctggaagctactgtctcctgggcaaggaggccttcactgcctccacagcccccatctgcacatgggccgcaggccctggcaaccccttcccccacttccctccactggcttggacctccaggcccacagcaagtaacttttggtttgtgttttacctttcacttgtaagcacattttttttttatcgttctatagggatttttcatatatcattttggatcctgtttttaaagctcagtatccctgtttttacagccttcaggatagtcatcttctatcatgtggttgtaccacaatttgctagttgtatccctgttgctgaacattgagctttttattccagcaggttttttattgttgttttataggcagtgctgcagtgatcatctttatgtacataatatttagcttctgtgcagttagtttcttagactctattgctagggttggaattgctagccaagactaagaataactttttaaaaatatattaaaatcttcttatagtaataatatttgaagaacagaaaaaggtagaaaaaggaaaataaagatgcccagctgtcccatgatgtggtgttcaccactgtattagctaggagtgtatgaggctgcagataacaggaaacccaactcgagtggcttcaacaggtggagagagactcgtttgtctcagggaacaggagacttgagagagagtccagggctggacccaggtgaagccatgctgtgagcgaccctggctgtttgcatctttctgtcccactgtcctggatgttgctg

SEQ ID NO: 77977 - DNA, 1017 bp, Homo sapiens
ccccagtcagtcttgcaaagggaggtttattgagcacttaccatatgcagcagggggttgtgagccacagtcgtggcctttgggaagctcacagaagaggggaggaagcaggctgacttacccctgccctatcacactgttacccttgtgtcaaccaagcttaaccttggctgagtagaaatgagtgatttgtgacctatgttaatcctacagaaaagaacaaaaaaataaaataaacttccatagatgcaccaccaggttttagttattagcatttttccgtatttatactgggtacctcttttttgttttgtaaggaatgaaatatggcagatagagctaaaaccctacttcattccctttccattagtggccactcccctgacgttggtgggcatgcttttaaatgtttcctgcatatgttatgaatgacataaataatatgtaatacttttgtattttaaaggtttatgtacatgttattacactctgtggttttttgcaatttgcaaaacagtcaacattatgttttctgttatctctctatccatccatccatctatccatctggttcattcaattttcattggtgtgtgggattccactgtataaataagctcaagtttatttactcattctcctactcctggaaggttgtttttactttttgtctcttgcatacaatattgtagtgaacatgtgttccagttttttattgctgtttaataagccacctctaaacttagtagcttaaaacaataatgtttattttgcttctgaatctgcagtttgggcagggcttggtgtgggcagctcatctctgctccacttggtatcatgtggggcagctcaaaggctagaaatggaagcatctgcaggtctgttcgctcagcatccgatgagtgattctggctgtctgctgggaccctggctgtgctgtttgctggagtattacatgtggcctctccatgtggtctgggcttcctcatcccatggcagctgggttctaggggctag

SEQ ID NO: 77978 - DNA, 1045 bp, Homo sapiens
tctcttccagctcttgctgtctccttggtcatttaattacttctggtactgatttcccccagcctgatctcccctgttataatagcgtgtgcatgaagcttctgtggagaatgccactgaggatggaagctgtcggtggttggcaggccccagtgtgggcatacctggacccacgggctggctgtgggcttcctccttgggccacatagcacccaattagtcagacacaccttattccgatcgtactgtgaggttgtagaggaaagtcccttcagatcctggcacaaaggctggcattggggagtgtttaggaaacgtgttgaaccaaataattcaaaatgttcggttattataattatcaaggtaacctgctgacgtcactcaaaaacatctggaaaatagccatgtcagatcaagaattttatgatgaatttcctcgaaaacggaacttttgactacttttaatttaatctggttccatctgaacactctgaacactatttgcagcgtgctggagaacattatcttctctgcttccctcctaaggggtgtttggattcttatctgtgttgagaaccagagcctgtgctgcggaaatgagatcttgtctgtgcactgagtcagcccaggtcttttgcaggcactcaggaagcagcatctacatcttgaggggctacttttctggattgtgtgggtgcagcgtgtcctgaaaacatcactgggcactgctgtccataccttatgatggggcacgggccactccaggagtctcaggtggcacagctgcccaggatgggcttggtgctggtcccagggaggcagatgacacgtgttgcccctcagaacagtggggacagccaggtgtgccacaggccatctcgcagggcctccctgtaccaaccagattgggtataaacaaggcattcattacctgttgttttaaggggaggaaggcaccacgggcgaggcctcccaggctggctgggtgagtgttcctgagcccaggcacttcgatgcccacactacttccagggagctgagtttc

SEQ ID NO: 77979 - DNA, 1034 bp, Homo sapiens
aagaaagaggagaagaagttgcctccttgggccaaggggctaaggtggctcaggatatgtctgttcatcttatatcggagcccactgttcatctgccctgaggcctttaatcaccaagaccccagtggctgggggaaggcctaggcagtcctatacatacagcttctgagaacgtcagaaaatcaaggattcaaccccataatataggtgacactgcttgtcttagtctgcttggactgccataacaaaataccctagactgagtggcccacacaatagatagtttatattctcccagttctgtagactggaagtccaaggtccaggatcagccagcagcattggtgtcaggtgtgggctttccccttgggttgcacacagccaccttctccactatgtgcacacatggcctttccttggtgtgtgcgtgctgctggggtggggcggtgggggcagggaattggggcagggagagagagggctcttatgtctcttcctgtaaagatagtaatcctgttgaatcagggcctaacttatatgacctcatttagccttccttccttccttagaagtcccatctccaagtgcagccacctggggagttagggcttcaacatatgaattttggggaagacacatccatgacacccctagtatgctgcctgacacatggcaagtgctcaatgaatgtttgttatatttgaatctgaaaggttccagaaagatgagatggacttggccccagaggctctaggcaaatcttgcagaccaagggggcctggtgtgtgtgtgtgtgtgtgtgtgtgtgtgtgtgttcccgggaaggcacatcctaagcttggcctgctggctctggctggtatgttgggtatagactggagatgagctccacctctgcccagccagtcagagtcacctccggacctcctgcttcctgatctcctcagccctttggggaaatggaggaattgtgacatttgccctaggtgatggggtgctgctactggggccatataccatgaagccgaaattcc

SEQ ID NO: 77980 - DNA, 1116 bp, Homo sapiens
aaacttgtgaatgacgggtgtacttgctcctcctgctggggttcattgcatgcctgagatgccaagagcagggctcgcatcaccctgggtgctaaggaaaaaggccccagggagggaaggataacccaggagaaaggaggagctattccccttataattgctttccttatcattcttttaaaatttgttgtgtgtacatgttttgtaatgagtataacacatcaatagaatagggtttatgtactcaaagttgtgtgctcagaaaaatttttaaaaatgatagtgatatgtgatcaaaaaagtttggagatcacggaaagagaagctcactcagctgtcttgaagtggagagagccctggcctggccttaacatccagagatgagggcttgtgatcccacctgctcctgctatgggggcaacaagacattcattcactcaatcattcgttcattcattcattcattcattcagtatggctgagcggtgaggttaacacagtgagcaggaaggtgctgtcctgacttcagagagcatctgcaagtccagatggggatcttcatggctggaaggacagtgaggcctgtcagggaaggacacagtgctgtggatcacctaggaggggcttgtaagtgaggtttgggggttagatgtgacttccagggagaagagtgacgcctaagtgtgtatgagagtcctctggtgtgaggcttggagaggagggagtgtagctgctggccagcaccgtggaagagttgactctgagcaaatcattaatctttttgggccttaattgtcttctctgtaatggggaaggatagtaccactggcctctccagcaagttctttgcatctgctgaggccagattcaggtgtcaaattctcagctctgctgttgactagccatgtgtctttgggatgtgttatgtctggagctttgctaacaaagctttctcaccttatctcattgagtcctcccatccagcattttccatatgagtgctttgagtttcagagaagtgaagcgcttatggagggtcccacaagcagtgggagccgggacgcagggctgactactacacctgggcccgccttttcaccacagactgtgtgtgct

SEQ ID NO: 77981 - DNA, 1030 bp, Homo sapiens
gcagcgttttcctttttcaatttcaacctgactccattcctctctttatgtgtgtcagtcatagcaggggagtgttttcctcttggatgcgtttgcacctggcaaatgaatgtgcaggaattctttgattgcaaaatagctactctcaaaatgcagacaggcagccacagtcagggagcccttcggccacggcagcggggtggcgccagacacctggctttgagtcccgtggaggcatgccacttagtctgttctgagcggctgtttacaggcggatagaaagggctgtaggatgggaccctcaaggttttggggcatgggaggggctggccgtcatgattcagcatgctagctctctggaggctgtgctgagcactgagggacactgggagaaaaacacaggctcctgctttgtccatgtggaaggagcccaggctgccctggctgctatacgcatccttccaggcaaccttcaccttctggtctatttagtctcattccctgtttttattcccttcttttatttagggagagccagagcagcaattctcaggtcaggattatttgggagatccatattacttctgattatttacgaagggacaggccgggggaggtaaccacctcgataaattcgtcagcgaggcagctggagggatgtgtgacaaacataccaggctgtcatttggccagagattgtctgcactgggattgttcccccaggatagtcctgatgacaaatgtaattgacattttttattaaccctgaaatgattaaagatgctgctgctgaatttgtgtcaaagtacccggtccctggcattttgagaaagggattctctgtggagccaataaacagcctgtgttttcttcctgttcatcactttaatcaactaagacatacagagccctgtctggtttggtcttgaaactgggccagggagataagactctgcttcctggcttaggtttccagaacactctggtatggacatcatgagggacacataggaggcactctgttcattta

SEQ ID NO: 77982 - DNA, 1039 bp, Homo sapiens
cgtccttagggacttgagcctggtgtgtaccgacactgcgctctcttggcagcaggcagtgagggacaggagaagaaccaaagttgatagtgccttctgtggcaccttctacttcgtcactttaattccctttaagcttccccaccactctggaaagtgggaagattagccccgttttctagctgttgaaatgaaagctcagagacaatggtcatttacccaggccacatggattgaaggggcagaacagagttaggattcaggggtgtctgaccctgaagtcccccatggaactgggcctctgtgttcttgctgtcaccccatatccccaccaggcaccctctcactcactctgttcacatctcccagcaacctcagagttttaccctatgagttctcagacaaaactttagaatttattatcaatgcatttctctgcagcaaagtctggatgaatttaagattaggggattcggttacactttattactgtttgtcattaaaaatcatgcaaataagccatggaataaagtaacttgtgttgttttggacaccagatttacatgtttactggaagaaaaatgatgctgaactccttcaaggtggtaataaaattttgcctcagagccttagctttgttggtctttttctataatttactccacaacttccaaaaaatattttaaactagtttatcataaaactcacaccaagggtttcaaaacatccttttgtaaaggtgaaaagaagactgagaagctgcataggctgcaggctgggagtggagaaggaaagacctgctgcagccatgtgactcaggggcctgagaggtgaatcaaagcctccttgttgccagggctgagacggggacaggatggcttctaggcttcctgtctttggattttagtaggaagtttccaggcttttgttctgaaacccccaggttgcttcatttagcttccgacctccctgtaggaggaggtgggcacagaacgtgtttggaagcgtctgggagaataaggaccaggctagaaagaac

SEQ ID NO: 77983 - DNA, 1543 bp, Homo sapiens
gtctccgagataagagtgagtaggatagggccacgagggaggcgaaggcttacccagaagtttgacagccaggtgatggggttatggatgactcttattttcgttgtatttttctgtttttttttgtttgttttgtttgtttttttttttgggcagagcacacatatttccaatgaaatcagagaaacaacaatcctatagctgtttcctttgggattttgtttttgcacttctgtatagtttgaataatttacaagaagactgtattttttgtaaccaaaaacgaaaggcaggcaggcagaaagaacatgacctgtggctagatcaatacttgttcaatctttggagactgtgaggaactcctggtggggccatgtcttggtaacgaggacacagaaactgtggtaaatatggcaccgacaagtgactgcaccatattttacttgtcatattcttttcaaatctgttacttttgtcggacacaaagaatgtctctagttaatacatgaaatcatcttggaacatttgacagaagatttaactccttaattctatgaaggcagtttgggatctctaattacttaattgaaaaaagcacgcacttcagtctgctgcaatgttggggaattaatctttaaaacctgacagtgaacattaaattcaattaaggagaccaattggcaaagattcttccctccttcaccctggatagctttgagaggtagctgactggtctgcattgattcagatgctgtcgttgtctgtgcatctactaggagagccaagtgtgcgtttttcacttcagggggagcttgtcagacgatttacagattgatggatctccttacatgtttccgtggctgatttgggagttcccctggacaagaattcaaacattccagtttgctgcttttggccttggacttcatagagttcaagttttttgtaatttcttctttcttgcatgagaccactatgttgcccaagctggttcttcctcctccctccgtcctctcctcctctccatcctctcttcccctcccttctcttctcttcttcccccttcctctctgcaccccccttcctttttcccttctctttccctctccccgcttcctctcccccgctccttcctttttcccttctccccttctcttctctcccccttcctctcccccttgctccttcctttttcccttctccccttctcttctctcccccttcctctcccccttgctccttcctttttcccttctcttcttctttcaccccttcctctccccctgctccttccttcctttttcccttctcttttcctccctttccgtttcccatcctgtgtttcttttttctctcctctccccaattcctccatcactccttctctcccttccttttttcttctgctcctcctcctctccgtcttggttaatttaactttttattttaaatatgaaatgttttaaacatactcaaaattatagaaggtaacagatacctatacacctgtcactgagattgtcaaatccccaggtgtgtctgt

SEQ ID NO: 77984 - DNA, 1032 bp, Homo sapiens
agcaagtgccaagatttctttccattctaaggctgaatactattccactgtatggatagaacacatttttacaattcattcatccatccatagacacttggattactcccctcttttggctattattaataatgctgctatgaacatggatgtacagtatctttttgagaccctggtttcagctttttgggcatttacccagaagtggaatggctggatcatgtcataattctacatttaattttttgaggaaccatcatgctgtttttcacagtggctgcaccatttgacatgcccaccagcagtggacaagggttccagtttttccacatccttgtcaatgcttgttattttctgttttttgatagcagccatcctaatgggtacaaggtggtgtttcatgtaaaaacttaaatggcattgtacttcgtatatgcagcttgacttatgtacttaatattaacttttttaccatttaaccatgtaagccctgtagatctcgtttattttactatttaaataaaattaaactcatattcatacatatttttggaaaacagcagttccctgtgccccatctccctcccgtgaattcttattccactttgaagtcttctggctgtgtcttctggctgtgtcgtgtttctaaatgtaaatactgctgtttcttgattttttcagtttgagaccccagctattgacccttagtgaggaagaaaggaactgagctctcttcacattttttgaaggctactcttgaccttttgttttcttaagtgtagacatttacataatcccaggaaacaaggtttcagagctctgatcctttgcattctgagaacattcgggacttggcaggttgaattttcttgtctttaatgagaaggttatccctgggatcaggttggtagaagtgcatgggtgtactttgtttgggtttttctcttattaaagaaaatgaagcttggttttcctaatggaacaggtctggaatccacatccagttgtgtgccagccattatgccatgtgct

SEQ ID NO: 77985 - DNA, 1041 bp, Homo sapiens
aaggtcctgcccaaggcccctccactggaagtgacagagctgggatgggatctgggtctgcgtggctctgaactcctcagctataccatctcctgcttccaacattgtgccagataatgatggctatggccctaatttctgaaacaaagtcttatttgagaacttcttagttagcgagatttctaccttagtcttttcactaggtatccagaaacttactaaaaaatttaaaaatcttgtagttttgaacccttttaacaaagaaaagcagtaagggcctagttattataagtacaaataggaaaaatgtataaactacagcttatcttctaaatggaaatacttaaaagacagattttcaatctctttagggggttgaggaaaaaataacattcagattttttgtttgtttgttttagcagaaaaagttcgatcatcgtcttttagcaattcagctttcacattttctctcatctttcttccccattgttggcaagactgtatcactgcacttttgaaaaaaacatatggataattcactgccatttctgaaattaagcatatggttatatgctatggtctaaaaaataaggaacattttttctccaggcagagagagtttgtgtttccttttggatttaaggattggcaatgaattccaagtgagcaagaagccggccactgaatgttctcagcaataagcgcagttgtccttgtggggagaaagagtttggcagtcctgggccttctcggtggtgtggggactgcagtggtatccgtgtcctccttttctgtctaggggttgtgatggtggtccctgcctgcagtctccagatgacccccagccgcttggctgaagcgagtgtcctggggcctctgtgctgccacattgctgctctgagtccctggcataggcacatggagaccaaggggacagccctctgcctgtgctccctgagcagggggacttgctagttggtcatatcacggttggtttctgatcaccaattgtagcttaaaaggtggggtttgtcatgctct

SEQ ID NO: 77986 - DNA, 1132 bp, Homo sapiens
atcttagttttaagatatttgttttgtgacctaagtactttctaaccctctcttctctttttgtgttgtaggaacccagctatttagtggtcgaagtgactttagaatcactaccttgaaattccatccaaaagaccacaacatctttttatgtggaggcttcagctctgaaatgaaagcttgggatataaggactggcaaggtaatagccatattcctaacttggcctttccacaggagagcttgtttcgacaatttgaataattgggggcaggtcagcatctatatataggacccttgaggtggaataattaccacttaatatttaatcagtgctaagcataatttttagatgttttgaaagaacattcttgagttgtcagacttaaaatatcaaaggtgcaattttatgcagcatattactaaaaatatttgttgaacacctactgtgcacaaatgcttccagatgatataaaatgaatctgctgggttactcaagggaataatgtgcgggtacagatgactttggtacagagaattggtgtgtgtgtgtgtgtgtgtgcgtgtgtgtgtgtgcgcacttgtttgcatgcttgcgagaggaagggagggggtaagtgcttttagcttgctgtgggaagacttcttagaggaatcacttttcctcagtcttaaaggctggttgtgatttccatccccatcctttattacaacctgctgtgccttttaccatcaccacttactagatggcagctccaccctagttgttcaggccaaaaacatcagaattagccctgtctctgctctttgcatcacattcccatacccaaaccattagcaaattctccaaaacttggacatttttccccacatcagctgttgtagctctgctattgtctctcgctgggatggttgcaggagtttcccatctgatctctcactttcccccttgccccttggaggctgttctcaacacagccgctagactggtctgttacagtgtgactcagacatgtcactcctctcatcagaatcctccaggctctgatcttacagtaaaagccaatgtctctgatgatccacaaggcctaaatgatcctccttggcctgggggtaggtcagcatttctcat

SEQ ID NO: 77987 - DNA, 1043 bp, Homo sapiens
tggaacccaggatgcctgtggtctgacctttatagtattgtgagggtcaatttctgcagaagcccctgagcctctagtgccgttggcctgagctgcaggagacctgggctcacgtcctccctctgctacttgcttggctgggtgatttcggccacattccttaagcaaaagcctctctgattcacaatttttaaattggtatcgtaaagtggcaggccaagccacgcctccaaagtagcgtttctcaaactcacctgtgtaggagagcacctgggctcttgttaggatgcagattctgtttcagcaggtccaggttgggataagatcctgcatttctaacaagctcccaggaaatgaaggggaggatagtatatggaccacattttgagaagctagggaccaaagggcctctgaagttaaaagtcccttgcttctctcatttgaaccttatcctcaattagcctgcaccatctgtgacctatctcagggacaacgatcactcttgatctgtgggcacttttatccacaggtgtttatttacagccgcttggtgtgggagcctgagtcacctctgtgcctggcatccccgacagggcctggaccagagcaggtgttcaggataacctggagtgagctgatggggtcagccgccactgtcattgtgatagaggcctgcaggagcacccacctgcccacaacctcaggggcagtggccaccctgggatcgacatagagggcatggcccctctgacaaatgggatatgaaggctagctggaattcagctgtagtgagtcattccagaagtgtggacagaggcaggaggacttgggagaccctgtgtcagatgagatatggtgtggccatcaaagcactgtagttctccactgaggctgagctcctctgctccccggtgtttggtggataacagagttatgagtctcttgcatttccagctttgcggtgctgtggctctgtgcccagcacagaatggaagctgtagaattgcaggagaagcctgtgacacggactcagctgtactggg

SEQ ID NO: 77988 - DNA, 1053 bp, Homo sapiens
gaagggagatgaggagtggatagctctctttcccctctgcatgccccttttccaccaaacagatttcttggtttttaattacagtctttgtcttgaattttttcttttttttcaaaaaggtcggttttctggctcacctcactcatttgctcattgaacactgcggagcacctgctgtttatagggtgtcttcctagtttagaggattcagagaagctgcaggaaatgtctcttgccctgctgctggcaccacctccacccagttggtggcccagccagaaacctctgcagcagctttagggtctcccttctccaccacctcagtccctgcgtcctcctcttccagggccaacatgtgaggttgtgcagtctgtacagtgcagagaggcaccttgctgagggataggtggggtctgtattccattccaagccctgctggccaggccacgcccctgatttggaatggtttctactcgaaggggtatctttctctaataggaaccaaggtgccatgcgggccagtggcagccctgtccctccccttctgtctcttacttggcctgagtggggctgtgagccgatgagagggcttgtcgtggggtccccctgtgacttgggtgcaagcagggtgtaggggtagaggcaaaaaagggccttggagacctggagacccaagtgctgcccatgacttcagaatggagggtgaggtggttgttctctagatgttcgttttgattagaaaaggaatacatggtctttgttggctacttgggaaatggaaaaatataaagaagataacccattaaacttcaacccagccataaccaccactgacagttggtatccttcattcaattgttttatgcatatgtatttacatttttatataattgtctttcagcttattataatatcattagaatttcccatattgttaaaaggtttttggatgctataatttttaataattactcaatatattataccaagatgtatttaaccagccctctattgttgggtgtttataagatttccagtggttcccttattaca

SEQ ID NO: 77989 - DNA, 1173 bp, Homo sapiens
caaggtgtcagggagttcaccgtttgcagttttaaaataagaaagctaaatttagaaaatgtggagcaggaatgaaaaaggagtatggtctcttccctccacccaccttcctggggctgagtgttcaccttcatcctctcctagaaaatctgggatgccagatccgaagccatcgtggagaaaaacggcttcacctccagatgctgtgcaggctgtgtgtgctggctgcagtgctgtgtgccgggcgtggccgtggcttttttctgagtgcagctgatgctcgcagcttctgacagggtgtccatgatccccactgtccagcagaggaaactgctgccctgagggcagggagccatgcccaaggccctctgaccccaagcctgagctctttttgcacctgggatcccttcccaaatggcctcccgtaggcgccacctccacctcactttggctgtctgtacagtgggagacccagctgcctagagggtccctggaaattgcattgatgaatgtcctcaggctccagcaagggaagctggccagggggcctgggtcttgcccaaggtgacactgtcaactggtggcagagcccaaccctgcgctgccctgccgagagctgaggagaaacatacatggatgtgtgggcgggtggcggatgtgcagacagggcctccctgacggcaaggcaggatctcagtgcagggagagggcaggggtggagcagggaaccctgtgccaaggccggctgcctgggtagatggggactgtccaggacttcccgttcagctgtggggacagtccaagtgcagaaggtcgaagggcagatccagagggaaactgccagctccagagctcagccccttgggagccccacaggagcactgaacagtttctagaactctccagctgtcacagatctgtgccttttcatggctgtgttccatttgcctaaaatacctgttgaactcctattcatccttcaacacccattgtgatcctctcctctgacccctttcattcgtcctcctggagcagtgagggccctcccctctgagaggcccacaggccctgtgttctggaagccctgagctgagtgttacactgtctgccttcctcccccacctctgagttccttgtgggcagggccaggtccccgaggccagcatgaggctg

SEQ ID NO: 77990 - DNA, 1002 bp, Homo sapiens
tccacccggccccggcccgtggaactccacttagagcgtttttcacgcgtccttcccccatgtgagaggagcatccccccttttataaagcgaaactatttttatagagaaaaagggtctttcttaacgcacttggcctccagctccctggacggctgccttggcgttttcaacacaaagctcctttattttttgggcgagggtgcgtggggcctgccccttggaagggaagggaaggacggtgtcctgtggagaccagactctgcaagtggggagaccacccccgcaagccagtgacaagggagccctgaagttgtgtccacgaagagggagctgaaacaaattcggggctatgaagtgttttaaaaatccattcttcgcagtgtggccaccacaccgccctgagccctcccacggcccatcgtcccgggtgggccgggatgatgccccagtgcggccggtgctcatctccgcccccgggtccgccccctgacaccgtcttactctacctcagacatgaggaggccctccattcctggtttctgtagcttgcattcttgttgtctctgatgcatgccctgccagttagtactgtattttgcattcattaataaaagacaccggtggaaagaatctgggttgggctgtttctcctcctcctgccttttggtctcgggaacctggggtccctggtgtccctccccagccttgctctctgcagccgagttgggccccttaaccccacttcacaccccatccccataacaccccgtccccaccccgccatccaagttcctatctagggtgtggattctcctgcttctcccaacccactggagacaacagctctttcatcccattctcctgcgcgctgccccaccgatttcctggcccctaatcctcgtgtctcagacttggcttctgctccttgagatgtactggggccacggatggaatgtcggcaggtggccttttcccgggcacacgggatgctgccgctct

SEQ ID NO: 77991 - DNA, 1011 bp, Homo sapiens
ctgccatgcaaggcctgtccctcccacgacccttatggccgcacagcctgctgagcagggtggggctgaatttggacctcctgagctcaccccaccagcttcaccctggtggaatgtgtgcccctctgcacacagcagagaacatcccattaaagcaaacttttgtagaagcctttcctaggccagggcccaggactgtatttccccctccaccccgggaccccctgaagatgggaagggaaggcttgttattcacaagagactctgtcccatccacacgcggagccagtttactcacatttgacccacaattcttacaaacctgttatggggttgacagttcaaatgcaaatgagcagggaagaaacttaacactaactatgtgatgggccccagggtgaggctggagacatcacagtgaacaagactcggttctgccgggtaggaggagtggagctgagtgtcaggtgggaatcaggtgcttggagattccattgctggtgggagggggcttggggatggtgtccagcctcagacaacctatgtgtcgtgttatggcccctgtcttgccaatagggaaactgaggtgaaactttaattacttaaagcagtaactggcagggcccagattttaactgaggtctgactgcactgcccaagcttggtttccacatgaatggagggtgacattcaaaacactcaggagctggggctgttcggagagggacaaaccctctccctatggcaagtcctccctaggggcaacaccagccgattctctacaaatacctaaaacaaatcaagccaacagcaaaggttgcatgcttcttgcattttctgtttaagaagatgagaaagtgcatattacatttcagaaaaacatccattttaaatgtgcacaagaaaactgcttttagaaaagtttggtgtttgagggagtccagcacaactggatcgacacttcattagcccgtacgcgctcaagggaagggtccctaaactggttcatct

SEQ ID NO: 77992 - DNA, 1058 bp, Homo sapiens
acctcagggcctttgcacttgctttccctctgccagaaacactctcactctctcccttcccctccttcccatcatctaattcccagctgaccttcagggtcccagtttcacagcctgtccccctctgtccctcagattagatcaagtacccctgcggcagccccttatagccctggcccccagctgtaactaatgtttgcaattatttattatctgtgtgtgtgtccccccgtagaatgtaacttccactgtatcccagctctttgcatagggcctggcacatagcaggtgctcaatgcgtagttcttgaatgactgactgaatgaatggcatagcaggttcaggctgtcagttcacaaacatccccagcctggtgtgggcctactgtgactggaaacaggatgagaatataggggagggatctcaggctctcgggaggccacagtgtcctcctcccaccctatggtccccgacagtcgcccctctacacccggacagcccttccccagcagcagccgttcagcccctgccctattaccagtgggaaagagacttggaggctggcagatccaagttcaaatcccttctccaacactccaacaggcctgcgggcaagccacatcccctcctcatctgtcaggtgggcatggggcagtactcagcccatggcagtgctgggaagtggcatgagcaagggacttcaggactcattagcactggggctctgatgtggccgtttcactagcacgcatggttgcaggagtgttctgggggctctggccaaccagtcctctgagctgcttccagagtttcaggctgcatcaggcaagtttccgttgtcataacaacctgctggctctcaggcgcctgggcctgaggctctaaggatgctgccggctaccgtgggctcacggcctggacctgctcacctaccagcagcctggacaacctctcctggaggggcttccggctcctggcaccgcagcccctgcctcttgactcatctgattcagtcctgcttcccaagcccatcctgcgtgccaagctccgtgctgtgc

SEQ ID NO: 77993 - DNA, 1022 bp, Homo sapiens
ggtgtgcagccctgccaggctggccttggtcttgccagcaggggcaactggccgttgggggtggctctgcctggcatctgtgacacgcagggcggggagacggcagagagggccccagcagcatcctgcaaacccttaattttcccgactctcactataatcagggcagcttggaaaagcaagcactgtggcagatgcggctctgcccgggctcagcacacgggctctgggcgatgggcggctgcgctgccgccaagggccctccccagcttttgtctcatatttatagattccaaggctccgcgttccgtttgtcgtcaaaacctggagctgttcgcacctgggagctgagtggggaggggagggctgcctagaacctcagcctggaggatgagttttccatgcgctggggtggagtagggggacacctgtcagagcccaggcctggagagaggaaatgagccctaagcaatctggaagatcttccatccactctcccaagacttgggcgcagggtctggcccacatagctgccatttatggaacgcctgctatgtactgggccctggatcagcatttccacgcatcatctccacggcaacactttgaaggagcttccctactcctgcaggcactcctgatgctgaagagtggatggatggatgaatggatggatggatggatggatggatggatggatggatggatgggagggagggagggatggatgggagggatggatggatgggagggagggagggagggatggatggatgggagggagggagggagggatggatgggagggagggaaggagggatggatgggagggatgggagggatggatggatgggatggatggatggatggatgggagggagggagggagggagggatggatggatggatggatggatggatggatggatgggagggattgactgaagcccatgagtccatggctattggacacagtccacaaatcattacccagggtcccaggaggtggggtccaagggctg

SEQ ID NO: 77994 - DNA, 1050 bp, Homo sapiens
tgtgtgtgtggggactgcgtatatgtttttgtcagtgtgtgtgaccacgagtcagctgggtatgtgtgcttgtgggtatcaggtgcatggctgtgcgtacatgtgtgcgtaagagtcggtgcatttgtgtttcagcgcggctaaggccctgactgagatgctgtgtgtgcgggggtgggtgtgactgaatgcgggcacgggtgtccgtctgtttatacgtgtgtttgcgtgtttgggtgtgcaggtggctctgcgtaagcgtctgtgtgcagggggtcggcacatgggggaggatgcccatggttgggtaaccgcaggtccgcttgaccctctgccacctaggactgtgtctatacggcgtctgggctacagtgtgtttgagttgccgtgtgcgtttccgttgcggggtgtgggttgccacggggcaactgcatttttctgcgtcttcatggccaggggtacagggggcgtcgggcttttcctgggggtttttctgtgtgcgtgtgtaattatgtgcttagttcacatcttcatagtgcgcctttgtgttttcctgggtatctaaccattgcacgtgtgcccgggacttcagcgataagtgtttcggtgttcctgcgtgcggatttgtgctctccggggaggtctgcggcccaggttcgattcctgcgacttgtcctaggcaggcctgtatgtgcgcggcggccgcgtgctgtacagtgtgagggaacgtgtaccaaacgctcgcgggatacctgtgcccgtctagccaagagtgcacccgtgtgcgcgagcgggcttctgggacgccgccgtggtcgggggcggccctgcgaggggagggggtcacagggactggccggcgccggccccgtgcgcacggaggcgggggcggggggcgggggccgcgaggggggaggcggtacgaaaagggcggcgcgcgcggcggcggcggcagctccccggcagcggcggtggagagcgcagcgcgcagcccggtgcagccctggctttcccctcgctgcgcgcccgcgccccctttcgcgtccgcaa

SEQ ID NO: 77995 - DNA, 1050 bp, Homo sapiens
cccctcccctaacaggagagggtggagatgcagtcttgtctggtggagacaggccttagggaatctcagctaggcacgctgttgcagggaggggcatgatgtccacagtgaacgtcacggacatgtcgctggatatggggtgacctggtgccaggcaaagggaacagctatcctggcctgaatatcagtggccacgactttctgatctgtgaccttaggcaaggaaaccccttcagcttcctgagcctcagcttactcacttcatgggtttttttgagggggctccctaaaccctcttactccagaccccactcggtggccatagagccattttaaagcccactggggcccgcatcacgctcgtgtatggagaggaagctaagttctcgtcttccccgtcaccccgcagatgttcgggcctgctcctcggccccctgtgccaacaacaggacctgcgtgagcctggacgatggcctctatgaatgctcctgtgcccccgggtactcgggaaaggactgccagaaaaaggacgggccctgtgtgatcaacgggtaaatatccttcctgtgtgtgatctaatgaatgctgcttttcatgcggccaccaaagaccctttcagcctaaccctgctggacctgtcgtctgacaaaagatgaagtaagcgctcatcctggcagccccgtaggggaccgccctggatgggagtattcacgggggaatgtgtcattgccataattttttcaaatgatcctgaaggcgatttcatattcccctgatgttctcaagtcccgatgcgtgtgagtgacagtcgatcggaatgatgaactgacactcggagctgcgtaattttctaaaggcaacgtagtaaaagattggagctccgcggggctgaggctgtttgtgaaacccacttgctgtatctcagggggtggttttggggaactggtgggctctgcaattggattttctgggatgtctgtggagggagttgccaggctgagaggtgaagagattgggcttctgccagcacgagaggaggtgggccagctg

SEQ ID NO: 77996 - DNA, 2422 bp, Homo sapiens
aaaatctattcctgaatgtccctcgtcctgtggagtggcagtgaggcctgaaaccccctggcttcaccccgcggggccaggtcaggacagcgcggccaacccagggctgaggcagggcaggctgggcctcatgcagcatgtacccaggcagggccccagccatggcgccagcagggtatcagttaatctccataagaggctggcgagggtgggttcttggccccattttacagatcaggggccagatttcccaagctgctcagctgacagatggcgacaaaccaaagggccgacctgaagccggtctgtgctccagccgtgggcctccacttcactgtccttgagatctcaaaacccctactcccaaaatttccaggctgggtagcctctagaggcatcctggcccccagcccctgacttctggcccattgccgtgtgcccactcagagagggagcatggaagacctttccgtctcccttcgggccttataagtaaaacccagctgcgcttccctcatgccatctgcaccggttaatgatagattgagaggatgctggcctggccatgggtgagggtctgtcctaaataggacatgtcaagtgcccagcaggatagctctgtgtcctggagtaagacaggtgtggatctaaaattggaggagcggaggtggcgttgactttttccaaccttggttcacccatcccgcgccttcggccgggaaggacctgacaggtggtcccagcccctgggcccatatgcctggattcctgtgctcacagcagaggccctaaaatagaccaggacattatacaccatgtccacagtgccctgcttctccgtgaggagtggcgcggtttccgcctggagtcacaggggctaatccctgctcttccccaagcctgtggcggatcaggggagcctgggtgccgggcgggcctggccctgtgtttctgttcagctgcctgttccctgtgggtttgagggcaagtcacctaagtcctctgagcctcatgtttcttgttcattcctgtttctctctgcctttccctctttagagcctggagacatgcctttctcccaattaagtgccttaattatttgccatcttcctcattccaaaaatcccacagacaggacttaattcttccatcgacacagaatacccggaattccgctatgagcaaattcacaatatcctctgaagcctgcaattttcttctgcctaaagccagctgacgcacacaggacagagccacggctgcctgcatttcctagcggagtacatgattcatcattttcagacttggggatcagggggccgggcagggcctttatctggtgggaggcagggcgcaacttctgctgattgcagactgcgcagtctgttgtggccgattcttacaggaatcctacaagagagctcgctgtccttgtttcacagctaaggagacagagacacagagctaagaaatagcacactcaagttcacacaaccagtaatgaccagatttattacaatttctcccagtgtctcaatctggaatcatgtttgtcccctctagggctatagaaactgcaaatgatggtttcttattctcagccctgaagctaccagttgctgagatgttgaacaggagcttcctggcactgtgtcccgtgtccggggctattttaggtgtcagaaattcatgcacatttagcacatggccaggaccactggagtatccctcctgccctgcctgtgctcctcagcccaccccaagaccctcttccatttcctgctaggcagcagatggaggaggatagggtcttcacctgacaactcctacccctgaagaaactctggcggcttgaagcccaggtcctgtggacactttctgaccttctgtccatgcctgtaacctctggaccaccctgaaaggtttctctaaagtggttgcctctgttagaccatagaagctggccaactagctgatcccctgtctggaaagcctgatggctgtaacctgccttcctgcaacaatttggacaaacatcatcaatctgcagtttcttaacaggatctcatttgtcctggttctcaggcaggggtggtaggagccgagggcagggccttggcctgcaggactgtgtgcgcatcagcagcgagcagccatgtgcagactgctttgacatgcgtcatcctgaatgcttttagccacccgtgggaagagaatgccaagggccagaggagacagcttgagcccacagtctttgaattcaggtctgtttttgtctgaaattcacagcatatctttttgggaggttcagaaatgttcacctttcaaatcctatgcccaggctacctccctagcagacagtcaagggtggcaccaacatgaagtgccacgtcccaacctatgttcaggacctggtttggtt

SEQ ID NO: 77997 - DNA, 7596 bp, Homo sapiens
attttctttcgctaagcccgcatcctccgatggatgttccgaaaccgccaggtgtgggatctgcgccccgacagccccaccttggccatcggccgcctgaggacggccagccatcggggcgattccccccacacattgtgcctgaattcaccctgcctggcgagccgggctcacgcagggaaaaagcacccgcgaccacagggtgttggtcatggcggccaggggcactgcggcagaattttttcctcccttctttgctgcaatctgggtgcggctagagcaatttgtcatagaatctggggggctcatttttccggccaatcacttttagagaaatgagcgcattgcagcagaatgcgctgacgtcagagaccaccccttctgcgcctccatataaaccccacccagccagcccctagcgcagacggcggagagcagagagggagcgcgccttggctcgctggccttggcggcggctcctcaggagagctggggcgcccacgagaggatccctcacccggtgagtggttggccatccttgccgcaaaggatgtgcaaaaggaagacggcatccgcttctgggatgggctctgtcctcctggacatgccgagagcctgcctgatcctgggtcctgctgctggaggcggccacttcgcctggtccccgagcgtccgcaacaaaatttgtcagaaagaaaatcttgaggcacatttccctggggggaagtcagggctcctctctggagggtccagtccttaagggtgggctgggtggtagggacttcagttcagaggagcgggaggaatcagatggaactcctcttggattcgggtatacggcagtcactggggggcgaaccccggatttcctgtattagaagccgcctctagaatcgcgttaatagtgggagatatggcggcgatgccttctgcgtgccccatgaattagggggggaagcacccgaatagaagggtctcccgggcatatttgcctcgccagctgttggccaggtttttggtggatcgtgggcgggaggagtggaggttcctcttcgcgaggttttccgaatccaaatacacaggtttagtgcagtgtggaccccaggcaaaatgtggagtaaaatttctacccgatatcatctggttctgccctgatcagccactttcacagtggagagagatggcgcccaagtgcaaacctgccagtagccccctaggatcagtccttgccgaaggggggtcgtgggattgggggcactgggagaatagatgcagggggtgggttggggaggagagaaggccgtgtccttgggtctgggaagagggaggagagaaatgcagaaaagggggtgtgttgctggggtctggacgctgggagctggggatggggtgccgcgggggtcttcagagcgttgcgtggtggtcgctcgaaaatcctgacatgttgcagtcttggacttttggtcaaatcgccttttgccatttcctttgtcagagtcaagcccccccaggccgccccctcccaccctgggccggcgggcctggtgggggcgcaggcgggtggctacgtggcaggtttctggaaggtttcctggctggccgcgagagggcgctggcggcactgcggaattttggggggcggggtggggaggggaggtggcctttgttctcctgatggagggggtcgggcgcgggatctactggaggatcctggattcgtttacccaagagggaacagttttgagaccccccggattcactgcggagtggccgcagaggccggggtcggcctttgcgccgtggcttcgggtgttgtggaggcgcacagaggcacgttagttgatttccagtggtttttggtttcgggggtcttaggaaggtgtggctcatttgagcaggatggagagagaggctgtgacaaggtcagtgaggggccatcgtgcgggggctagaaattgttgttgtggcgaaggagggaggcacgactttggaggcgtgatgttgatgcctgggggcgaaggcggggagcggcgtggtggccccctttgcgttactttccagcgatgtcacaggttctgtctctcgttccgagaccacccacatgcgtgacagcggtgcctggaggactgggtctttctgactttagtgaacgtgtgtttaattggattgacgaaggtgggagtcgggatttctgcttttccctgtagcaggcggagcggcgctccagaggggcctggcgcaggtccgctgggtggcccaccttcctctggggctggggcccggtggctgggggcgcaggaggcgcctggtgcgggcgggaggcgctgcgccgcagccacaggtgggctctggctggtggtggctggagaggcgtccagggggcgtagcgacctggcgcggtggcctggggtgggctgtggagcccttcctagcctgagacctgttgggcaccccctgtccatccaggcccgccgggcgcgggccggggcgccgcaggtggctgctgcactcctgggttacgggtgcgggccgcgcgccccctagcggtgtgtgccagccccgctaccttgggttttgagttgcgcacacgcacacagctaacacttgtgacctgtcagtcaaatcatccttaccccctcccactcctctcctccacctcccatttctcctctccctccaccctttctcatttcctcgtccctcctccccctcctatttttcttctccctcctccctctttcctcttccctcctccctcttcccccctcattttcctcatctctcttttcccctccccttctctcctcccctctccctgcccccctccttcctccctccatacccctccctcttccctcccagcccctccctactgccttcctcagtcctcccctttgccactcctccctgcctttccctctgcctgcccccttttgctctctgctgttccggtgctggccgttagaggtcacgaagatggtttctaacctgcccccctcccatgccatagggtctctcctcagggatgacatcatccgtccacctccttgtcttcaaggaccacctcctctccatgctgagctgctgccaaggggcctgctgcccatctacacctcacggtacttcaaccctcctgctatcatttcataaccaacgtggcgggcagaatctcccaaccccaccaccatccttgcaccacccccagacccactagcaattaaaagacaattttaaattttaactaatcagctttaattgtaattaatgaacttaaactgtaattatgatctaggcttgggcttttaagcaggttctctaacctttgatcaattgcagagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgcccgacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcaggtaggggctttgcagagaccatcgacgggctgacttgagtaagaacacgaattatgcatgtggccatttccagagcactttctatgtgatatgaacatgtgatttttatgtaatatgtgtatgtaaacgaggcagcctcatttccaggtgaggatgcatttggtagtgttgatttttgtaatttaaagaagctgaaagggagagaggacccgtgaggactgaactctctgtcccatggggtagggcttacatttacattaaagaaacagaaacttgctgggaggtgtaagtatttggtcacattgctggcaacagaaggggttggagttggacccagggtgccacgctagctgccctcaccccttcttcccctctggcccagagttatactaagagtccttttatttcaaaccaaatgtttgacaatgggacagtctgtttgaaatcccagctgcctggggtggtcttgggggtctgggtggccccagtgctggtaccatgtgctggcttcaccttttaataacagtgtgaccttaaacaagtcgcttaactactctaagtttcagtttctttcatggtctaaatggagattaaaacacacacacacacacacacacacacacacacacacacaccccctcgtgtatctaccccacagggcgcttttgaagaccaaatgctgtaactactatgaaagtgctttgtaaattgctgtggaaagtgtgagctactcaagcacccgaggctgtccctccttgctcacatgtccagcccaattctcccttagtgagaacagcactcagtaggtgctgtgtgtgtttgtgttcaattaagaaattccagaataaataaaaatgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccaagcttcttgaaaggcctgtctacacttgctgtcttccttcctcacctccaatttcctcttcaacccactgcttcctgactcgctctactccgtggaagcacgctcacaaaggtaaagacttttctgtggcttaatccttgtcatgttttcggctcatggacacaaggacacattttcatgccttctctcacagggctctgcgtctccggttcacttctgtgtctttacactcccttcacagagacacttgctcccccttctctcgttcttagcatcccctaggaacttgcacacccaggtctctcgacttctggacctgcttcttaccatgccgtcttaagcagtcaggagtcgctgcctgggttcgagtcctagttaaattacttagtgctgagaccttggggtaggtaaacttttccaagccaggtttatctcagtttcaaaatagggttaatcgtctttatctggcaggtcaggtgggatgtctcacaggtaagcaccagatgccatttgaaaggcttgaagcaaagtcaataaagcattcatgggaaaatacaactggaggcaccactagattttcgtatacattaggttcccacggggaggaccgaagagagaagaaagaagtggaaagggaggagcgtgcaggagagacaggagaagagaataactaaacaaagacattaaagacaaaaaaaaagtaggaaagggagacttagaaaatattaaaagccaccaaaaacacatccaaagacggtttccccttacgttagttgggctaaaagaaagcaaatgggaagaaggttttaaattgattatcccagtgacaaatcccaggaagctttcacatcaaatcaccctattctgggtttttaactccttccatcgagtttaacctctttacctcccacatcctggtaaaccctgccccctccctaccgccccctttgctggtgattaaatcctgaaggtacacgaagtatttcagtgaatgaatggctaacagaaaagggcctcccctcccccttaccctggcggtgtttttcagttttattccactttccgcccttttcccttaatgaacacagggctaatctcgggccttgtcgaaggaagaggctgcagacgttaatgaggttagctgctggattccagtattcgtcgcataaggatccttctttgtctgcgaaggaaaaacacactgattatcataatgaggtgaactggccaccgccgggccggggcgatgtggcttcttaagccacacttctaattttggtgatggagccgacatttctttggcttctcatttaagtctttgcctctgtcccagtgcgaagtccattcagcggggttgaaagttgcaggcagctttgggaaggggggcgtcggacagggttgcattgtagaaagtggctttgttcgatccttcgcacagatgcaaatggccagagcattcattccctttcttcaagagctgaggactgggggggccactggtgatcagttcccaactctagctctcctctgactcatctcaggacccattgaggacatccaaaactcactcaagatcaccaagtggtaggaaagtactaactcctgggcatagccctaggggagtgactacaatgtgaatactcatggaatgcctagccaggtgaagaagtgaatgcatgttggcatcccagagggaccccccttaagagggcatagtttggggttcagatttgactccagcatactgttgaaattgggcacagggggctagtgattagtcaggatcaatcagtggagaggagattaaaactcacatctgggagtccggaatcagaacttgtagttcttttttttgaaatggagtctcgct

SEQ ID NO: 77998 - DNA, 12880 bp, Homo sapiens
gttgctcccttgagtgtaggggcagccctttaacctggctccttgagtccctgctttttctgcttctgttgccttcttcctcgtcttcctctctctcaatatctccctctctttgtccctccccagttcctgacctggccatcccggggtgcccttgaccagccccgtgtctcctcagggtgtcccagcaccagcctggcacagagtggggctcagttagagtatgtgggatgttggtttcgccaggtgagtgaatgaaaggactcgaccaccacagctgagccactagctgggccatgcgaagagttctaggtgcaaaggctggagggtggaattcatttttgagaggtgtgtgagcagcttccgacccctgccccatttgaacgggggccttgctggtcgcgtccctgcattcacccgcgcggccatcccgtcatccaacagttgatcctaactgagcacgcccacggccctggtctggcctgggcaccggccaccgtagcccatcccttgatggcctctgtgtccccaggagggcgggccggggggttgcccaggggctggagcagtggactgtggctccatagaggtaggccggagggtgtgagggcagattcaagctatccccagggctctgctctggtcggagccagccccttctccctctctgccttccccgccccattcctgatgctgaactgttctggacccctggccctgagtctctcaggaccaaagtgggcacgggaacagctgtagtgtgtgcccccccgggctttggccacaggtctccctctcgaggtgtggttgtgactgcgacccttcccttgccgtgatgccttcctcccccggggcttggtccagctccttcactctctagcagctgctggggcccacctcccatgccgaggaccagcaggggaaacctccagggagcatctgcaggctctgcttctgcccggctgctggcttgctctccctggtggctctccagcggccagcttcctcacccacccggcactccgctttgctctgtctcctgaggtgggcctgaccaacctccccttctctgcctcagtccctgggctccagggctcagctccacagccctctgcctagcaggctggttctccctgccaagcccatacctgtggtcacctggccctcctgtggtctgagtaccactcccctgccccaggagccactcccactccagctgcctgtttccagcaggttcccagtgcccccgacaagcccctgctggtgtctccatctcctgccaagcatcctccagtgcctcctcctgtgggcctggcctcagggctatggacagactcctgtcccatcccagagacccctcgtgatcgtgccctggtgggtgttgcccccgcctgcctttgcctccgccgtggccctgagagtcctgggctctgccccgcccggtcccttgctccccactcagttctggatttggggctgcccctaacccagcccgttgctgctttgcaccttttcctgtcattgggcatcccccagtagtcaccccactccaccgaaaagtaaactgcaggtgaggccgtgccccgagtctttcttcggtgtgtttggcttttccggggcgcttgccttgccatgattctaactctctgcccttccccaaggcacgtgggccgtggcccggctgggtcggctgaagaactgcggatggaagctgcggaagaggccctgatggggcccaccatcccggacccaagtcttcttcctggcgggcctctcgtctccttcctggtttggggtgagtttcttgctttcttgagacccaggattttattagggtcagctcatgtctctcctctctgatcaacaagagtgtcaacatttaatttggggaggaggcaccctgccaaggtgaattctcttcacatcagccccaggggtctgggggccggagagctgcctggagtggagacccttgctatacccagcaagcatgtgtgggggtccaccctggctgatggcatgctgtgggccggcgacggtaggtggggagtgtccacctccactctagacccccgagagcggctcgggccaggcactcaggagccctcagtacggctttgctgaacacattgcaaaagggatccagggggcacttgccctgcccacacccggcccagggaccccttcggagaggaggaaatgggaatgcttgcctgctcctcagctaggaagacatttctttccaccagccatggtagcgtcaccccctgtgagaaccgtggtttctcacacatgaggctttgataatgtcctttaatcaaatagtggtttttgagcaagttcttctctttcctcctttcctcacccctgaaattgcaatgagacgggaatgtttttgtttgtttaaataaaacagcaatggtagagaagaagaaagcgggattggagccacacaattcactcgaggacccatcatttgtttatttgtgttttactaattcaagatgcagccgggagccgtccagggctcgggcctggggttgttctggggcgcctaaggctgggctttgcactaaggaccagagggtctacttgggtgccgtggagcacccatgcagcaaggtggcttgcacagcagccaggcgaggtgtcgtcgagggcgggggctcagggtggcatgctggacggccatgccaggctgaagtttgggctggcaggaagagaggaggctcagctgaggccactttcctttctgggggtcccagggactgagtctgtggctcactcagggcgatggggtgtttttagagccactgccctgggaggcagtgtcaggatcctggcacccctcatatatgacgcccctggggtggccattgtggtgaatgagtgcagttagacttcccagagaagctgggtgggcgctgagaaaggtctgaaccgtggggtgaggctggctccattcccccagacatttatggaggcttgagggggccctagcactgtccttggcccagatgccaatactcccctctggacgcccacgaatggggtctctgagaaggaagtggatgaacacagctgcacgctgggtggggcccagcctctagtcctcagccatgtgcacgcatcagcccttgtgcaggcctccgccctccgccaccccccacccccggagtgtctctggtttccgacgcagcctcgtaatgctctttaatcaaacagaggatttggagacagctctcctgcagccctgcacttctcccctgaaattgaaatgggatggggatattatttttaaacaaaatctggcagcgtaggcagagggggcagaggcgctctaacctggggctgttgcctttgtctgcttgtttctgctctctggagagccccagagcctggagagacggggaggggagtgtgtgcccagggctaaacccagggagggggcccaggaaggctctgccccgtgacatttactccaaggctagcatttgctgagccacctgcaaacacagtgatgtggagaagaggcccgggaggggaggtttgcacaggggcaggctgctggggtcctggggggatcctgtcccaagcttactagaatgcattcgagtaactggtctgagccagatgccctcagctcttggactggtttctcacggacatctcaggactttcccaaggtggactaagcccagggacaaagtcaaagtgaaggccaggggcacacaggagaggcccagataggaccaagctttggcagcccctggctctcaggggttgaaatggaaccctctttgcactgagttgtatttcaggtactcatgagtgtttcggtctcaggcaaacacatatttggggttttgtgtgtcattaggtataaaataggtaaaatatgccacgttctcaatgaaagaagttgaaacgtgacttactacgtcagccttgctggtgatcttctcgggaactgccgaaaggccactagtaagtgctgaaagacatgatcattttcaggaaaattctattttgatggattggccaatgcctgagccatagcgggtggagatgagaccctgactgactaggcagtgagccacagaggaccctgtcacatcagcggagggcggtgaggggtctctggccatttgtcatcgtgctgattcctagggggctgcctctagtgggactcttctgggtgggtgcaagtgtcagggtaaagacggcggtctggtctggaaactggctctcctctcgcacctgcccgccctgggtggttgggaaaggaaaccaagagggtagctcaggcctgagctcgtggaaaggaagaacatgacccctcattcgctcactcgcccccacattctctcacctgcgagttgctcattgctgctttcagggcccctgacctcatgcctcctgagttgtgattcaaaccccaaatgaatttccaagtacatttctccaaataatgtcaaaacctggcaagacttaagggcaacaggatgcatgtgtttcttattcattcatttacataaaataacttaagtgtgttttttatgagcaatctgacttccaaaaagaatgaaaaggaaaatctacccatctttaatgaacttgctaatgaatttttccttgcaaagaggaagggagcttcctacagaagggggtgtggagggagacagattcaggtcccaaagggttaaagggcagtggacaatgcggaagccagcattgtgagctgcagtggaaaagccctgggtcgctgggagtggcttctttttaggagactggaattaatgagttgtgaagtgtcccaaggactggttccccctccctgctgtttctctgagccctgtcccctcttccaaaggaggaataaggaggtctagcttcgtctcccatccccgatttgagcagatggaagagtctagaaaagaggtgtaccttttgaaacgaggcctcagatgtggggttcctggtctggaaaggggaaggatgaatctggggtaggagagggtctcgtatggagccccattcagacagggcagtcccacacctgggctgcccacaggttcttgggggagtctaaggaaaggggagccacagaacaggcttgcctccttggcatggattgggtcagtgtttcagagccaggaaaggtgggagtgtggggggccctcggggctgatgagggcgtgcagaccctcccctcccacctcctgtcccaggagccctgcagacactgcagcaggagggcactctgccagaagaggggttccagctccagccggatccagcagacatggagagaccccttatctttgccaagacgagctctgcggtgcctgagaggcccgtaggtctggaattctagggccttctgggtttgagtcaggtcctgaggccagggcctgggccctgatcctcaccatggaaaactggtcactttactcaggataaactgtgatgaggacttgggacatatctctgtctgtcctctcagctcgcgtcacccctgagcccttggcgatcgtgggcggcccgtgtacagagcaggtgctgggtcactggggccgccgtgggcctcccaacatgagggactgtgtgtgagagaggagttcattaagggagaggatggtggtgaagggtgtagccatgactttcttaactgctctccaatttctttgagcttaaaaataaatccagatggagagttcttaagtcccctatcctgggagaaaggaaggctgcccaccaccttcggcttgcctcgactctgagcagtgaatagggtctttggcaggggcttaaggaggagactcttagcctgggagctcccagggctgtttcagatggaaacaaaggctcaggccgagaggaatgtgggggagccccccgtggggaacagccacctggggataattgggagggctgagcgcagatgagttttcccaggttctgtgaatgcgccctttcaatggaaggtgcctttttttccagatgaaaagaagaaaacgtcaattaccttcccctgaaacggagtgtgtgtgtgttccctcccaggggttgtgtggggccccttgcccttgtgtgtgtgtcgggagctccaaggctgcacaatgacgcacttaaccagccactgggttcgcgcgaccctgggatgctcacgctcttagattctagggcttgattttgaaagtttcttagcaaaggggaatcagagtgattgagcctgtaaacaaaaatttgatcaacctgggcctgatgcctgaaatatagccaaagagacagaatggggctgcggggagagaggtccaggatggaaagttggggaaggaggacagtcgggggccaaaggctgaccgcatgtctgcgccggcctccgcgctcacagctgggctgctccttctgccaccccagccctttctctgggccttcctggcagtggacatagagtgattccctactcaggaagttggcggtagggggctcagaaatccacagggctgttgtttcacagttagccaggagaggagggggtcatggtggcccgcagggatggtgggcagctgcgagagaggggacgcttcaggttagagcgaagctgtttgcaccaccactgccccagactgccgtaagggtagggccactccagaggcaccagggacaaagtccctgccgtgacaggaggggggcacaggtctcagtcttggctggtcactgactttgctgctgctggcttctgagcctcagagaggtcagcagtcttccagagacctggttagagcctgtgctcagccctgactatgggtgtgaccttggcccctgtctccagccccttaggcctcagttttcccgtctacgaaatgggcgagtgcaggcccatggtcgtccgagtggctcggggtttcttcaggcctccctggaggtcatctgtcgtttgtttgctgggtctttggagttgttgggactttgggggtcactggtccgctgccccctctgctttagaggtggggaaaccagcgatcccagaggcccggagccttgcccgaggttgcacggtgagccggcagcaggccctggaggtgaagcccctgccagttgccagctcctgtgtgacctgtgtggtcggggggggtcacagtcaccggtcattagtgtgggtcagagctcttgcccaaagaaggttccaaggggctgccccatgagctgggatgcagggatcgtgttttatggggcattattccaaacaggcaggctgctggtctggtctggaacacctttttggtctgtagagtgactcttgtttaatgagactggacttgtggcttcagaaccaggagatgttcgttcccccaacccccgtggctcaccttgtgccttttgggtcctgagaccctcgccagcgcctctgttggcacggtggcccagtcggctgagaacttcctgaaaaagccaacaggatgacaacttctggaaaagtgatcatcacccgcctgcactggctgcccatcttagactcagctttgccaacattcccagctatctctgtgtgctgcagtgtgtagtaatgaacagctcacaaaacctccggctgggcctgcacctggttattaccgtggtgggctgcagcttttgttttgtgaccttggttgctacaatacctgcgagctgaaatgaggaatcgaaaaattgccagcttcaattagacgggcagactgctttcccaaggctgcctccgccactccatccattaacggtaaacaggcaccaaataggccctaattctctctaattgcccactcctgaagcaaagaggtgaaattccaggaagaggcgtatgtaaacatcctctgtaacctgaccaagtaaaattagagggctgatgggggcctgcgagagagaggggacatgatttcaaaagatgtcccaattacctctcctattttcataaatgggtctgtaatgtccagggccccggcctcacaaaggtacaggaaattagctctgcaaagagcttgcatttgtcaggggaagttgtaagggggtggtgtttactcaacaggtaggaagtacgagatctgaggcaagactgattatttgtgtaacgacgggctctatttcttgagatcaacattttaataaaagtcatccttttaggtccttttgtgtttgaaacagccataagttgtttataccaaagacatgccagatcagttaggtgctgtttgcctccagaaaagaggaacttttaaaatcctaagatgcagagctagagttttctaatcccattaagctgtggaagatgtttttggagtgttcaccaatgctttctgcgtgggtcatgagctcactgcacgcacttatgaggtcttccatcaaatgcttgtgacaattactcctctggactctataaggaggcctcgtgtttttctttggttccagacagtgactcatctctgcagcttttctgacatttgttaagattctagcccagcactgcgttattaacacatcacagcaagcccagagctggcacacgcagcttttaaaccaaggcacgaatttgctggggcttctctgtagcagagcagcctgcggtctgcacacaagagttaattaaggacggtcagggactctgaggtttcatggggtccctggagcagaagcaggaaaaaacccagatgctccttcctgcttctgatttctccgctcctattaaaaacacaaaaaagaacaaaacaaaaacagccaaacaaagcacccgcctctgattcctgcgggaaatggcagtgcctttggtcgcgctgtgtgttcttggcctgagtctcgttgccaccttaggacgtggcgatggtgagaggccaccccagccacgcacagtctcggagggagggtgggaaacggtctcgagtggtggtcagtagataatgggtggtctggcagcctttaggtaaccgaagtcggcccctcagtcacccatgcactgatcattgcttcactaacacttattttaagacttgttgtttcttggttatcaaattaaccagttatggcagaacagggtttatgaagggcaaggccagggaaggagattttaggaagatttggaggcaagaagtgtccccagtgccctggccgggtcttggacatcctggctggagacatgactaggaatagagaggcagaggcagcaggggtggcccagatggcaggggtgggttggagagatccctgagaggcctgaggacaggcggcagtcttgggagcccctgaagacctgcagtggggcaggcagctggagtcaggtgtctcccgggacctgttttttttttttttttttttttttgagacagagtcttgttctgttgtccaggctggagggtagtggcgcaatcttggctcactgtaatctctgcctcccacgttcaagcgattctcctgtctcagcctcccgagtagctgagaccataggcacataccaccacgctgagctagtttttagtagagacggggtttcatcatgttggtcaggctggtctcgaactcctgacctcaggcgatccacctgcctcagcctcccaaagcgctgggatgacaggcatgagccacccccctggggctggtacctgtggtctgtggcttctgcctgccctggtgcccccacatctctctcatggcctttctgtttcctgggtggctttgtgggggtgtcccatggtctccccctggcttcctgtctccacctgtgcctaatccaggaaacggtccccagagatggtgttttcaaacagaccttggccctgtcctcctggcccagcccctggctgccctatcacctagcttgctgcgttggtgggacctcagctgtcacaggctacctttctatgacgcctcctcaccttaagtagactctgaacagattttaaaagccattcattcaacacattttttaaatgaataaactttttttctgtgtagttttcagtttacagaaacattggtgggaaagtacagagaattcccagatcccgtccccaccatctcccctgtcattcacacgttgcctccgtgtggtgtggtctgtttgttccgatcgatggaacgactctgatacatgattaactagaggccttggttcacatcattagggctcactctttgtggcgcacatcctgtgggtcttgacaaatgtgtcatgatacgtgtctgacattgctgaagtcaccttttcttaaagcttaacattttgggagtattctgaactatgtttggcccagcctgctgcccgatttttataaaaaagaaaaaacaaaacaaaacaaaaaaacaagttaaaacgtaaggcagatcttgacactgaagactcgatgtgcctggccatggtgcttcccggggcctactgcactgtgaacaaaattgccacagtggagttgtctgtccaggcacacaacgtgtgtgccatggttttgggaaacgctgcccattaatagccctgcagccctctgtgggctgccctcccggccacaccccgcttccctggtctcctccagggccagccatcctgctcgccgacctgggcaccttgcttctgccagagcacaggttcatgccctgtcttcagggcctgggccacccccgtttctcatctatgcagggtcctaagcctttgggtcccacagagcacgacttcgctccgtgaacagcaccaacccaagtctgttccatgtctccacacctgccccttccgctccataggcagctggtgggtgagtggagtcaggagagaaatgcgtggcttctccaattccacacttgctggaggttggggagtctctgctccaggccacccctgcccgccccccagagctgttgtcctcatccgccctcctcctcctcgccggcctgagtgaggttctactctgtgacctagtgccttcttgttacagcggaagccatcacctggatgcctacgtgggaagggacctcgaatgtgggaccccagcccctctccagctcgaaatcgtaagtggctggagtgtaaagaacacacatgtggccttgctgctgagggtggggccagctgcccggagcacaccgccaggcggacctcgtggaggggctggcgggcactggccgggggtctgtgcaccgggaggtgggtgcccatcgagtcaagccaagtgcagacctgggggctcctgttttctaagacaggagccccctgcctccttgtgttgtctctgtggcaaaagaattctataggcgggcttcaaatgtcggaccccaaaagaatttcttctttttcactcttctaaatgaatggctctttcattattgagtctccctttggctcttgtgccgcagggcagactaggatggaagtgccctgtgagctggggggcccttcaaagggccaaggagaaaacgcaggccgagggaccagccttccaaatgggcttcaagctccaatgacctccgctcgccccctcgaaatgtctggaaaacataatgggcagattttctgtcttcaaagtttccggctaaacctcttcaagttctttattgtttgggactgagacactcagccatgttaatgggtagtttcttttgtatttgccttgaaaggccaaaatatttttatattgccacagacaaagccacctatttaaaaatgaactccatgtccgtcgtttcccaccaggagactatgtaccatgtgtgtgtctctatgtattctggggtcttgaaacaggtttctcatggggatggtcattcaccacggtccagaggggcagaacaggcggcgcttgccttgcccagggggcctggggaacgtgggccctcatctcagatctgcccccagtatgtttaggacgcgagccccagaaggatctgggagtaaacttaacattcactgtgtctctgctctgcatccgccatttgtgtgtgtttctggactgtgggctgtgtgtaccttggttggtgactcagtgagaagaagcaggaatgccaaagatactgtgaatgttctgagttttgttgctgttgttgttgagaggttgtttcactggtatctattgcattgtataataaatgaccagatgaatgaatgagtgaagcaagagagaatgaataaacaagtaaataggtaaagaagtaagcaagccaggatgagagtgtgtgtacacaagaccatggttcatccgctttgatggctaggcaatcaatatataaatagaaaaaaaccagtgaatcactaagtaatagggcaacacacaaagcgatatcaggtgattatggactaaggggtatgtgtaactcaaatatatgcctctgacatttgacaatgaaaaagaacctaaatgaaagaaagaatggatgtatgagtagtgaagtgcagaatgagacatagattttgaggcccgtcaaaatgaaaagatgcaagttagggaacaagtgatcaaaagggagaagggaaaggttttttttaaaaaaccaaaacaacaaagaaaggttaaaaaaaaaaacagactagaggatgagtaatgagtaactctgtaaggaggaccatgtcagactattgtaagctaagcattaggactgatacaaataatatatgctcctggcatagaaaaataaaccacagagaacgagttcaaagaatagcaaagaaagaaagaggacccagtgggcgaaagatgagagtgtacttttaccaaaagttatctaagcctgagcacttgaagtctgcacataaataaataaatgacaaaagaaagaaaaaaaggccaaaaagtctacattgcgtgtgtggatggatgaatgagcagtgggagtgcagcgccaggtgacaagatgttgtgaggggttttga

SEQ ID NO: 77999 - DNA, 9705 bp, Homo sapiens
gtcagtgagtacctaaatagacaaggatgaggtgaatgagaagacatggccccatgggtcctcctgatgagggtgttggggtcccccctgggcaccccagctgcatgaaaatgaaggacaggaggtatggaaagctatgacagaagagagaaaggaacggtaaaaagaaataacaaccaaatggataaatgggtagatccacgagaagagttaggctaggacttgtcataagggcacctgactccactaatagaggaataaatgcctaataaaaagagagcaagcaggaaggaaggatgctatgaatgcaggaaggaagtaatgagtgagacgtggaaccgcacggccaaggatggacgtttgcgggtggctttttgatgcgtacagccaagccactccatggcaatgagctccgaagacaaagtgcaagagagaatgagtgagagagtgagagagagagaaacaataaaaaatgggaagaaatgtaaaaaggaagaaaggaagagaggtaatatattaaggaataaatacatgcatgcagatttaagacagagccatgctagaacaggaatgaaaggctgtgtgaaccaagcagaccgcttaattggcaccagtgctgctggtatggtcaatcacctactcaactaaggaacggctcaaagcatacacatgggagggaggagtggggccacagagagagggcccattagttgcagattacgatgtatccagttaggtgcacctgccttcgagaagtgtaaaaataagtatttacatagaaagaaagactgaatggatgcacggtgaatgcatgaatgattgaacgacagaaaagatttgcattgaccgatgaggagggcattgtagacagggatgagggtcattgatcctgggtgcagatctccaaaagaatgacagaaagaaagagggagtggtggaaagaaacaataggatgggaaaaaatgaaaatagaaaaaaggaagtgaaagagataataaataattagatcaaataagttgatgaaaggggactggtttagcacaagccatccacattaattcaaacctgtggctctgaagtttgttttttaaatgaccacaagtgtaagactgaatgaaagaataaatgcgtgcattccataggatgcaagaaaaggagtgaggaatgggaaaattggaagaacgagagagggagagatgtaagaaaagaaaggaaaagtgaagtaggcatatgaaagaaaaggcacttcttggacaagcactgaaatataatgagacagttttacccattaaatataataaacagtaaacgttgaggttcatcaataaaagcacagatacctgaatagaggagtgacctgaatagaattcgttcagccgaacgaatgagaatggatgattttcactatcctgtgcactcaaggcccaaaagagaaagcaagagaggagagaatatggaaacgtatgacaggatgtatataagcaatacaaacatattgaatgaataaataaagacataaatatgtgggagagtggaccacgcaaggacaaaaagaggagagaaggcagcaagaattatgactaattcaaaactgggttcctgagatagttaaataaatcctgcaccaaatccccagggggagaaattaacaaacaaaagacagccccacacggaccagtgtgcagaaggctccaggaaccgcagattatggttaatccaattctgtgcacctgaggtccataaataaaagaataagtattgaaatgaaagaatgacagaaagaatgaatggacacatgaacgactgaattagaaatggaaatgcctggcacagccaggaaggagctgcccatgggattgtcattcatctcactctgggcacctgaggtccataagcgtgaaaagaggcaggaagagaagtgtcagggagtcaaagatagagctaaggaaaggcaaaaatgaaactaaatgaaagcgaaagggaaaataaagaaaaaccaataaaaaagagaacgaatacgtgggtgtatctgtaagagtaggatctgttaggattagtcataagactgtcagtaatcctgaagatggatgagataatccaggcccaggttcccagggggagggaaaatggagaaaatataaaaagatgtgaaaaaggaaaaaggaaaggtaataaacaaacaaccaaagtgataaatggatagttaagggaggttgtctgaacagggattataattagtttacatacatactccttaaacagataaatacattacacctttcaaagaataaatgaaaaatagagagacatacctggctccaaaacaaggctgtatcttctgccactgtaataaaatagatgcaattgaggttcataaataaaagaataaatacttaaacgtgaaaggtgactaaatgcggggaagaaagattgcaaataaatacatgggccaaagatgtttggtttgcccatggagttttaattaaaaaaattaataaggaaaacaaatacccaaaataaggaagactgacaaatgagtgagtggatgagagagtgaatggtgcttgacgtaggagcagtagtgctttagggaccagcatgaaggtggtgaccgggagccctgattcatgggattctgtccacctgactttataagaaccaagaatggctgggaatggtggctcacgcctgtaatcccagcactttgggaggccgaggtgggcggatcatgaggtcaggagtttgagaccagccagtttgagatcagcctggccaacatggtgaaattccatctctactaaaaaaatacaaaaattatgggcgtggtggcacctgtctgtaatcctagctactcgggaggctgagagaggagaattgcttgaacccgggaggtggaggttgtagtgagccaagattgcaccactgcactccagcctgggctacagagcaagacactatcttagatcaaaaaagaaaaaaaaaaaaagaaggagaaagaaccagagaaacataaggaagagtgagaggaagaaagaaagatgcaatttgggaagaaatgaaaaagaaatgaataaagaataaaataatgtaacggtcaataaataggacttgtgaatggaggcctttaggccaaaggctatgattaatttcaagctatgttactgaagtccataaacaaaggactcagatctaaatggatgaacgaatgactggaagaaagggtggtaggaaggtaggaagaaaggaaggagggaaaaagggaagagaggaaggaaccttctttccagtcctgtgttctagacagtggaatgaagtggtccccagggagggtggctgtaggcatgtcatgtgcttgtcacatgcacttgccctggcagggaggagctggctcaggaagaccctggtcttggggtgctgttgccctatcttggctgtgtgggccatttcactgcatctgtctcttcctcagtttccccatctgtaaacctggagtggcaccagctgcctactagagttgatcttatgtgtctctgttgatggtaccccatctatggcctggataggcaggaagggcttggaccctgagccccgcagaaggttgcatgaacgagtggtgtgaagcctgttgggtagcttggccactcccgcggcatgggtcacctgcacaggaggttttgcccaccagggggcagcagagggtcagggagcaataggccctgggtggagcatgggccccgcctgctgtgtgccaccctgggtgtggcacctactcacatccaggggttggtgcagggaaaggccagaaggtggccaggcgcacctgagaagggggacccagaagccccgggacccaggagccctgggcaagccaccagaaaccttgttcttgcaactctctgcagtgtgcccaggccaccctctggcctggtcttccatggggcagggcgcccacccttctcaactcaggtttccctgggcagcaggtgcacctcagcacccctggggttgcagaagtggtccggggaccctggcttccttgacatgccatccccagagcctggttcaaggcctctctgtcttctcggctgtttcacgacgtgttttgtaacttggcgggattgcgtttcgctgtgtcgaggttgtctcttctctgactcgccctccgggggactgccggggtaaatctggagagttgctcgtgctgacagtcctcccccagggcctccccggttctgttgagtctcctttctctgtagtggaggaaatgtgtgtagttttgtgttgtgtgcctgtgtttgtctgtaaaagcaaggaccaaagtctcccttgttgacctctcaattcctatttgggacatataaaaacactggattcttaacaagcgcccggagcagtaggagcacagcttggatggactcaggacttgtggcagggagcacgtgggaggcaggggagtggggtggggccaggccatctggagtgggaggcgtcatgctcagagtgactctgtagacgctgggtgggatggggagtgcgggcgcaggcatggatggggctgttagctagtgtgatgcttgaggtctgagctgatggcagcaaagtggggtgctcaggaatcaaagctatggggttatagacaggatatgaaggagggagggaggcaagaagaagggggtggttcccacgcttctagctccggccgagtggatggcaacagcatttggaaggcggaggacatggaattcatgtgtcaggagccaccttccgagcctccagtaccacgtgtcagggccacatgagctgggcctcgtgggcctgatgtggtgctggggcctcaggggtctgctcttcttctctttcagaatctggggctccaggctatgccttggctggactgaggtctgggggtgcacttattatccctggggacacctgctgaagcttctccctgacaagctgtgtcactgttggatgaggatggggcgggaggggttcagggcagaagaagaccgggagggtctttcaaaagaactcatgtacggctgttaaaaaaagtcagcagaggctcaggaagacttaaagtgtgcagaaggcggggaagggagggcccattgcatgcaccaagaggaaattggaaggaacaagcgacgttggctgctaggagagcctgctcccaacatctaggggctgtcctgacgggtcacagtgggtcgaactgagccaatgagagcagctctggggagacccactggtgccctggaggctgggtgggtttgggttggatgaattctgtgtgtccttttggaaatgtggaggccatgaggggggatcagggctcttagggttttgacccttaagagttttgtatctgtaattcaaaggttctttagttctgggatgctgagattcgggatagggttcctaatggcacaaaagccagagataaaacatccttcacgtgctccctacccggttctttctgtaccagacccacaaggtccgagttgggatcctagtgctcctgtctggtcagggcctatctttatgtgttcgttaaacttttaacaatgagaattaattctgtctcttgacattgtcatttgcatgctccccacacacaaatcctttcctggtgacaccaggagctacaactctccttggcctcctcttgtgactcccaactccctccttgggaagcttggcctcaggacctctgggatagacaggccacgaatcctgctgtgtcccgttgtgttcctaatataaatggtgtggatggcacttgacctagagcagtgggaaatgcatgcaccactcaacattctgacatgtcacccattttacattcttacaggcatactttttttaaaaaaagagtgtctattctttaatgagcatcccttctttaaaaaaacctaattgccattattcaccacatacacttttttttttttgtatcctgcctcttctatttaattttctgtcatcaacattttcccttgttccatgaatcttcataacctcacttgctgcgttgtgccttgttgagtggctatggcatcattcacagaaccattctgttattcttatgtataaccaccttttaaaaatattatgaataatgccacaactaactgcttaaaacaccctttttttcattcttaagaattatgttcttccacccagaaattatcattgcttcactacagatcagtttcccctgctagactgtgagccccataagggcaaggagcttattgaattggcctttgtatctctgatgcccaacatgttgtagactataaataaatgatgaatgagtggatggaagaatggaggaaggagcgagtgagtgagtgtttggctgatggataagagggtggaaggataggcggaaggatggattggtgaatgaatgaatgaatttcctttggttaagtctcttgaaagaaaggctatggatctttgtatggatgttgaataatttcagtaagcttacagcattttacaatgttcagcaatgtatgaccacttaattaagatatggctagtttgtctctgttataaagtacttttgcattactttaacttgcattgctttaattactaatgatgggtgaacactttgacctatgtttgttaacaaattgtattttatcttctgtgaactgtttgtccaagtcctttgggtcatggctttctgaagagactggtcccagatgtccttgggatgtagggagcccatagctcactggaggcattcaaggaaccagccaggcagccctcagagaaagtagtgtttaggagattctcatggtgtggggttggcctaggtggcctttcaggtctgtttgatgttaggatttgcttctccctgggaagtgggtgatggggaaaaagacaccttccattggcaggtgtagacactgcaggctggacctcctgggtgtgcttgtggactccgatcttgcccttgataaaacccctgtgggacaggaatagctctttgaacctccaaggtccagacagccacatcctagcaccctgtacaatcagttagtggccttcccaccagcgcagtcactcattcctattagatcccgatgaagccaggccctggggtttccattttcccacctcttaggggaattgggttccccgcgtcctgtgatatgtcagcaaatgtcctcagccctggcctgcacatgtggcctcagtggtggtctttggggtttaactgacgaatggaacattttggatcaggactgatgggagaatctcctttcatttttcttcacctggggcaattacattctaaggagcggaataaagggcatgttctgcccaaagcatcagggctcacaggtcagtcacagccatttagggagggcatgtcacccaaggagggctcgcccttctttccagagcatcctccgctctcagcagagctgcttctgcccacccatccctctactatagcactgagcactgtttgcccgtgtcagaatccctcacccacatgtttagcttggtatccgagtttgggaggccggcaatgactttcaacatgaattgctccatctacccatccatgcatttggcctacttatcttgaccccgtgcttttggccttttcttctcctgaaagcaaaccctttcattttgggtgggctgtgtagcgccatgggctgtggttatgaagcaaacaccctttcttgtagctgcctcctccggggttactgccctgagcacgtcccagctggatctcgtctgccactgtcacccatagcttcttccccatggtgctttccatgtgtcacacaccacgactgtgacccagggtcggggtcaagagtagcctggggccaagccctcccacccatgagcggagaagtcctccccaggcctcaccttgcctggcgcatggtccctcccatgagctttgctttcagcctttcagcttcctccacagggtggcagtggttgtaactcatccattcatcccttcatcccttcattcattcactcacagccaacagacgtttttaaaaaattagccagtgctatactagagctggctcccaaggacccgctgccgcattgccttttgaaacaaaacaatgaacacgttggtaaaggggccgtgcttgtgtgtcggtgacaaggcgagatccctgagtcaggtcaggcttgtagattcgagttctgttgcgagtttgattgcccctctgactttgtcccctgtacaactaggttgattaggaatcagccaactgtgttccctgggtgctcagaaatcacagcccatatcctcgagaggccaaaatgagagccagggggttccaagatgagtggctgcttctggccgggagcaggttttcaagtcattagaacactctggcctttcctggaggtgatcttggagccattcctgcccctttcaagaggagttaatgcccagctctgtttagagaaaattgggggagatgattgctcatgtgggtgataagaatcacctcccgtgcaggggtctgcatagaacactccataggcaaacctgggtgtccaaggcacgtggcattttgcaaactctgggtgcagctccgagctgtcctgcaggtcccagaccaggtgagaactccctgagttcctgctgcctgggtcgggggtgaggcataggtcttgggggttcaacctggaattctgaatgtcattcattgcattggagaggaaggagagtaggcaaagccaagaccctggaactggacaaactcgtgtggtttaaagtcactgtgagagctggagttgagtctgcctacgggggaggactgcggcacctacctcgcagggctgttgtgaggagcaatgtaaccgtgattttgaactgtgattctggaagggcggtgtgcgtgtccccgggggtgtgccaggggagtgaggagaaaaggccagggagacagcctcactcaggcagctgagtgggagagcatttatctctaaacctggaggggtatatggtgggacaggaggaatttgggcaggaactttcatgctaggggtttgggggactcgctggacaatgcccctggaccccccgggggtacgcgttcacgctcacctctgagaggctggaaacgcctggctgtgctttctgaatgctgtgtgcttcctgcctctgtgcctggcctgtgtgcagcacctacttgtgtccgccttcaaaaggcccttctgggtggcgtccttttccccaaaatattaggcaccagccatcaaagatactgcattgttgcctcccccacccctccccccaactgacaacatttgggctcaaatgcagcaggctgggtgcccaacacagtgcctggcgagtggtagcgcttacgtttcttttctgttgaatggatggatagctaatgaaattgtaaccaatgacaagccttgatgtttataacctttactaagagattattattttgctcttcatggacctgttaacaaccaccatattgtatcttacggacgtttgtatgccacgtttgaagagcaggagccttgtttcggcgtcatgttgatggaacttgagctgtctgatgcgaatctgtgttttatgttagaaagcgcgtagccttaggatctggcagacccaggggccacttaattaaccctttgcctctttgaccctcaatctccttttctctaagccat

SEQ ID NO: 78000 - DNA, 12289 bp, Homo sapiens
gtgcagaccactggcagagcagcctgcaggtgcttagcgatgtgggcccagagtaaatatttgtttgattgatgagtgatggctttttccttcctcagagtttgccctgccccccattccaacgtgggctgctgcttctccccagcgggttgtagctggcagggccgttgtgctttggggtttgctgtacctgtcgctgccgtgaggggacgatctgtctgcccggaggggtttctgcaaacattcatgtatgcccctgctttcgtttgttagggagaaggagtggggtgacctagagagaggatgaggaaggggttctgggtggcatccttggggtaccaaccctgcttccatcctgcgctctgaatttcctcacagcccttttctgtctctggtagaaggtgcagaaggtaggctttgccaccttccctgggcctggcaccaagctcgggggtcttgtacacactttcccttctctaactggggtgtgggcccatttcctagatgagcttgctgagaatcaggacagctggtatcagagccaggacttcccagtcttgcacaaacaacctgtgcatttttgagtccaccaaataaggcctcctgcctggtccggctcacccctgccagcccccagcaaatgcagcctggtgcgtccccacccctgccaagagcccaggagtgctctggcagagaagtgcagggatgaggaaggaggctgtgccctccaggggactcagctgcgttagaggaggtgctgctgcagtggcaggggtctccagacatcccacgcaggggtcctttcagatcaggcatctcttcaccagaccaccgtattcctttttcagccctcgtctcttgcacgtgggggtgcagtgtttggctctcacatccccacattccagctggtgggggtttgagctgggtgttccttctgctccccactccccactcacggcccccaccccacgcaagcctcccttgcccccactctttgtctccagctttcacagccttggcgggcaggctgctgcgcctgttgctgccccggctctcttccacccgcctcttctttctcagcctgagctttaccgtgaggtctgggcgccacaccttggcccctgccatgcctgctcccagaagcacccacgtgggtcccctgattctctcctcccctgggctttgctaaggagccctttcattgtggcctttggtgtctgcctcatgcccatcccctgttcttgagaacttggaagcagagggggcccctcctattgctcccaagaggctccacagtagggagcccctcccaggagattctgagtctgtgtttaggtgtcgattcctgggtgggccttggggtcccctcaggccaggcctgtgtgtgacctaaggctggggggctctgtcaggcacctagtgtcccttggaggtgggcggggctgggtcctggtctcctgaggacgggtggggagacaggctcagggagatttccacgaagctgcccttgaacccctcctctgaggcccacactgccctggccctttacaccctgcctcctgcactagtaggcacataatagatgctcgccacctgtggagggcagggtttaaatggctggaaagagctgagtgggctgtttggctagcgtacgcgcatttgtttaaaaggaaagggtgtgtttcttggcaaagactcttcggaggaaacgctgaactggggatgggtctctacctgttctggggcctcactgcccttcctgccggggacaggcagtcactggtgggtttccccccagtggaaacacaatattttggaaatatttgtatctaggataaaacttcatctggaccaacatgtctttgttggtgttgtggcccaggtgattttgagaatgtagaatacatttggcaatttccaaacggagtgatgacctgctcctccgccccccatgccctccctgaggctggaggcttcagaagcccctgccttgggaggaggctgttctacctgagaagtctttgtccccaccgttggtgacaatcagcattgacctgtgaggcacctgccaggttcgggacgcagctttagacatccagaaaaccgggggtggaggggtggggtgggggcttaagaccccagagcttgattccttttaactgtctcatccccaaagaatggtacatgggtaccaggtaggttacttgaatcaccctgagcctcgattttcccacccgttagaaacagggtaattcatgacagtgtccgcttgggagacggctgtgacccctgagaattctcgctgcatgccgtgggctggctcgtgagactcaaggtctgggttcgaggcccccgcaaccccttctgactgtgtggcctgggcgagtttgttgtttgtaacctggaaagcgtcacacctgcctggcacggttattgtgggcttcaatgagattgtttgtgtgaaataaacgctttgtgactggcacacaggcgctctcatcccggctctcctggtgggcccggaccgctgggtgctggctgcggaggccctgtgctccctggaactgtctgcgctggtcccagggactcttgggcagagtggagggcaagggggaaagcaccagcctgctctggggagacagtggcagagggaagtgtttgcttttaaatacactcagcaggttcagacaggagaggatccgaggggaaatgtttagagccctcaggaggaggaagagaccgagttttaggaaaaacatcaaagctggataggttgggcagaagagctggggatagcatttagagaggctgagagtcctgggttctgggttatcaaggtgagagaaaccagaggttgccagttgtaggtgggcgtcaggactagagtgatgcttccagaagtttctgcaagtgggccgagtctaaggtagggcagggtacgccagaagttgaggggcactaggtagacaggccgagctggtggctgggtgctcccctcaccctccatgctgctaggagcccgtgagcagggacttgctctcctctccctccctcctggggcctgcctgtctgtctgtgaactcttgtcggccagcgaggccgggagcaggtggccttcatctgcaactgtgtctctctcagcctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaacaaaaactgatggatgtgctactaatataaggaggggcgagtgttgggcatcctgtctcgctgggtagtgtgatgggtgggagggcgggggccgacttgaaccccacacacctgccagcaccctaccctgcccactgggctctcaaaggggagggtggctcttggaggtccggaggttgacacgtgcttggatgaactaacatctctctggtcccctccttctactgatcgtgggatgccaggcttctttccagaagggactgtacaggaggaggtggtggtggagaggggttctgagttgagctcactgcgtgagttcctggagccccagagaggaagctcccctggggctctgagtcttcctcctcctcttctcacattccccagggctgggctgagtggtcatcatgcttgaactgatgttgagcgatggccaagatggcccagccaggctgtggctaaactcattcctcaaaatggctcctgagcaaggctctgtgtgtaggctcctgagcagggctgcaaaggtggagcctcagacccatccctgcccgcggcagcaatgccggctgagctggggaggtgagccttgcacccctcagagtggctttctgtgagcagcttgtggctgggctgagcgggggcactgaggggcaaggggccaaagggcactagacccaagtcaagacggatcctgagtctgcacacctggctttgctgcagcggatcataaggacatgctccctatggggaaggagagaccgactgcttttgctgccacagccaccacggccatcacagctaccacggccgccactgccactgccactaccaccaccatcacaaccatggccgccactgccactgccacctcctccctcttctccttgctctcctcctcctcctcttcttcctcctcttcctccctcttttccttccgtctcctcctccctcctcttcctcctcctcttcctcctcctcttcctcccaccttctcttcttcctcttcctcctcctccttcttcctcctcttccttcctcttcttctttctccttcctccttctccctccccctctttctccctcttcgccttcctttcctgccttcttctcctcttccttttcctccttcctttttcctttccttctccctcctcctcctctttctccctcttcttcctttttgtcctcctccttccttcctttcatttgtttctccctcctccccctccccctctctctttttcttctccttctttctcctcctcctcctgcttctcctcctcctctccctcacagggaggtacctcaagagaactgcaggcaagtccagccgtaagtgcacaggactgagcatggcccctttgctgagagaaacaaccgccttggggatcatggccatgacctggcaaaggagacctgaccccagcccctgatggagatggtgacatggatggcgctgagtcagcagtgagaagaggaggagatggccttcagagtgcaccccacctagatgagtcagtctgtgctcagccaagaccaggctgagagtccaggagagtcctgtgtggtgagcagagtatcagcctttgatgaagctcaggtgtccagagcaagccacccactgatgttccagagccaagaccccagctccagcctctgttgaaccttgggcattcagaatgagccacccaacttttgacgtcccagagctaagactcagttccagcctccaatgaaacccagatgttcagaaagagggacctccttgatgttctagagccaggactccagatctagcatcaggtgatgctcagaggtctagaaagaggaacctgcttaatgttctagagccaagactccagatccagcatctgatgctcagatattcagaaacagggacctccttgatattctagagccgggactccagatccagtgtctgatgctcagatatccagaaagagggacctccttgattttctagagccaggactccagatccagcatccgatgatgctgagatgtccagaaagagagaccttgatgttctagagccaggattccagatccagtgtctgaagaagctcagaggtccagaaagagggacctccttgatgttctagagccaggactccagttccagcctccagtgaagctcagatgtccagaaagagggactaccttgatgttttagagccaggactccagctccagcctccgataaagctcggatgttcagaatgaaggacgtccttgatgttctagagccaagacccagctgtagcacttaacaaagctcaagtgtccagaaagaagtgcctctttgatgttccaaagccaagataacacctctatcatttgataaagatcaagtgtacaggaagagggacctccttgatgtccctcttcagccaggacttcagctctagctttcgaagaagcgcagatgtccagaaagagggacctctttgatgttctagggctgggacccagttccaacatctgacaaagcccagatttccagaaagaggggtctccttgatgttccagagctgagggacctccgtgatgttccaaagctaggactttagctttagtttttgatgaagctcagatgtgcagaaagagggacttccttgatgttctagggctgggactcagctccaacctctgacaaagctcagatgtccaaaaagaagagtttccttgatgttctcgaacccggactctagccctagcctctaatgaagctcagatgtccagaaagaaggactttcttgaaattctagagccagaactccagctccagcctctgatgaagctcagatattcagaaagggggacttcctttatgttccagagccaagacccagctccaacctctgacaaagcccagatgtccagaaagagggacccccttgatgttctagagctggaacccagatctagcctctgaggaaacccaggtgtccagaactggtgagaaaacctcaagcctctgggctttcctgggcagggataggtgtggccaagtttgtcttgagactggagagggcagacaacactcttctgtgcaatggtggcctgcaacatttctcaatagtgacactggcataaagaggggtcccagttgcaggagagatgtggagaggggactccttgtgggaggaagcgtattaggaagaacatggcagcagaaatcatggattgcagatgggatgccttcgatgaagcttgcctgagggcgtgtaacaccgcagcaaagcgctgttttatgccttttagttttgctggactcatggctggccacacatcagccttgacccacagggctgccaaattggctggaccccggaatgtaacccaagctagtttctgcggcttagctcctctcccagtggaaggtgctaaacccccacttgccagcccagtgtaaagctgcaaccttggggcgagtcagatctggttgcctccttctagcaatggaagttcatctaggttaggactggggcagggccaggctatcgcaatgggtgtgaagacagcatgaacggcaaaggaggcccccaaatacgtggggatatggatgctaatgtctcaggtgaagctgcatttggggctgcagccctgccctgagcaccttgactctaccacttgccctccaggagctccattgacaccagactgtccattaagctggagagagatggcaagtaaagaaataggccaggaatactgacttgctcagaagccataagagcattacaggtagatagaatccaagggacgaaaaatgtagacttggggaggagagagcgctgaatgctatttgggatgtttgagctctgcaatatccagaatgggagagaatcttatctcaccagttttgccattcagacacagctatgagaatggatcctagaggacgacttacttcattcagctggagtctggaggaaaagggagcagctaacaagcattcttgaaaaacacgccctaatgatgccacatcattctggtgatatttcctagaaactcattagaacttggaactgtgcaaacaagaacttctttgatgagtaactggaactcgagagttgggattgcatgaaggagaaatgtcatcttagaggactgcctccccgctccccaccctcatttggccaagttattttaggaaatttccaagaacaagcaattagaatcactcattgctgatttcctagaagtctccacaacagattctgaagccaaatgcaaaatgggtgagcccagcttgtgaggcctgtgaagaaaatgtgaatcctactctataaagtcgttggcctcagggagcaagactcagaagtagagctgcgttagggaaaatgaggacagaacagaaggtctagatggccaggcagagccccgtggcaaagacgagccttgagatgactgtgggccctcccctgccggcagccacagcctgtctcagactcactcctcagagcctgtttctccatcactccctttgtccttctgcccatcagagggatgttctccaggcttctgtgttgctatctggcttccgtgggccatggcttgagccaggctgtgggctctgggtgactgtccctgaggtatggtgagcttcctgagtggtggccacttggcaaagtgagtccatcgcagggaagtgggcaattaccggggagaggaaaatcatggctttcttgcttcccaagaggggctgaactgggctcccaatttccctgacactcccagctcagcttgtagaggaatcagggaatggagatgccttgggctgcaattttctttgagatgactgtaattttcccctcttatcctcaccggtagctgctgtgggacagaggcaggcggggctctgaaagcttttcctcaagctccccttcagtgcagagctgttttcacgtgcccaccagccagcaggaggttatgcttctgattgtgaccccctacttctcagaagacacttcggactccgcccccgcctccatacccaacaatgccgtgcggcatttcgtgtgactggaatggaaatccaacctggccctcgagggcagtgaagccagtccgaatcgcagcagatgatgccctctgcagaggccgggctcatgaacggcctgggtgggtggaggtgggttgacaggatggggtgggcagggcaggggagtgcaggacagtgaccagctggtccagagagtcctgccaaattcaatccagatattactggattaatcagcaaaggagggggagccccgcccccaccccatggagacactgatgagcaccatgggatagctgtggcttcccaggcagcccacggacctacagctgcctatcagcagccagggccttctgggcagagcgcctcggacccccaattgccctgggagggtgggtttttggtgtcagcttagttcagctcagctggcttttatagagcatgcactggctggctcactggggtgatgctgtcgtggggtagatgagcagcaaggcagattcgcagggttgggtgcaggcagcactccatgggggcatgcacggggcccttgcttttcaagcagaggtggactgaaggctgggcttgcaagggggtgggctggggtgggcgctggtagggtgttctgaaacattacctatatacctgcactttacaaagcactttatatgtttgcctggtgttggctgatggtggaaggagtgattggagatgcctgtctgtggcctgggtgctggttagtacccccatgtcagaggtactgaccctgggctcagagcgggtagaggctctcccagggattctcgagtgtctacagggggactgggattcccttcctgggaccaggaggcggggctcttcctgagatgctatggctggaggccctcctcccccagaatcacagggccatatgctaggaggaaagaccctgtaaactccagacctgacctcctgggacctggggttagtcacccaggtggggatctgcctctcttgcccttcatttagaattggctgtgagcctctaagggccagcccttagccaaaagcctccatgcagcccggtgctcctgcagaagtgctgcctccggagggtttctgcaacttgggactcctggcagtggggctagtgtcctccattcacccctgctcctgcacagtccccagccctaggtgtgcaccctctagtgtggggcgaatgggctcctatgcccattagctctgggttaggctcagatgtatgtgccgggctcctgttatgggagggctcagagcacaggggcccctggcctgggagcgggtagctgtgtgcatgtgtgtgggtgtgtgtgcctccatgagcctgtgtgtgccttcgtgagcctatgagtgtgtgagcatgcccggtgtgcacgtgtgtgggtgcgtgtgcctgccagtgcatgcgtatgcagctctatgcttgtgtgtatgtgcatgcgtgggagacagatggtggagagcgactgggagtgggcgacagtggatctgtccctgagcctacagcaccctgggtgccgatgccacatccacatcctgcccccagacctgcttcccggagtcacccatgcctatatcccctgtggctttgcccatcagtccgtctttgtgtccaggtctgcctcagtggacagaagagtgagagtcttggcccttgaacccctcctcttctccatccttctccacctccccccctgcctcttcttggcaaagcagctggagtgagacctgggctgaggccaaggttgggggtactgtgctcccatgagctgcagacaccgtcctctcaccggctctccctcctgtgtcctggagtggaacccacccccgttgcccaccccttaacccctgcccccttgtctggggttctggccatcccccccacccccaccccctagtctccagcttccaaggcagctcccaagacaatgggttgagcaaggggcaggctgggtcctgtgcctagcccctcagctcccccagccactgcatggggcttctgctgctctgtggcactggctggggaacctcaggaccagatggggcctcccaggcctcggctactgcatcacgctctggacagggccttgggcccggacgacgcctgtgcccgccatgccctctggccagatgctgcaccctccacccagcctccaggtgagttctcgtcatacccacggtgccccaccctccttggcatccaggtgatgcatctacctgaggttccgaatccaggggggaaatgtttgcctttgcactgcatatttacacactgatttgaattgaggggttcccaaaatgacatcaggctttttctgaaaaagtctgttttgcccgattggtttgccagtgaggttcagagtggacaaatcaaaatgagctgattccagacctctgaggttttgacaagtgctccatacctagcatttgtcacatctatatgctatagtatatgccagaggccacctcattgcaactttgtaaacttcctattaacttttacggcccatttaaaaatgggctatgggagggggagatccgtggctttccaaaatcccttcatggggtctgtaagcagaaatgtctgctgccccctgttccagggcacgtcccactcctcactggcagggctctcgggctcactgattattctctgaggatcacacagggtcgattttctgtgaatgcaagtgcgtggggtgggtggtggggcgtcgagctgaacgctggtctggacaggaaaggctcctgcttcatgtcccaccttgaccctcagaggtttccaggcccagctcttgggccctggcttcctcctctccctctcgtctttggggggggtccatctcatgcatgtctgttaccatggactccatcatcacggctcccatcacctccatctggcctctgtcatcctgggcacagcatctcatctctggccattccagcctccatcacccgcctcacctccatcatcctcgcttcggggctcattctggcctccagggctttgtacatggtaggctttcattcattcgtttgcacattcggtgaaggtctactgtgtgccaggccctgtgccaggcatcgtgtagatggacgttgcccttgtgagtgcacgcctcggggagacgcacgccagccggtggatggcaggagagcctgggccagggctgggggtgggggcgtgggtgtgggcatgagtgcagaggagggtgagctggtttccagaagggcgggatcagctggggtggtgggcagggggaggaagtgcgggctcagctgaggtcctgctgtgtggagcctggagggagagattgcatgtcccctctctattccccatgggtcatctcagtaatggctgccggagttcaggggtccctagattgctcccaaggtcctcactcccaagtccttggcaagattcctgcgccccaggagccttttggcacctgaactctgccacctagtctgctggtcagcctctgtgctgcccgcgttggtgggtgtcattggattgttaacgatgtacgttttgctctaaaatgatggtgattgaagatgggaattattttgtcagttgattttaatgttttcttttttgtgtgtgaagtgtttgttgtgaaatatctattttggaagtttttaggtgttggaaagccagaatctggggccctctggtgtctaggaagaacctgtgatgccctggggtgaagggatgtggactcccagggacaaaacagtggactctgaggtcctcagggtcacctccct

SEQ ID NO: 78001 - DNA, 1513 bp, Homo sapiens
tctggtgtctaggaagaacctgtgatgccctggggtgaagggatgtggactcccagggacaaaacagtggactctgaggtcctcagggtcacctccctttaaggactagagcacactcagtattcgggggcctctgtggtctttaaagatgtcccatgtttgctaaggaaatgttacttttgctggagaaacttctgaaaaatgtttagaattgtttacctgcatgttttatctcgttcagaattagaattggtggcatgtagatatgcttctgggtctaccgagatgaggcaggcctactgggtctccaccttcagctcaggacacccatcattcacctgggaggggcttgcttcattagatgttcacaaggctgaaaagtgtcccagcctcaagtgtcacgtggagcctcttccacatgcatcgccagaagcgcctcctcccccatcactctgaccccgccccacacagacgtgtcacactaggctcctcctcgagtcatgtgtcacatgagacacccccgtgtgtcacttccagccctgactactcagtgtcacttggagccttttgtccctccccaatgtaccacttgaaccgtccccaatccatgtgacacaccaaatctctgtgtcccactgagttccatctgcactcgtgtcacacagttccaccctcatgtgccacactgagtcactcctacatcatgtgtcacagagaggtcctgtcgcctcccttgagtcatcctgagaacctcctttctccgctttgtcccatggaaccctctttcacccagggttcctcctcagcacctcatccacccgtgtgtcccacggagctctcttcctccacctggggttcatcctgagctcctcctcctcctatgtgtcatcctcagagctcctcctccctcgtgagtgtcccatggggctcctcctccccccatgtgtcatcctcagacactccttcacctgtgtgccccatggaacccccttcttatctcatgtgccatattgagcgccttctccatccttgtgtcccatggagctcctcctcctgccatgtgtcatcctcagctcctcctccttcctgtgtgtcccatggagcccccgcctcttcccatgtgtcatcctcagcttcctatcccttccgtgtgtcccatggagtccctcctcttcccacgtgtcattttcagcacctccttcctccagggtgtcccatggagcccctcctcttcctatgtgtcatactcagcacctccttccacctcctgttccatggagccatttctccttccatgtgtcatcctcagctcctcctccctcccaggtgtcccatggagcccctcctcctccatccttgtgtcatgttcgacacctcctccactcatatgtcacatggagcctccacccatgtgacacaaataatttctcatctacttgtatcacactgaatgttctatctttcttaagggtgtcacagcaagccccactaatgtgtcacaggacgcccctct

SEQ ID NO: 78002 - DNA, 4628 bp, Homo sapiens
gtcactctgaccctgtcctctgcgtgtgtgtcactaggagccccacccattcagctgcactctaagttcctcctctaatcatgtgtcacacatgtagtctctccccacactcataagtcatacagaatgcctctccccatccatgtatcacattgagtttctcttcaacatgtgttactcagagcccttccctgactcatgtgtcacctggagcccctgtccctgtccatgtgttacaccgagttctttcctgctcatatgtcacatgaagctcctcctctactcacaaggcacacagcaccccctgcccgtttgtcgaatggacccctcacctcatgcatgtataacactgagccgctctcccaccccgtgtcgtactgagctcctcctccactgatgtattgcatggactccttctgacacgcggagccctccctgcacccttgtgtctcactgggcatctcttcccaaccttgtgtcccgtgagatcttcccccacccacgtgtcacatcaagtcctctttcttgtgttactccaagtccctgcccccatatgtcacagagagactcttcccacccacgtgtcacaccaagtcgcctttcttgtgttactccaagtcccttccccccatatgtcacacagagactctcttcccacacacgtcacactgagccccttttctgtctcacattccacctctccttcactcatgtgtcatgaggagccttttccctactaatgtgtcacctgagcttctctcacatgtcacttgaagtcctccccttcccatgcatcacccagagaccttccccccactcatgcattgccctgagcccctcccttacttatgtgacatggagcccctctccacacccatgtgtcacaccaaccctctctccactgatgtgtcacaccaaccccctctccacccatgcgtcacatggagctcttcccccacccgtgtgtcacaccagccccctcctccacccatgtgtcacactaaccccccccacccatgtgtcacaccagccccctcctccacccatgggtcacaccaaccccctcctccacccatgtgtcccatggagctcttcccccacccgtgtgtcacaccagccccctcctccacccatgtgttacagggagcccctcctccctccatgtgtctgtcaatctgagccccttttccattcatgtgtcactctgagcctctttcccacctccataccctcctgccacccctacttcttaatctttaacccctttccctaaaggtttccctccatgggctctttcagagaatgttatattatcaggtcatttactcacagatatttttgcaccacctaccacgtgcctggctgcgtgtccctgtgcatgtgtgttggtggtgtggatggctggagagtgtaggacgaggcaggcagtatggtggttgagaaagatgtcaaagaacaaaggaaggtgttttggggtacaactttattgagatgtaatccacatacacacaatccgcccattaaagctcacagcgaagtgtgttttagttattcacagatatctgcaactatcaccataatcaatttaagatcattttcatcacccccaaaagaactccagagccttcagctgtcaccttcaccctccatgcacaccccccagccctcagcaaccaaaaatctactttctgtctctgggaaattcttgaagtgcccctggacttcatgagtcctcactgggtccccagaggtgcctgttgcaacccatttcacagatgtagaaggcaaggctggagaagtaccagggagtcaaagcagtgggtgggtggggtcgagtccccgatgtccactcacagacctgggccagaatcaggcctgtctcccccttcacctccccatcctccgtcccttggcctggctgcacagtcacctgggggctctgtggggctaagggaggcccaggccctggccataggaggcaggtagggcaaggctgggcagggtggacaggtaccccagcgctgcaggtgcccagcagtgggtggcactgcctaggctggctgtcccttgctgtcactgctctaaccactagcagcaggcgtcccctctgccatccgagcgcttgcactgcgcttccgggaggagggttgcggcccgtagtcagtagttggggggtgggaacggcttcatacaggagttgatgcacagttatccagctcctatatgatgcctttcttcatccccttcaaccacgcgcagcccccggaccctcctctgcacccttggctgcacggggacgcgtcctcaagtccgctgctgtcctgccagcctcttcccggcatgctccttgggctcttctctctctcttctgcagctctctgacttcctggaggggagggcctggggctgggccatctctgaggcccctccttggcagggaactatgcccctggtgggacaccccctgggctgactccacagccaagggcagataggccggagggggagttgggtagccctggggcttctcccactgaggggctggggctgtgctcccacacagagccctccaaagggacccggcccacaggatggatggacagacgttggagagatggtgcccctttgtgcccagggtggagggggtggggctttggcggaccagggctggccctttctgtgccccaagaggagggtctcctcgaggggtctctgcctctacccaggactctttcatgaccaggaggctgaggcccctcacaggcggcttcttactctctccttaaacctgttctggagacatttcccctctccccaaggattcccaactctgggtccccagaagctgtcagctgggctcccttcttcccctgtgcgtaccctgctcaggctgggtacctgagggtgcccaatggcaacatgagcagggggcacggccgtggcccctggttcttggacctctgtcttctgcctctctgactaactcaggtcctgtgcatggcagaggtgacccgcaccaagccctgtgatattggcatcattaaccccattaacaagccacgacagccagcccaggcatgagcatcggggcagcagggcagccagtgtggggagagaggccttgcagtagctgaggccattagagaggacaagagggtgcaggagggagcatcctcacctctgcccttcccacttacatcccatctccccttcctcacccctccttccccatgcaccccttcttcctgtaggagggagcaccctcacctctgcccttcccactcacctcccatcttccctttctcacccctcctccccaatgcaccccctcccttcctgcaggagggagcaccctctcccctgcccttccttcccacctcccgtctccccttcctcacccccgcttcccccatgcacccgctcccttcctggtctacccctcagcttctgtggtgtcaggatgggtatgcttgtctttgttgatctcagacaggtggacaggggtctggacgaggcttactgtttgggtctgaggtcagtgctcatgggcttggggcatgacaagggtcttgtcgtccccgcagcagggctctgagcgggtgggtggagcttgggagtgggggtgatggcttctatttgttgtctttctctttttcactttgggagcaaccggggtcaccaggtgggcaggaggggacctcacgtctctgccctgggcagattgttaagagctggtcaagctcctggcacgggggcctgagtccaaggccctaactggacctggggccgcctgcaggagggatgagcgagtccggacccgagcggtgagtagccctcagctgcctgggtggtgtgctgttgagtgttccagaaactggccctgtgtgcaccagggctggaggctggcacgttgggcatctcatgggggtgggctgggtcgggaagggaggttgatggacaagactcagcaggagtggagctcagggctccctccatcccctgacatcagtgacctgggggtggacagagaaggtggaagatgggtgcatttagttgtggcccgccaggtcccgtgggcctgtgtgccagtgtccgcgccaggctgtgctgtctgctgttcagaggagttttcacctttttttgtggtggccatgatgtcataacccagcatgacatttaacattaaccttcctttttctttccccaggagaaaaaaaggtttgtattatttttcttttgaattttttatttccataggttttggggaacaggtggtgtttggttacatgagtaagttccttggtggtgatttgtgagattctcgtgcacccatcacctgagcagtacacactgaacccagtttgtacttttatccctcaccccctcccacccttttcctggagtccccagagtccgttgtatcactttatcagtagttctcctctgggcctgggggctgccgctcttctctgtaaactaaacctgctgtggctggatggggcaggggagccaaggaggcgaggtcctcactgtctgctggtgtggggggccgtggccactctagcaccgggagcccccagtcaatatgtgtgtgtgtgtgtgaactgtggataaatacgcttacctta

SEQ ID NO: 78003 - DNA, 1059 bp, Homo sapiens
aggggatctgcacctcttgcagctgagcccctggccttaacccatggcagcctgtcttgggctgccatcagaggcagagtgctaggtgaacggacagacagacatggtgcccttgagctcctggagctgctgtgatgttggttgttgtggaggtcattgctgggccttgtgactggaggcagagtgggtgaagtggcccaggtgagaggacaaagatcagccaccaggaaggggcctccatcctggctctgtcctcagctcctctgcagccggttctgggccttgatttccccaagtttaccttgggaaattgacatgagaagtctgtggatggggctgggagctctgagtgccagctgtgcccagcagtttattcctaactctgaatcctcacagcagccttggtgggttggagtgacagatgaggaaactgaggctgggagaggccttcctgcagccagccagtggagggagagagaagcccagaggtgtagcccctgcctttgaacctggagatcctgaccatgatctcctggtgctgctatcaggggtagattcttcagacaggtggatggtgggtgaaggccaggcacccctggggacttgtgagggcatcgtgagccctgtgtggggctgggcagtgcagggaaggaaggaggctgagcttgcagtgccagccttgggctcccgtggggtgtgtccttggtcaggggctccccactgtgtgcccagtggtcctggtccacgatgggtaggagcaggaggcagagccacactgtctggaggctgtcatgctcccgtgcctcccctcgaggacacagtagggtctcttccatgtgggagctgagaactctggggccaggtggaaatggctttcctaggggatggggtggctccaactcaggctagtcagacccctgcggggcccctgagctttgagcctgagatctgttgggtggtctcacggtgtgtcttcaggagcaggttcctcagcagggcagagagggcagagctggtgtgtcctggcatgggggcccgtgtgcacagagctccagtgtt

SEQ ID NO: 78004 - DNA, 13846 bp, Homo sapiens
cttgtggaccctgcagtgtggggctcagaccgcacctcgttaatcacatggcgaggaggccaaggccagaggtgggaactgggtttcggggctcccttttctggaacccttaggagagacagcccccactcccccgcctcccactgccctaaggcacctcttctgtcctctctttgacatgagcctgtggggggtgcacgtccctggtggcctcagtgggggtgggtgccttctcatggcagaaagaagtgcccagagtcttggtggggacgccttcaggaaggttgggggaggcctgctgcccatgtgccaggcccccaggggctgtttcagggcagagcgtttcctgcccccacccttcctgcccagtccacttgccccctcgtccaccccacctactccctccctcctcccatgcgtgtcccctcccccgcctatcctcccaccacctccacttttagaacaaaccccaaagtcagacagtcttttagtttgctttatttgaggagtgcaaaaagattggggggtgagaaagctcggggggtggggaagggtctactccccttgcaaagcggtggtgtggccagagcctctctgtgactcggcatggtcccctgggtgtctgtgtgccttctgggactccatccctgtatgaggggcccctgcacccctgcactgtccagtgttcagtgttgggagggaaaggcgccccaaggcatgcaggggccctctttgctgtgcaagtctggtaagtggcactggtacgtccggatgccccaaagagcggctttgtccaggtaagtccagagctcagggcaagaggaaggcggggtcaaaaaagctgaagcagatgtggtgggggtgggggtgggtttgcttgcagggtgtgatgggggtgagggaggcaccacatcatcagatgtcgggaggttgggggatgggggttggggggcgggggcgggagctcaggggagcaggagcaccggcagtggaggtagaagaagtcagtggagcacccgaggtcagtgtcccagggtggccatcaccaggccgggtggggggccccgtcacctgcttgcttggctgcgcctgctgtgcctgcttcttcatctggccacgcgtcatggggtcacttcctgctcaccactgctttctccctcatggatgtcactcccgggcatgggcttgggacctggagaacggagaactcgtagcccagggctggcgctgggtctctgaggactgggtagtccgttagcacaggtggcattgctggttgatgagttgaagaagttgttgcccttcacaagtgggttcctcttgggtcaggagtggcaggaagggaagcgaagcaggctgaggcgcggggaggccaggggacgtcgggaggtgttggggtgagaaatagaggggactctttgctggagacagggaggcgtcttcagtcgaggttagcatcttcgtcctcatcaggcagctcttctagccttgcctgctccctgggctggctctcccaggcggggatgggcagggcccgcctgtagatcagggtcaggaactggctcagggccctggctgcctgctcccggctgagcaggtgcagctggccatctgcactgtggatgtggagcaggcggctaccaaggaattccaggacctggggatccatcaggtggcgtgggcggggtgggtgggtggctgctgtgtggctgggtggggcctcctgcacgtcgttgtcctgcttgtcctgcgaggtgtcttgcaggccgtcatgcaggccacactgacggtaacgttgcaggtcgtcttgcagggcttctcgcaagacgacatcctcatcaccaacgacgtgcagctccaggtagcggttctgacgcagggcagggaggtggccctcctggggggtgactctgacaccgaagaactcacacagcgtcagccagaagccaggggtgaactgcaggcctcggtgggcctgggagtgcagagcatttcgctgccagcggccagggcccaggaacagctcagccagctcctgggctgggatggtgtttgcacctacgagagcgggcatctgggtgagcagctgggtgatggctgtcgtgatgctgctgcctgcgatgagggacgaatccaggatgagtcgtagggagcgctggggctggggccgagccacccgcatggcgggtgccggccgcagcgagaggcattgcctcacgcgcagtagcacgaggatggctgccagggctagggtgttcttccagtacaggaggcctcggaagaagtgcagaatgacggccctgatctgggccatgctgaagtgggcgaggaagctgttgaggatctggtcgatgggtatcatggccagcagctcttgccgtaggatctgttcattgagctcatcctgttcttcattctcttcttccccggattccgtcgatggatccctggggaatccccttgaggccagcagcagggtttgcctggcggcagtgttcctctggaaggctctcctccaccggaggtttctcacaggtggcagagctcggccgccgtcttgttctggcagctccatgacgtcaaagttgaagtgggagaagaagaagacccaatgcccggggagaagtacggtgagcctgtcattattcagagaggctagatcctctgtgttgagaaggatcatgatgggctcctcggtgttctccaggtagcggcaccacaccatgaaggcagcccgtattggaagaatcttcatctccgcttgagagtactcaacctcgataggggagatgttgcgggagtagaaagcgcagcaggctctcttgccggtttggtcgtcgatttggatcagggaggcgtgcagggccgtgccggtgacgccggtttccaagtagaatgggttctggggcttggggtggtggaggagaggcgccttgcggaaagccctcttcaggcactcgaaggcctcttgctcctcgactccccagtagaactggtaggagctcagcagctgccgcaccaggggctctgcgatgatgctgaagcgctccacgaagtggcggtaggggaagacgaattcgatgaagtttcgcagagatagcttggagccaggggtagggtaccctgttatgatggtcatgacgttcttgttcagtttcacccctttgggggtgacgacgaagcccaggaattccacggtttggcggtggaactggctcttgtccagggagcagtagacgttgtgatggcggaagcggaccaggacttggcggacgtggtggaggtgctcctcctgactcattgagtagatcaggacttcctggccataagaaagcacaaagaaccctagcatgtcctttaggatgaagtgaatcacgttctgaggtatgatagggtctggggagagcgcaaacggctggtagctcttcatctcttcaagctccaaaccaaacgctgctttccacacatcttcggtgcggtgcccgttcacgctttcctccacaatggtcccacgcagctccagttttgtgaaccactcggctccgtgtaactggtcaaacagttccggaatcatctgtatgtagtcctgtctgttggtcagcatgtcctgcaggtcccagtattcctcctgtagcctggctctttcttgcatcctggcacccacaggttcccaaggcgcggtggagggacactcgtaaaaggtctcgctgtgatcactgtctccagcctgctgaagctcagagggctctgattcagaaagatcatcggatccgtctgagcttggctggtcggaagtctcatcatctgcttccttcgggttaaacacgtcggccaggtctgagtatgggtgtggcagtccgggtagcaggctcatgccgtgcctctctagggcaatgcatggcgggggcgggcggaagcagttcttcaggcagtagggagagtggaaggtgcagcggcctttgatccagtcgacttcgggggcgtggactcggagccagcggatgcctaggaccacagagaagttcggtgaaggtacgatgtcaaattcgatggactcctggtggttctggtggatacacaccaggggctccgtgtagagccagacaggctcgttgccaatcagcgagccgtccacggattggaccggctgtgggtacggcttctcgtagagctcgacgtagtgctcttgggcgaacttctcatccatgaagttgccgtcagctcccgaatccaccagggcctggaccgcgacgctgtggtaggggttcactctcaccatgagcagcaggaagaggtgggcgcgattgatgtccggatggacttcgctgggcaaccagctgctgaccatccacctctctggagcaggtgagtcgatccaggtcaggttccgggggcgggcctcggggggcagcctgagcatagctcttctctctgccagcttctcttctatttgcaggatgagcacaatcagactgtctagggaatccggctgagggacccggaatagatagtgcctgatctcctcgttgagcccctggcacaagtgggcctgcaggacttcatctggccagcccaagatgggtaccaggctctggaactcatcgatgtactcagtggcagagcggccgccctgcctgatggtgaacatggcctcttctgccacacgcagtgcctggcggtactcaaacacttcggacatggcctccaggaaggctgggaagtctccgatcagggggctgttttcctgcagtagagctttggcccattctaatgccaagccggacaggtgattgatgacatagccaactctcagacggtcgttatagaacattcttgggtagctctgtaaggtcagttggcagagtacgatgaactcgtggaattctctgcgatcgccagagaagtgctttggggcgggcagttggcctgcattgatccctttgatcaagatctcttctgctactctctgttgctctttgaggtcttgcattcggaagtacagcgagatgatggacctcaccatggccataagttctgcggttgagtgctcggtctggttttgctcttgaggagtctcctcccttcccgattccttcaggtcagtgtgagcctcttgttcttctcgggctcccgatgggttgactgatgcttctttcatcctatcagatgctccactgagtggatccccccttgcctggtgtgaaccgttgcatgactcctccaggtcttggagtaggtcattgggtggatcctctatttccttacgtgggccactggatggctcctccatgtcttggagtagatcagtgggcagctcttccatttcctggagtgggccactggggggctccttcttttcctgggctgggccgctggctggccctgcctctccccgcactccactgcccgacgtcgcctcggtggtgttggatgagccctcggaggactccatttgttttgatgatggattcttatgctccatcatcgtctcaaatgagtcttcagagggttctatcatttcgtcggatggaaaggagtgtattctgaagattggtaaggttgtgatggcgtccagtcagtagctgggaccgtggagatcagaacctggtggtggaaggggagtgtggggagtaaaggcagtagtttaggatcttgtgaagtggcagtatcagggtctcaaggacaaatcagatgcccaactaatcagagcagagagaaatgggggaaagccttcttgtatcgagccagcctctttggctggtcacttggggtgcccccagggagggaagatctgtcaacccctgacctgcctcccaggcttattcagtctgcctgtcctgtccttttcctccatagatgtgagaaattcacagcccataaattctgtggctgggagcagccaccgtggcaggcgggtacctggcagggtgcacaggctgctccattcccccctggcacatgcacctggtcaatcctcttttcctgctttggtcacctgagaatcacagaggtcacatctcagcaccatccaaagccacccctggcaggctcagggctctggagcaagcccagccaccttggttgtggagcgggaatctctagcaaagatgcctactgtttcaccagtgcagtggaagaggagaaaatgggcacttggccactgtcccgtcagttgggtcagcagcccaaaatagttcttatttccttccccatgttcaaaatagaaatttcagggggtgtgtacaggtctgggttttttttttttttttccataaattttataacatacctactatgtgctggataactgcatatttgttacttgattctaactcagacttttggccaatttctctttctcgatttggtctccttccaatgctatgttctcccgacctctgagctgttgaggagatcttcaaataatctccttctcttcctacaatctccactctcccaggactgccctctttgtgaggcttctggaacttcacacatctggcctcaatttcaccagtgcaagcatatctgcacgcctctccaatcttatcctcccaggtccccttcttaacgccagtgggtctggtctcctctttctagcaaatatctttttctctctgttgctggttgagccctcccaacagacatgtatctggcagagttgggacattgagtgtgggggttggggggaacatgtgacatctttggaatctgacggtcccagagtggatttttggaaatctagtgttgggtggttttagtgggctgagacagaattgaaagggaatgtcttggttggggttatttgcacatttcttctctgctggggcagagcaaattaagctttgattatctgatagattaactgtaaagctactgctctttataaatttaacaccttttgttacttctgagttttcttctaagccactggacccatccgtaaaaaaaaaaaaaaaaactgcgttcccccttacgtgaaactcattggctaaaatccaagctttccaacaggatacaaaattcagatctgctgtttctcaaaattaagtacacccttgttagcatgacacttaaatttgatcatgcagtctctctgattaaagccttccactgtttatttactgtctgcaatattaaatccaaaccttctagcgtaaacatatctgacatgtaaactcaccaaaactattctctggttaaaatgtaagggccttaatataatataaaattcttattttgtcattcctcaaggtagagatcacatttttttaaagcacagtatacaaatcagcatggtataggaattataagaatcatcatcatcatcatcatgatgtacatagcacattgcagaaattaactcatttcctctccataaaagtcctctgagatatgcattattactgtaaaattccaaacctctaatataaaattctaattgaaatacaaataaataattctaattgaaatacaaaaactaagtaattcatctgcagacttatctatcaggaataaaaatctcagcatgtctctcacttaaaactctttattggtgaaaatttaaatttcttagcaagacgatttaaaaactagattatgccccctcttaatataaagtctacactgcttaacatatttacaaattcgaccatgtgaatgattaaatccttcaatgttcctgccttcagctcaaaatctaatatcctcggcatgttagaaaaatcttaatacttcttaacatcaaagtttaaactgttagcaagatgaataaaggtcatctcataatttctctatttaacacatataaaaattcatttttattgcctgtaaagtttcaaccacttagcataaaatgaaaattttcaccgtgtaatttacttgccaactgattaatacgaacccccaaatctcatcaggtcactcctaaaaccctttattggcttaattccaaacctcttcgcatgatataaaattctgaccatgtcattcctcaaaataaaaaggtcactctcccttgcaagatacacgaatttgctcttataacttctgcttaaagctttattctatctcttaattacctatgagataaggtctaattatttttagcatagaacaatacattttactataaaatttctctgactactctacccaagacaaaatttctgccatgttactgccttaaaaatctcttaatgagccaggcacggtgactcacagctgtaatcccagcactttgggaggccaaggcaggtggaacacttgaggtcaagggttctaggtcagcctggccaacatggtgaaatcctgtttctactaaaaatacaaaaattagccgggagtagtggctcatgcccgtaatcctagctacttctcctaggctgaggcgggagaatcgcttgaaccttggaggttgcagtgagccgagattgcgccgctgcactccagcttgggcaacagagggagattccctctcaaaaaaaaaacaagactcttaatggctgaagtccaaattccttagcatggcataaaaatgtaattctgtcatccctcaaaatagtgtccaaacttcttagcatgctatgtaaatttaatcatataacttctttttataaaaacatgctttgtctataaatgacccgtctcctcagcatggagcccagcctgggtgcccttgtgcccaggggatacctctgctcacgagtggtctgatgcttattcattatctggttcagcaaatccagataccttaacttaaaatatgtttacaatccagtttctctggagacaaaaccctcatcaatttacttcttaaaacgctttactggctgacatccgaacgcctctgcatgagatttcaacaatgagctcaatgagctcatcccccaccccttccaaacacagcacttgaatgccttcaactcttttgtaaaatcacatctccttagcatgtgagcaaaatctgatcatatcatctttatcatagagatcctgtcttatagctgtgccaaaatgcacttgtttgagcatgtaacttctcaacttaaaacttctcgaggtttcttcattgcctgtaacataaagtcccaactacttaacacaaaatgcgacattttaccatgtagtttctctcaggatgatctattaaaaaaccccaaatctcatcctgttcctgctgtaagccctttattggcttaaatccaaagttattaacatgatataaaaatttgatcatgtcatcccttaaagtcaaattcacacttcctaggacaatatataaaatttgatcttataactccttttaaaatcttacagtgtctcttagttgtaaatggaagaaaagtcaaaattcttagcataaaatgtgaattttattttgtaattcactgcatactatttatcaaacgcaaaaaactcaccaggccactctgttagaaagttttattggctaaatcaaattccttggcatatgcaacagtctaatcatgttggagcctcaaaataaattccaaatttcttttcatattcgcaatattgatcatttaactcctctgattaaaatctttcaactttggtgtcaacattaatcacacctcctaggcaagctctgcaggttgaaattggcactcccccaagatagaaattcaaaatgtttgcgcatgattgttaaattggtggctgttacttttacaatttccagtgtttccttgttgcttgtaatgtgaatcccaaagccgttacccgtaaaatatattttatcatgtttttctgcatacttatctcccacaaacaagaatctcatcatcacatttcttaaaaccctttggcaaaaatccaaactccttagcatgatataaaactttgatcctgtcatccctcaaaacaaagtccagatttcttcccaggaaactcaaattatgaaactcttgcttaaaatctcaacgtgttttcatcactacaaaaagcctcaccattttagcaaggcacccacttttaatcatggcactcccagcttcaaacctgtcaaatttcatgtcctcaacataaaatctaaatgcctgagcatgaaatgaaaattggaccaattatttcttacattaaaaatctttggattgctcttctctacttaaactataaagctgaagttcttttcgcatgaaactagaacttttcaccacctacagtttccagcttccatttcctgttcctcacgcttctctctgaaaagactgagtttcccattctccagcctccaaatgcatttcgattttattgtccccaaatgtttcttttcttttttttgtttaaccacgtccctctgcccataattcattaattcatacagcagcatgtcctgattctttttctgggccaggcacggtgctcgatccccaatggaaggaaatggaggcagacccatcttgcaggtcatcaccaggaaggagatgagactcatgtcctggagacgaataccccactggaggtgagtgaggggccttggaagcagggccagggggttccctccacacctgctgagcatctgcctctctgggagggctttgggcgttgttggggcctgtcgggcctccaaattctggctttagatgggcactctgggattcccatctggcttcacctgcctaccagctggcctgccatagcctgggccctgcctcttctctgcgctttgcagaaatcatattctcagtccttcagctgtggctcaatacatgttgttctcaaatctcatgacagtttctttaagaaatatctactgatttgaaaattcccgccttatttgaaaaaaaaaaaaaaaaaaagaagcccagaatttaatgctgctggtttggggtcacaactgcctttgaggtcttcgaatgggaccctcttccccccaacactcaagagacagacgccccagcctcaccaccttcagtgcccagagcctctgtcgggtcagctccttgcttgcctctgagccagtggcccattgggtcagggctgccaacgtgtgtctatgaagggttgggtgtggggggggccatgggggggacaaatccctcagcaaatacctctctctgtcagctcgcctgtacagtaaaggaaatctgattttaaaaatagagcttggaagaggagatgagaggatatttaggagcagagttgagcctggggcggggggccggggtgggggaattaggggagaggtgaggacaggggaggagggtgggaggctgggggctgaggaggaaggtgaagctggtgaggagtggggaggctgtgaggatggaaaggggagtaagggagaggtgggttctctggaatgctggccatgcctcctctcctggcctccagaaactagcccagtcacacctggggcccctggctctctgggctgccaggatgggtgtcaggtgaagatccctgtccatcttggcctccttgtaggtggtgctcagagctccttgggtttgagggacatagctactgggtcttaggagggaagtggcctcaaaatgaatacccccagcagctccctctgctgcctggcctgctgtggcctcctgtggatggaaggcacagcgtcacagtgagggtggacatgcagggaccctgggagggtttgttattatttatcgattattattattatttattttgttgaactcgtgtcaaggttaagatgtgtccatggcagcttgaggcttggaagccttcctggtttccctggtatgaacaagtgtcaaggatggctcacttgatgggacttggtgaggaggctggtgagattcctgggggcttcctgagggcctcataaggagtttgggttgggtcctggggatcccagtggactgtggagtctgcaggggctgctggcctggcatagcttatgttggagtccctccccccgggacccttcaatcttgcacacccctgacttgtggctaaagacgacttgagccttacagggtgggaggccgttggcatctcggcccagggcagcccagtctcggacattccctctcttcccctatggtctggaccgaggtccttgaatgccaggccccatgggcctcggacttcatcgtagtgatggggaaactgagtctttggaaggaggaacagggagttacagtagaactacgctgtccccagggcgtgtctaaatcccaaaccacccagcagggtgggggtcttctgtagagggacccccagcccctcaccttgctaagccactgaggtgacagggagtgcctgggcccagcagcgctcctgctgctgtgtccctgccccctctatgcttgactggcagctccagggggcagctgtatcactctgcccagaataaccctgggaaggggcgtgtgccgcctgcgggaggggctgtgcgaggggtcacgggtgagcttgtccttcttgtcttgcccaaatcagcggggccaatcagctgctcctgaggctgatcttgcctttcaaggcaagtgggcagggacaggtctgcaccggcctcctagcctagatgggctctgactgtcaacatgaccttcctctcccaggtcctcagtttccccatgtctgcagggagggtttcggtggtggtcttctcactgtgctcctgtagctctggggttcctaagaggtgcctgcgggggtccctgggaaacagtaatgagaggaggtggctggcccaacaggtggagctcagggacacccattgctgccttagttccaccagctgctcctataaattggggtcgtcgtattatttcatttaaacagaggttgccagatctgagcaatggttgaaagcacagactatgtggtctcttctaatggcttgtcttgattttccaacctgggctgggaggggtgtaagagtggaacctgctcatctctggtgggctctctactctcacccagtgggctgcatggacaagcccaggtggctgcaggcctaggagtggagctgttcttagagtaggaaggtgaagactttgaggcaaacaaggagggccccacctcagggcctggtggaactagaatgagggcagaaggcagatgagaggctggctaaccttgcagaacctcagtttctaaggggatgattagaaaggtaggagcacctccttccagggaagacgggtgtgtgaagccctttgtaaactgtaaatgctatggacaagtcagggatagctaccgtcattaggattcttacgactgttacttccagaacacccactgtaattgtatggtcaagatttggacagcatttcatgcatggtgtcaactttaattttcccgttaaccccacaaggggacgatgccctgcttggagagtaagtaaactagagtccagaggggtgaagtggctcctctggaaccataattatcggcgacaatggtgcacagacccagcatacaggaccttccccgggaggggcaggctgatgactggagttggtgaggggtacgtgcggaagacggaatgtgacccagaaagggacgactagaatgtatttattaaatacattcaaatgagtctctgagtacctgctctgtgtcaggcgtgattctagccactcacccctaaaactgactttgctcctaacgagttgggggatgtgctgccgtcttacagagttaaactgggattcggagggcgaggtgctggcacaaggcccccgagagacagaggcagggtttaaagccaggtttctcctgggcaggagcagatgcccagagtggggttggcagttgccatttgggaaactgttgggaccttcagagccagagatgccatcttcattccatggtgttgatactgccagcctcgtggcctgag

SEQ ID NO: 78005 - DNA, 1040 bp, Homo sapiens
tgggggtctcagtgtctgcctccatctcccccaaaggtgcttgctgtcattcccaactcattctagcttatttggtgttcgaggagggacaggacagctggcccaggacctgctaattatagctgctcaagtatttgaatagaggccttgagtacacaccaccatgtcatggttttttcttacagacgaatgaacactttaacccttgtcctgagtgccaggccatcccattcactgccccacctcccctgcctgcccacccgatccctgggggaggtcgacatgggacctctgccccacatcttaccttggctgcaagcgttcaagtggatctcctcccgtcctgtgccactcgatcctcgctgcttgctaaaaagttattgaatacatttgtttctttaattgtgaaagtccagtctttttgacatgcgtacattttctacagtagcaaccacagtgcacacacacagtcttccagcctgctctgctcgcgtgcctttctgttgtgagcttttttccacgtggctacgttggggacctccgtgatgcttcctgagtgcttactatgcgccaagcgctgctttcaccattttacaggttttcactctttcaatcgttctaagaagctgcgagggccttccttttattatccccatttttcagaagaggaatccgaggccttgggacctacacccaccctcacacccgggcccacgctcactttaataacccggactgggcaaggactaagtccagccagagcgtcagcctcgctggcgtcctcactggccatggccctgcagccttgctcttcagttcctggaagcctcctgcccttggtggacaaccattttgctctctagcaaatggatagaaaagtttatgtgagtctggctgggcggggtggctcacacctgtaatgcagctcgttgggtggctgaggcaggcagagcatttgaggtcaggagttcaagaccagcctggctgacaccgtgaaaccttgtctctactaaaaatacaaaaattagctgggtgtggtg

SEQ ID NO: 78006 - DNA, 1682 bp, Homo sapiens
taatcccagctacttgggaggctgaggtaggagaattacttgaatctgagagatggaggctgcagtgagccgagatcatgccactgcactccaacctgggcgacagagtgaaactccgtctcaaaaaaaaaaaaaaaaagaaaaaaaaagaaaagaaaaaaacgtgtatttgagtctgggccccggcctctgttggactttgagtaaatcttaatttagcaccctgagctgcaactcctttctcctgaccctgccacctgcatgcgccattcaagtggctgcgccccaggctgctcatcccttccgccctgggtccccatacacagcaaccccatggggtttttgtcctgctccttcatattaatctgcattggtgactcctttgtcccatcttccctcagcacacagtagggctgctggcagcaggtgaggcctggggcaagggctcagagaggcaagatgccatttggccatgccaccgagtgagcagtttctcttcttgccctcccaggtggcgtgaaggggagatggctgctttctcctgggaagggagcagatgcctggcccaggaccaaatcaaaaggtctgaaaaatgatattcattgtcctaatgtgtaaatttcgacaatttgcaaatttgtagattctttagaatagaactaactcaagcccttcattctgcagctgaggctcactgcccccagtgggcagtgggtccagggggtttctgaggacagggcatgacccagccctgctgcccccaagatggcacctggcttggaggggtgaggggccctgttagtctgactttgaagaagaccagccttccagactcgcttggtgccctgacaggtatgtgtgctcttctctctcccacctaacagccccttttgggagacagggtctgagaggagtcagggtcgtataaccttaacacagtgtgttatccaaaaacccactaaccctgttactcttgtctgtctgctatgtgaaaccaagggcggtgttaaagtttatcaccatgatatacagatgtgcgtggggacatctgggatggggctcaggggtctacctggaggtcagagagggcaggatctgcttaggggagatggatgactgtgggggtcagacagggcagggtttgcttaggggagatggatgactgtggacatgtggctgtaaatcatcctccccgtcttacataggatggggatgcaactttcaagagttgccttgattggtaccttaaaggaaataaaacataaaatgcttggcacatagtagatgctcaacacatgtagaaaaggcacttattttaggtggatctgccgccgaatggcccttttgcaagctcttctcattttttggaatccaaagggaaggtgtggggagcagggtcggggtggaggggaaggacgacgtgaggttgcagagggcattttcttgaggcaatggcatatctttcattggtactggctgggtttatgcggactttgagaggagtggagtgtctccaagtggggctaccccagcctgcaggttggatgcaggtaacctcagtctgggcactgcatttttatttaccataaaaatatttcatatttgctgggtgtggtggctcacgcttataatcccagcactttcggaggccgaggccggtggatcacctgaggccaggagtt

SEQ ID NO: 78007 - DNA, 12192 bp, Homo sapiens
ctgtagttccagctactcaggagactgaggcatgagaattgctcgaacctggaaggcagaagttgcagttagccgagattgcaccattgcactccagcctgggtgacagcaagactccgtctcaaaaaaaaaaaaaagaaagaaaaattgcaaaactatagcaatcacctcaaggttttcacaggaatcaaactcagtccaaactaaaatgctgtgtaataaatagtggggcttcacgtgcaggaaaggcgattaagagcgaggcatgcaggccgagggctgcttaacctgtctcagatttcttccgcacaaagtcatggttgaaaataggtctctgcctggcagagggtaaagaagttctcgaaggcctctgtctgcattagcttggtgagagggaagacatttaaccaattaaccaattagtgatctgtgcggatggagactgagcaggacgagggtgccacccgactgggtgtaaagtgggcttagttttgtcttcttggtgtctgggagcctcagtgcctttctacgtagatgggagtatgcttgtcacatccttgtcacacaagtaaccctgtgcctgtttgaggattccaagagcctgtgacggctgcagggggccctgaagcttagtgtgcaagcaggagctggggacagaggggcttctgacgggagtcggggtgcctcctctggatgtgggggtgggctagggtgggcaaaggttgcttcccgttctcctgcagctgacagttagaaatgccagtgccgtttagccacagtccctctgggttagagtcgggaagaaacatggcagttgtgtgttttgcacaggaatcaagctgtcagggggcacagtgaggccccagctccttaccagcaagccgtctaggctgcgaacgcgagccgccgggccgcagctctctagaggtccctgtccccaccgcctggccccatctcatgtcacattcccccaaggtctcattccactcggctaatctccaagaacaccggccagggcattggctttcgggtccttttaaagaccaaaaagtaaagcactcccccgtgggtgctggacagcttgggagggatttggggctgtgggtggtgaaatcacagccctgggcacacacctgccagcccgatgtcactgacaggctgctcggaggcttggggctccagtgagagcatatagatattttttaaaaaacatattcgcgataaaataaatcccctgtgtctgcagaacttgctctgggcatgtacccactcccaatccatcaggaaacatgccctttgctttgtatttgtaaaaacagaaacaaaaacaaaaacaacccacaggcgaacaagcaaattaaatcccccccacacaaaatgtttattctaattatgcaagaaatggattgataattaatacacgcattagtaaaaatcaaacactgcagataaagccatctttaatgcttccctcgatccctccccatcaccccccagcaaattaactgctcttctcagtttcaggcgtctggttccagatatttttttctgtgcatttgcatatgtagataaatatacctctaaaatctatgactttgtttattttttacataaactatatcatagtgtacatttcctctcgcagcagcttgtgtttcttccttcaagagtctgcttagagataataaagatcaacactattccttataacaacacctcagtatcctgcgagctgtacacaccagagtttatttaaccaccttgctgctggcatgaaagcctcaggtcctttaccctggttggcgggggggggggtgggggggtggggggcgggggggggcagtgaattggtggcggcaggtgtaagtaattgctgagatttgggtttggggagtgggctcacgagtgtttatgacattattataaatgaatatatgagtgcataaattagcaaaataaaagggggcttttctggaccaatgatgagacagtgtttatgaacaaaagatcatgattaatccagttctgcacaaaacactgaggtccattagaagacaataggtcttggctgtttcattccttttaagagctgtttaatattccacggtatgtatgcaccattgttgattacactcttctactgttgaaaatcccagctgaaagtgctctgggggaggagaagctttggtcacagtcctagccgtcagggtgggtcacagattcataggtgttcattaaattattttttaaaaaagaatacataaaaatggtgcttaatgcagatcagtgaggaagcgtgtcacaaatcgaggttttaattaatacgattctgctcaactaatgcccgataaaaaagatctaagctgtttccattttttgttgctgttaccaacgacactgcagtgagcattcttgcagctaaatctgtaaacacatcctcgactgttcctttaccccagcttcttagagatggggtggtgggttaaattgtttgcaaaagtttattttcattgagtgatctttctaaaatggcattttgaccttgttactgtcttgctttaaagcctccatctgacttcctggagcttccgggacggggtccaaaaaataaggccttatcctggcatggaagaccctttagggtctgtcttggaacttgccagcctcagcccctccccactggtgtttacctgctaggcgcacctcacccccacggggctacctgtttctctcagcgggctccctacttcttaggctttgcgcggccgtgccttttcagccagtttctccccggccttaaagagcaggcttgaaatatccctgttggggagcccaaagttagatgggccccacgaaacactgtgttcagaagcccaccgaagccctgaccctggaagtgggatgcctcattgacatttttttcccaattaaagggaatgttttgcatttttctagaattgatgaaactggtcaactgttactcaccctccttcctttgtccctttctaggagccctgggctcccccagtgttgcctgggtctgactttgcctcagtgaaaactgcctcgaattctttcttgcaccgatgggcagatgggcagtgtcggaggatcgtgtcatctgtcccgtggcgctgggtaagtctgcagtgttgtaaagctgcaaacacccttctgggtggggctcaggctggcacccccccactgccccagcctgcgctataccacgttcccctgatgcttgccttgtgccgggccccagaacccagagtcatggggtccacagcgcgggagtagcgtctcagtgttgtgagttctggggatgaggttcggggtatgattacagcttggaaatggctgattgccattatggctcctccttgccagaggtaaacgggtctggtcccagaacaggaggaggacatgtgatgactggagtaacgatgaggggctctggggaaggacagggctgagagcaagtgctgggacctttgggaccgagtcatattctaaaaagagcacaggctttgggggagaggagctgtgaggccaaggcagcatccccctggggagcttgtcaggagtaacaggagccactggcagtgtttgggcttttggtccctttttttctctcccaggggaagggagaaggaggcattgcaggaagccagccaccctgagcacagacccagctacagaacagacttgagctgcgtgtccttggcaaatccccaagtgtttctgtgccttggtttcctgatattaaaaaaaaaaaaaaggactcataatctctctcacacagggctattgagatctcaatgaggaaataacgcaaataaatcatccagcacagtagccaacacgcagtacccagcaaaactcggtagctctccccatcttaccccgtcatgaaatgcttaaccccctccctgagacgggcagctgctccctttcagggcagggagacccaacagaggacaacacaaatgccagagagagtgtgaggggcaataaaagctgatgctcgcctccctcccagacatcttcccagggaaaagtgtgctttcttgaacacctgggggccggggaaggggctgccctaccactttgaatcgggtttcccgaaaagtttggtgagagtttatttttatgtaaataacatataaaaagtcagacttctccacaggcagattttttgaggctcatattttacagactttggcaagggtcactcggaaggaacagtggttacagtctccagaggttcataattcctggaaaaacttctggccaaacctgacttctcctaaatttcacagaaaattctccctgggctgggctcaggctaaatgagctttttgtgtgttagtacagccttacctagtggaagcatgacttgcacgttgccctttacacaaaagggaacctcctcggccgctgtgaacaaaggctccgctctccgaaatgtttgatttgtttactcgggagcgtgagcctggtcaggcacatgtctgatactggggctatttctctgcggccatatgtagagctgtccaggtctctgcaatttaaccctgcgcttcatgccagaatcccatttcctaacttcctcaagcaacggggcaagggaaccacagcaaaaaggagtgtagggggagtgttccctccgtgtccggcaggggctaaagggcttgctgccctgtggcgtctgcctctaaatagggatttgggtcggtgacttttcacatctacaccaaagcccttcagaaccctttctgcaccaccagctatcctgaaccagaaatccctgttcacagaatttcccatgtgggtgcctcttgttctgcaccctgcatcgcgccccctcccccgtttatgtaaatgacacatgtaaatgtcactctcccaaacattttcacacctgcagcttcaaatcaaccttttaataggttaaaacaacagcaccaacaaaaaccaacaaaaacagaggctcccgagaaacaaacagtttttcccgaagggcttgcagtgcctaactgagctgccagggccgtctgtctgtctgttagccaggaaggcaaaccagcctgcgcactccacctgcaacacgatgctgcccccccacggcgggtcggagcagctgtggcgaccccagggctgacagattgggttgtcaggagcaggacaatgaggctgcagtgaggatgggctccatccttgaatgactctgccctccttgaaatttttctgctccatggaggtgcatctctgcccccgaggaccttgggcatttcacagacaaggagccctggctggcctcgcagccatcccccatatgcacacacgcacacgcacagacatgcgcgcacacacacatgctgagtgcctgcactgggagcataaggcagaaaactcctttggaaactgcagaacagagccttgtctagcagaggtcccctgataaaggtcccacagttcctgggaactgaacccctgtgaatgggccaggagaggcagctcccgactcccgtgtgggctgcattcatcagcaggccggcaccccagccctgtcactgtgtgaggagctttcatgagtccactgaacatgtaagtcacagtctggcagctggctgcatctgtggttgctgctcagcctccagaaaagggcccctcaacctgccagacctcctcgctccttccactcactctgccagcctgttgccccagagaggacacaggccagcctctgtgggctcaggagccagggcaggtgcttggccactctaggtgttctggccctcaagaggggagttggcagcaggacagtccccacctccccccaccagccctgggcactcaaccccattctctgctcctctccctcattgccttattgggacagaggcaccccgccaaccatctctgtgcctttgccatttagcccagggcaagctactcgggagaggccaaatggcctcatactgacccctgcctggtcccctctggccacctcgctcacttgcccgcttgcctgctcaggagttggtgctgtgggagcttctcaaaggcctaaacatgtgggctgccagcctgggcaggaaaccgtgctgcagccttctcagccaagcactggcctgcctctctcccctcggatgcctcctgtaacagggagctccctctctccccaggcagcctgctcagggctcgcacgcagagctgctttgctgagccctcccctgccttttgcatctgcctcctcggctgtgcagcagcccccttgccccctctgccctccgatctctgcaggctgtgggctccctctcttttcagtcctctcctttctgtgctgaatggcaatacccccaccaatggtgggaacaggattgggcgcctctacacctgtcctaacacctctgtctctgttcttttagacctgggacagagccctttgccctgctgttctgctaaaagcccaggggagggcgtggtgctcccctcctggggccagctgctccatgtctatctgttgagcggcttctcagccctcttgggttttctatggccccttttccagttgctagggagaacgctctgtatgcagccccctgccttttctgcaggagctgctggcctcccggccagccctggtcagccctgcagtagcagcagcagcagcagcagcagcagtaggcagccacagcagggctgggggctcccgagccaggcagaccggcttgactccctgctctctagctgcaagacaattccctttacttttcagactcggcttttcccctgtgaaatggagatgagagtttctccgtcactggcgtgaagtgaggactaaatgagataagtgtaggcttgcacacatcagacacttcataaatgcttgtggagtagacggtgggacccagggagggagagagaggtatgtaacaagtgtcgcaagagagaaaacagcctggcctttcaagaccctgctcccaatacaaacgggaacctctcctggcagagtcccctctgctggcttaatcgcacaaatcaagtcagccggaggcagcccccggcctgtggaactcacagtagatgcagcaggcagcataaatgacatgcagagcccacatctgcatttaatagaccgagaatttgcattgtatataacagcacgaggggtaaagcatgaaggcataaaggaacagtttttcccggcggcttccttgaagggccagcttagacaggggtctggggaggagaaactcagcggggtccgggcatcccatagactatgggacagacatccatccatgcactcattctccaagccaccacagtgtacctaccttccccgggcccagtcccaagcgtgaggctggggatgaagtgatgccggtggcttagtgatgccggtggcttcctgtcctcgaagctcagtcggtctggtgggggaaacaaacagggaataagacactggaaattgaggtgatcaagagggggtgcaggcatggagatttatggagccccgtcttggagccaagtcccgaactgggctgtctgcaaagaactcacccgggcaataaccctgcacactggtctcatgagccccattagattgatgaggaaactgaggcacagaaaggcaaagtcctatactcaccgtctctcagctggtgtgaggctgggccaggatggaaccccagactctccgaggctccccaccacaccctgctgctgaaggctgctcagcgaggctgtgccgagtgctgggggggtgtgggtgggcaggggacggattgattagttataagcacctcccagcggtgcttgagatcccagctcctctgtggcccaatccgtttgaagggcagattcaaaattaggtggtagcacctatgggcagaggcttatgaaaatggcattattaacctgatgtggagagggccctgcctgtctgcaagtagattgcagatagagacggagggggctgggcttgtttgtgtggacagtgagttagagaggacagagaacatccaggggccctccagggcttccggacggggagaaccagatctggaggggctggacaagtgggagggggaagaggggtacgtcttaagggtgccccggcacctcagggaaatgccccaggctggacttggaggaggatctccagccttgactctgacacagacagggactatggccctccccgcacctcggtttcccatctgtgagataagagatggaaaccaaacgtcatttcgagaaaagcccccattcccaccaccctcctggccccccccttcccccaccaccccaatcacgtttgccagacacctgtctgcttgtcagagcaatattcaacaggagagttccttcgcttcctccctggagggagaagggagaggtgtggacggggagaggggaggggagaggtgccccccactcagagaggccgctgagcagagttctgcatcgggtaggagttgggccaccgaagatttgtgccaactcacggtgcggtggaatcagacagtctgaattcttcagacaccagccaagagtctgtggcgcccccacgtgccacaagggggctgcctgggccacatttctgagcccgaaaagtgaggagggggacagtcaagagggaccggcgcttttgctctggcagcggcgcttttaactgcgacagatgcgtgcggtgcggcgggggagccggccgtgccggggctgggggctgctgggcgggggtggtcggggcggggggcgggggctgcaggttgcgcccctccctcacagacggctgcgctgcaatgcagcaggctgcgggagctgtcccgggagctgtcctgtccggtggccggctttccaaagtggggaacgagagatgagggagggagcacttccaggcgctgcgtggtggccaggcgcccaggaagccgaggggcccgagactctgcagcggggccagaaagagaagagtgggggaggaggccgggagtggtgcatggaccagggggtagagggaggtgggtgtggacctggggtcgggcgccagtcagcttgcagcctatgaaggacggaaaggagggctacagagataggggaagagtggggctgaggatagccagagcggcttggcacacagttttagggtaaaagcatcaactcttatctttccaaaagaaataaaaaagccaaaaaaaaaaaaaaaggcatttgaaagctagacagctgaatccttcccagcatgactgagccggtcactccagggtcttccttcaaagcgtgtctaatgggagacagcgttgtcccagtaaccaaattgggaccagagtcccagggaagggctcatcaggtggccgctctgccttgaagagtggtaccctcaggcccttttccagccaggggtcagggagagagctggagggctcggggaggcagggactgggagggagagtggggagaggagcgctgggggctgcaggagggtctctgggcagctggcgggtgtctcgttccgcaacactctgcaccctggtacatcgtcctccgtccactcaacgtggaatgattctcttccctctggatccagcccctctagttcccttttcactttgaggcatttgccccctgtgaatcagttccctgctactccagaaaatttctctcataccccaggcccctctgttcttttaaatggcacccttcacccccagcccttcatcttctgcactgtattttcacttgttgatttaaaaatccctttattatgggaaattgcaaacaacacaaaagtagagaaaatagtacgtatttttactgtttactcaattttcatcttgccattacccggacacggttgccgtcaaaccctggcccctcttgtttcatctaaaccctaaactgtccctctactcccactgcccaacccctacccctggactatttcgaagcaaatttcagacaccatcctgtttcctctgagcattttttagtttgtatctctaaataagaagcttttgtttcttaaaaataaaaccacaacaccattatcacaagttaaaaaattaatagcctttccttaatatcatccaccatctatgtagcattccaatattcttgattgactcataaatttcttttacagttggcttggtcaagtcagtgttcaaactatctcctgctctttcaaggggatctggggctctagaaggtaagtatggctacacatttaggggttgaatatctgcctggaccttaaatgagaaactcaacctcagcaaacctcagtgttctcactgaaaatggggcaagttctgggtctctccttgggtcattgagagggttagagcattaacccctgaagccccagccgcatgtctaatatgtcagagacactcagcaaacagtagctgcgagaatgattctttttcccagaaacgtttaaaggggatttgggcaggggcaggcaaaacatagctggctattgtccataaaacaaaaggctcctggcagtccaggtcccctgagtggttaaaacagcacatgcactacatcccaaaaagggcagcctacagtctgggggctgggttcgcctggacctcctggcttgccgtttagctgcctgacctcagctgttgtgacctgggaccaacaggggaccccggcaggtgcctatccactagatggcactctctactgtgagtccaggggggaccaccaccccaaactgctttggccactgcccagccctgggtgccaccggaagatgcacaccactaaaacatcgcagataatttctaaaaagcacttctcaacatgtcatgcaaaagatgcggtggtttatttccttgcataaatcccaaccagattgcagaagcagagggaatgaacatttaatgactttgctgaggccagacactggtatgtctacgctctctttaaatcctcatcccagcgacatctgatttcccttcattttacagattagaggacttggagaggttagtgacttgctcgaggtcggctaggaagcaagacccaggattccaactcaggtctgtgtgattcctctgcaaaatggagaggtggaaggatggatgtcaggtctgatggatggatggatgcctacatcaagatacatgcatagatggagagatggctggctacctcatgaatgctggtaagatggatgagtgaattgaagcacaggtggtggaaggagagaggaatgagagaggatagtcaatttcccaccaagatcaaaggcttacttgatctttgaagagaggttccctctgaatggagcttgctggtgaagctcctgccttctgttctgcttctgagcgcactgactggctcaggtggctctgggacaacaggtgggatgccagcttacagggaccaagtcccagctgtggtgctggagctgctcagtggcaactctccgtctctgctgctttcacgcagcactgacgaagagcaggcatccgcctttccactggctctcctggatgactaagccctaagccccaaccgcatactcagcccttcactggcacttggcataattttatctcctctaaatcatcacagccaccctccatgatagcaatttctattctcaattaagtgaaaaggaaaccgaagtttaggagtggtaagtgacttacccaaaatcgtataaggaggaaatgcagacccaggatttgaactcgagtcttctttccttccaaactcatcccctcaacctgtttatttccttttctctatgaccatgtctgaagaaatctgccttggggttgtctcatattggactcactctcttggtctgtcagtgagctgaacttctcatccaatcaaatccaagcttatttcccaagtaatatctctagtgtattctatttgtaatgatcacacaggcaagggccacacatatcactggcatcctacagtacaattaatcaagtcaaattagattcctggcatctcatattctgactgaatgctaatggtagtagatgtaaaaatgactccagtgcaaggcaaggagggaggggactggatgtagggctgaatggcgaatcagtaagccttgctgcagacctgggttaacattagcagataggttttgagaacctgctcatgggctaggccctacttcacacattctaggtgctaaggtttcaa

SEQ ID NO: 78008 - DNA, 4818 bp, Homo sapiens
cagcacatctgtaactggagcctaggtggcatgtggctgcacatcacatggggtgcctctggcggggtgcaatcggatgccctaacagccaggcgggaggagatgggtttagcattggtgctgacttgctgggctgtgttgaggataagctgtgatcccagcattgcctgacttcagattctgtgccagtcctgtaagaactgttgcccctgcatctcctccaagatggacagtctatttattcatccaggtccaatggtacatcctggggattccctctgcttctggggctgcctgtgtgggaggtcagaaaaaccttcgcacctcccccccagcccccgccacgtgatttattctcacactcacattgcgggctggcagtgggacattgctgccaaaacgaggcttccggaagaagtggtaaggccgactctggagcgacactgcccgggtttgcctcctggctcagcatttccttgctgtgtgaccacttataagtcacttaacttccctgagtctcagtttccttaggtataaaataggactagtaatgctttgctcaaatatcatcatctccgtgaggcctcctccctggtgtcactccctacccccttcctgctttattttcctccctagttcttaccaccatcttttatcccatgcattaggcttaccttttctgatgattttctgttcctatctccacccacagggatgttaattctcatggaaccgggatctgtccgttttgctcactactgtatccctggcacttagacccagcaacaatacaaagtgcatgctcagaaattttggggaaaaatttatgagatactattgaattgtatccaccccagaggagtgtcaatgtatgcaaagtaggcagtgtggtgcttggtacagagtatgcattcaataaatattggctaattatgattattatgtctaattcacaggactgttgtgagaatcaaacgagataatgtatgctgaggcatgctgtgaacactacgtgctgggtacaggaggtacaatattaatgatccctgctgcttggagggaacttgcacttaaaatgttatgcttttcattttcacaccacttaggagggaggaaaggctggtgggacgatcgccacctgaggctcagggaggggacaggccttctccaaggcctcacagtatgaagaaggcaggggcaggtccccacactggtggtcttcccacgactccctcatgacagtcccccaatggacagattgatgtgtaaatgacgttatacacctacaccataactctatataatatatagaattattttcaggtccctgagttgctctgaggccagttgtggcaggtggtacacacccaggacaagctggggggaggggtaagaaggaaactggctgtgtatctttggtaaggcccatagtgaagcctcttttggtttcttggaatcaagttgaacatcaagaatctcactgcatagacttccccaagggcagtcccacttcacaaaatgaattttcattttccaaagcacatcccttagttggatttctgtttttcagtgtatttgtttaagctctgatgccatgtccaaaaaagaacatgcccgaacaattccctgcccgagtcccaaacccttggcttgatctgagcattgaactaattcatttctttgatcaaactggggactgtttgagcagtgggctgggcgtcatgggacggggaaagggtggggtgtgcgcaggtgtgcaaggcgggctacttgagggatgggcgatagttcaggtcaccctccggttggacccacgagggcgctgcattcctcattctacaaaccgtacaagtcggggcacaagacagagaagccaggtcacgtctctgcagttacacagctcacgagtgcctgctggggtggaacctggtctgtctgtctgtctaacaccagagctcgggcgctgctgcagagggagccaagatttgggtgagggagggggctcagaggtgggatggagggtttttttgtatttttttttaacctggttgccattggcttgaaaataataacataactttgcttggggaccccccactgcaactatcttgctgatggggaaacaggcacagagacgttagtttgctttgctgatgtcacccagctcgtctggcattgaggctggatttgggaggtgggtactgaggtgtgagcatatgtgctgcaaccactgggcccactggctcgtggtgtgtgcgcaggtgcagatggctcagtgatctgggtttgagggcttttaccaatccccccagcagtgggtgtactctgaactcaagcttgtgtatttcacactctccctcgacccttctctttagccttcactgaaaactcctgcaagccactgacccatggaaaatatttaagaatacatatattacatatatgttgtaaatttatatatatatatatctggaaagggattgtatccaggagatttgggagtgattgtttaaggtagagggaggcaggggcatgagagggggagggatggaggtggggaccaccagtggtaattctcgtgggtggttttaacaatcaatacaagaagagagagacatgccagcagcaaggacgggagtgggttgtaaaccagggatggtgattaattcttcacaactgaggggcattaaaaaaagaaatcagagtggttcgtggctattaattttgttattaaaaataatcaaggaataaagaaataaggtaataaaggcctcgaatggaacaattctgagaatgtgttctgggcaaaggattatgactaatccaggtctggtaacctgatattaacaaacaaaaaaggcctcgtaggctattttctttttttaaccggctttatgttccatagaatgggcacactggggtttctctcccagagaaggtgagtgcagacaaataaaagccggctttgtgggtgttgattgaacagttaaaaatgaatgaatgcgtaaataaaaccagagacagccaagcatgtaccaatgatggcaatgtgttcctcactccccagctttataaatatataattgataaatcagtattgtatgtatttgtattgtatttaaattgtacagtgtgacattttgatatacatatatattgtgaaatgattaccataatcaagcgaattaacatacccatcacctcatgtagttccgtttttccatgtgtgcagtgagaatacttaaggtctactcttttagcaaatttcaagcatgaaatacattattgttaactatagtcaccgtactctgcattgggttaccagaacttactcctaactgcatcttactcctaagtttgcatcctctcactaagatctccagattcctctcactcctgacccctagtaactacctttctagtctctgcttctgtgaggttattccaaaacaaaagccaggttctaggctgttgaggctgagggtaggaagtgtatcaacaggtatacagaatagtcactggtcttgggctaaatggtgacttcaagtgtagtggctgcatagtcaaaaatgaattagatgagtacaaaagtgacgaaatgaaagaatgtcaagaatggaccacaaagacagtgttttatgacctaaagattaagatttatccatttgtgtacaattgtggactatataaaataaaacaagactttgacctcagtggataagaagtatttggatgtactaatcaatatttttggtctgggtcagtggtgggttcatctgtgtttgttgtatttaaaaaaataaatgaaaacattgaaaagggtgagtaggaatcaaatatgattgtcactccaagtctgcgtcatctgcatccgttaggaagaatatctgggttggttccttcttgggtaagatgcacagggacatatgtttgtgagagtcatgattcttgtttttgattagagtggtgaattaatacacactcatttgtaataatacaaattaataaatgaataattgcggagagctatgcttgggccagtggtgagactgtcatgaaccaaagattatgattaatactgtgcttctcacctgatggccattaaaaaaatctaggttttttcatcctttttaatatcagccttgtgttccacagaatggaggctccagagtgaaattaatgacactttgtcgatgaagatcttgattgtgacctctgtggaaaatgagccatgaaccaaccaatgtgagtaatgtttagtgttgttgttttgaagttgggtggttggttgatggttgtttattacattattaaacatgaatcaatacataaataaggtcaaagatgacgggcatgatgagaatgtcatgaaccaagggtgattaatttcatatagcgtaactgttaccaaattaaaaaacaatattactgggctgttctctgtagcaaatgagcaaagaaaaaaaggaacacacacacacacacacacgtatactacatatatatcacatgtatcatgtgttatgtttatacatgtatcctatatatatatcacatacgtaatatgtgttatgtttatttttcatatttgcaggctggggtgggtttatatatgtttatggggtaattaaacataaatggatgcatgtataaacaagatcaaagagagtcaagcatggactaatgaagacaatgtatcatgatctaagatttatgattgcacagctctgcaaattggagagacattgaaacacaaatatttatgctgtttcattcatttcagtagcattccactattaatttatgcactacactttt

SEQ ID NO: 78009 - DNA, 2327 bp, Homo sapiens
tgacacagtttgcagttatccacctcctccaagttcttaatatgttagatccagataactgccttgtacagccacctccaggatactgcctccctaaaaaacagctagatacactgaccccacagcctatgtggaccacacagatatagtggcttgctctaaatgcaccagtgagaactctctgcaggaaacctgcttgggaaatgccatagcctgcaatacaggctttccccttcccgctggccctgtgaggcatgcaggatctgtaagtaataaactgcttctgttgtttcatttcatgtgttttgttgagttgcttcctctgtgtctcacctgaccaacacacttgaattgaacttctttcctggtcagggatctcctagagaatggctatcttggcaggaatagactagatgtaggtcagacaagaaccacaggggtactgccagtgtaaatgagtttcctatgagagggacacctggtaatggataggatgcttaggcattagactgtctgctgggataaagacgtatcccataaaagatacgctgtaaacacccatgaccacctctcctgcatccccatcaggcagagctagaatttatattcactctcttgagacagacctcaagaccatgttagaagaaagtacaacactcatcatcctagaattatgattattccaattcagttcatccaaggtccctttaaaaatgcattggttaaagagtcagttaatattcttttttttggcatggtggcatgttggatgttgattttagtactaaaaataaataaataattacctaagtgtgtaaaataaacaaaaggccaaaacatggactggtgatgagaatggtccaagaatgaaagcattatagttaattaaattctgactgccacacaaataacctaccctgtttcacttcctttaccagctgttttgtatttcattttgtacatgaacatagtttatttacacgtttgcccataaatagaaatctgggctatttactctgaccaaggagcacacaaagagatgaaagatgacgtcagtgttctattagtggagtaacagattggatttatgattgctcattgcaacttctttagaaatgatcaaatcaaataaaagagtgtcagcataaaccaatgatgatgtttcatgaagcagagatcatgattaatccaattaggttcattagaaaaagttctagaatataacctaagagtattttctagtattgcccaatggaactttctttctttttttttttttttgccttgagacaggtctcactctgttgcccaggctagacctccctgtgctcaggtgatcctcccacctcagcctcctgagtagctaggactacaggtgtgcaccaccatacccagctaatttttgtattttttgtggagacagggtttctccatgttgcccaggctggtcttgaactcctaggctcaagcagttcaccggccttggctcccaaacagctggttacaggtgcaagccaccatacccgtccgcagtagaactttctgcagtgatggaaatgttctgtaatctgttctgtacagtatggtagctactagtccatgtgattattgagtccttgaaatgtggctggcgttcatgagtaactgaatttttaatattacttaatttttattaatttaaatttaaatagtcacatgtggctactggcccatgcaagtctgatatccagtggggcagtcaaattttaaagctactacattagtcagttgtgttaggtggttggttcatggcagttttttgaatattaaatatgaatacataaatacaaaagttaaataaaagcctaagcatggaccagtgatgaaagtgtgtcatgaaccaaatattatatccatacatttctcaacagatgaagtccattatgtaaaggtttctgtttctccagttatggttaaggatgaaaagattatctatctatctatctatctatctatctatctatctatctattcatctatctatctattatctatctatctatctatctatctatctttctatctatctacctacccacctatctattatatatctatctatctctataatatactactgtttttcttggttttgatggtagattcgtggtgttttacttgattatgttataaaaatcaataagtgaatacatttttaaaattcaaagaccttaaataaataggttatctgtcttctatatggtaaatattctatagacacgaaggtcacaagaaccactcccacttacaaaaagaataggaggcactgagcagtgccaccccacggc

SEQ ID NO: 78010 - DNA, 2574 bp, Homo sapiens
tatttaaaagaggacaaacatagatgaataaagttaatgtatcattaaaaatgttcatataaataaaaggggactagggttctgcacactgtggataaagaacatagagtcagttatttgtaataatattgtaggccattttgcattttccttgaagaaaataaaaatactaacaaattattccatgagtgaataaaaaataaacaaataaatggattcataaattaggatcaaacatggaccattggtgaaaatgtgttaagaaatggggacataaatttatccaattctaatcaaggaagacctataaaaaagatcaccttggttcttacctatgtgggtggggcttaagtgatagaatttggaacatgcctagttttttattattttttttagggcacaggtttgggagttttcactatattgcctaaattagtaatttaaaaagtcaataaataaaatcagggccattcttgggctaatgatgggaatttgacaaaaactggagttttttttttccataaatttggtacaacaggacttaggtcccttaaaaaaaatctaaatctgtgctgcttcttgaattttctaaaatctagtttttactccacattctgtatgccagatctgacttatttgttatccaatgatggagatcatggctgtcacttatgtggataagaagcagagaggcacgttaagtaacagagttcttgttcttgctttgaagggggctattcatgttgtccatggaattaattcaagggaatgaatggctaccacaaacataaatagaattaaaaaatgctgagagagtggatgtgaagtgttctcaccacaaaaatggcaactacgagaagtaatggttatatcaattagctagagttagtcatccgacaatgtatatataattcaaaacatcatgtcgtatgcgataaatacacataattttatctgtcaattaaaaataaaataataaaatcaaaaccaattaaacaatgccatgcatgggcaaatattgggaatatgtaatgaaccataggttaagatgaattcattttagtacagctgaagtcccttacaaagatgaatttattttggtacaactgaaatcccttacaaacataattggagggggttgtattcattttcacagttgcttaatattctactctattgtgcaccgtattttaagaagatttctctattgataaagatctaggctttttcattggtggggagggagcacctacaaatactgaacaaattgccagtgttccagttgtggaatgaggtgatagggtgttcattgtactgctattaagttatgagtaaattaagcgaaagacgattgagcaaagagcagtagcacacgggatggttaggaagcaaggttatcgattaattataggcacagtctgaggcccaattaaaaagagatctcgtctaccagctctgtgggaaacaagcctggaaatagcattctgcagcagtcagaggtcttgttcttgggtttttgtgattcatggatattaaattattttgtgggtgaaaccatgaatgaaataatatgcataatcaataaacagtgcataagtaaatacatgaggaaaaagtgagtgatgaatagttctgtggcatatgaatcattaattttgattaaaccctaaactctgaagtccattagaaagagaccttgctcttctctgtaagagagtggaattcagagtaaaagttcagtttcttgggctttagtgcttcctaggtagggatcataaatgaatcgatgaatgcattaacaaagaaatgtgtaagtgaagataaagactgtcatatgtggaccatttatgagagcatgtcatgaaacaagtatttctaggaatatatttgtagaatactgaatttcaatataacatataggcaaaagctgtcatttggagtacataggagctgcagacacgcagaagcacatggacagatgcatctaagtgtccatgttggcattctggattggtaagaggttgctagctgtcagcttattgagaaggaaaaatatttacacaaacaaaagattacatgactgtaatagaaaaggagcaaatatgtgccaatttgaggatgtgttacatgacaccagttatgatggatctaattgtatccactgaattttataaaaagcgacaaaaaatggcaagggatagagtcggttatttctatgggttgttttgttttgtgttcaagttcaagtgtagagtctgggatctctggtaattatatattgttttttaagttgaatgaatataattatatctcaagggccaactctggacagtgtggagcatgtgatgtggaataaagcttatgactaatcccgttctaccctactggtgtccttatagagaaagtaggatctaggcgcttctaacttgggttaacttgggttaagttcatagagagggatcatagaatatttcagttctgggctgctggtgggtttaccatattttattgagagagggccaaacacgaaccaatattcagaatgtgtcgtatgaccagggttataattaatcc

SEQ ID NO: 78011 - DNA, 1986 bp, Homo sapiens
ttgtccagataaatagagctccaggttgcccctgctttggataaagcacacattgaaatttccatggagtaattctttagaaaaacagatatgtaatttattccatgcataattgtatatatgagtaaataagtgaatcactagacatgtaaatcagaaagattttgcatcattaatgagaatatgccataaaacaaaggtttacatttatctaattttgcacaagtgagatccactaaaagtgatcacctatctggtaaatttatggatctggagtatgtagacagatatttatgatagatatggctcttattctcatgttgatattcattgtattatttaaaagcccaaactacacaagtcaataaataaggagtgccatttttgggcaatgatgagatgaccgaagtttatgattaatctaatactgccaaacaaatttccattaaaaagtctaactgtagggtctttctttctcttgaaagtatgtattttacttcaccaaatgagcacattatggtgaagaactgatttagtcattctctaatgctaaagatcttgccttttacttctgtgggtaaggagagaagagatttatgtaagtaacaattagtgtttactgttcttggattgggaggttggttcatgggtgttgcctgaatttattaaaataataactggatatattaataaataaaactaggtaacaccaatatgtaccagtgatgagaatatgttcagaattgggatttatgattaatctgatttggtactagtaaaattcaataaaaaagatacagggtatttcattcattttcagagatgattcagattgttttattattgcgttgtgattcagttaagtacctctccattgataaagatttaggctattaattccttgagggaggagcacataggaagatggacagtgttgtcagtgttctagttgtgcagtaagattatgattccttggtgattcattataccatatttggcacttgaaaaaggaccaaccgtggaccagtgagtagcatggagctgacatgaaagaaggaagttgattaatttataagtgccaaaagtgcatatatgtatatatatgtatacaaactcacacacacatatgttgcagaaagtgacttccatctattagctctttggtcaatggacatatatacaatcattagtattcacagatgttgttcttgagctttttgattcatgagaattgattatactattattattaatgaatcaatgaataaagaaataaacaatgcataaagtatgtcaagtatagccaatcattagtattctgagctgtaggaatcaaagattttgattagattctgtaactcagaggtttattagaaaaaagaaactagttatttcgtctgtgggaaaggggcttacagcaaaagttaggaatagccaaagatctgattctcagttcttcatgcctgtgaactgtatgagaagtgaaccaatgcaagaataaagatgtagaaattaatgatggctaattatgcaagtctttaatgaaacaagggttattactaattattgttattttctgaagcactgagtttcataacataaatagattaagtgtcccttactattttccacaaaagacatatctaatttcacgagagtccctgttgtaattttggattgatgttgggttgtcggttttatttagaaaagaaacaaatcatttacattaaaagtaattgttccaataattgcctaattgaaagaaggccaggtgtggactaatactgagaatatgaccataggtcttattaatccaattctgttcactgaacattatctaaaacaacaaaaatgatctagccatttgtatttttgggcagtgagcatacaaacagatattagtcagtgttcttgtccattgtcttggcttttattcattttgatgtattgtaaaaagtgaatgaataaatgagtttgcgtttcaat

SEQ ID NO: 78012 - DNA, 1582 bp, Homo sapiens
tactcaagcagtcctgaggaagagtctatttgtgaagaaactgtggcttcccgcaatcagcaccaactttccagccatgtaagtgaagcagacactctagcacagtcaagctttcagatgactgcaactcaacctgacatcttgcctgcaacttcacaagaaaccctaagctaaaactgcccccagtaagcctctcctggattcctgccacatagaaaccgtgagaaatgacaaatgtttattgttgttttaatccattaaattgttcagtaattcattacacagcaaaagataataatacaatagaatgaacaactgtgaaccaccatcttaactcacaatgaggacactgacactatcttccttttcctatctgcttctccctagaggagtgaatagccttgatctttaactttaaagaaatgtgtgtaaatcaaccacggcacaaaataaaatacaatattaaaaacctctgaaattaataaaagccctccatcatttgtaatggacctaagttgggctgaattaaactaatcataaaccttggttcacttccattattggttcttgtatggtatgctttttatatatgtatatatttagcggtttattcttctaacataatttagtgatgaacaagccacctaaacccaggacatgaactttaactattatctacaacagactctgagctccttaaccacagaggcaaaacaccaatgtctttattgttatcgaataattagctgtggcatgttcattgtgtgaaggaaaatacacattttagaaagaacgaaacagcaaagacttaacttcttttagaaattattttagattaatcataaaccttggttcctaacacattctcattattgactcaagaataaccataccttttatgtatgaatttacttactgtttaattcttaatataatgaacccttaaatccacccaatgcaagagtaataaatgtaaccactaacaactatctatctgtatactccctaaccacatcaacacccaaacctcattaatttttttaaggcaccatatttgagcatttctgagagtgtgccatgaagcaatgatccaagatctaccttaatttaagcatttactgactcacttgtgttctttcttttatttaattacccccaaaataatttgatcatttattcattttttctaaaaaaagaataaaaacaaacaataatcaagaagtgaaataccatttcatgcaactgttgacacgcactttgtccaaagtgggatccatgtagatttcttttatttttcatctgtaaaaatgggttaattgttatttttgtttgatgacactttggccaatcctccatactcttttaaataattgaaacgcaaactcatttattcattcactttttacaatacatcaaaatgaataaaagccaagacaatggacaagaacactgactaatatctgtttgtatgctcactgcccaaaaatacaaatggctagatcatttttgttgttttagataatgttcagtgaacagaattggattaataagacctatggtcatattctcagtattagtccac

SEQ ID NO: 78013 - DNA, 1716 bp, Homo sapiens
ataatggaagtgaaccaaggtttatgattagtttaattcagcccaacttaggtccattacaaatgatggagggcttttattaatttcagaggtttttaatattgtattttattttgtgccgtggttgatttacacacatttctttaaagttaaagatcaaggctattcactcctctagggagaagcagataggaaaaggaagatagtgtcagtgtcctcattgtgagttaagatggtggttcacagttgttcattctattgtattattatcttttgctgtgtaatgaattactgaacaatttaatggattaaaacaacaataaacatttgtcatttctcacggtttctatgtggcaggaatccaggagaggcttactgggggcagttttagcttagggtttcttgtgaagttgcaggcaagatgtcaggttgagttgcagtcatctgaaagcttgactgtgctagagtgtctgcttcacttacatggctggaaagttggtgctgattgcgggaagccacagtttcttcacaaatagactcttcctcaggactgcttgagtatccttacaacatggcagttgatgtcccctagagcagtcaatctaagacagagaaaggtggaaccctcaatgtattttataatctagctccagaagtcatacaccatcatttccacagtattctgttggtaatacaggcggtcatgatttaatatgtaaagaagctacacaaggctatgcataacaggagcatgggccttgggagccatttggaggctggctacctcatgtactatctttaaaatatggacaaattaaataaaagaaagtctggatgaaatattaatgtgagattggtatgaagcaaggaagtgtagttaattatttgtataatgcttggatccattctgaaaaaatgcagtatcacttctatggaaaataagcttatagatctcagtaatattcaaggatcttgttcttagttttttttgatttgtgtctattggctttgttgttagtgattcaatgagtgaaacaataaacaaaggtatgaatgaatgaataaaaaagaaatgctaggcctagaccaatgatgagtattctggggtgtctgaatcaatgattttgattaaaccctgtaactctgaggtccattataagaggagacctagttaatacctatatggtaaatgatattatagtggaagttagaattatttgggattttgttcttaggtggttgaagttcataggtgtggattgtattactagaaaagatttagtaaatgaaaaatgaaacaaatatgtaaataaaggaagacaagtagagccatatgttgcctaattatgagaatgtataatgtatttattattattaacacacttctgaagcactcagtttcaacataaattgattaaatctgatacctatttgggtaaggaatatacatacagagacaagtacctagaaatcagtattgtttgtcctgcattatttagatgttgctgtttcttaatgaacacaagaaaatatgatctagtctgggaatcatgagcaaatgacaggtgttaacgccattcatatttctgatgcaatctgtatgttcacagatattgatgatgtcatgagtgaatgtatacacaggagtgaatgtattcagttatttgaggaaggtaaagcagtgtttcttgactttggctctattgacattttggg

SEQ ID NO: 78014 - DNA, 1992 bp, Homo sapiens
ataggaattgaattgaacctgtaaatgggtttaggtagcatagacactttaacaattttagttctttcaacccatgaacacagggtatatttccatttatttgtgttttcttcaatttctttcactagtgttttatagttttcagcatacaggtctttcaccatctaggttaaatttagacaatatttttggtgctattgtaaatgggcttattttcttcatttcaagttaattacctattaggatatagagtcactactgaattttttttgatgattttctatccagcaattttactgaagtcatttatcagttctaacagttttttttttttgtgtgaggtagtttggattttctgtatataaaatcgtgtcatcagcaaatagagacaatctcacctcttcttttttctataaagatgccttttatttcttcttgttcttctaggataagtctacttttcttccacgtaacaaccacaggatagatgacattcattttctaagaaacaaaatcttggcagttagatccgtggggtaaagaatatagatactaatgtaagttaacacctcaagttcatgtccttggtttggatgctttgttcaggagtgtttagtggtatttcaaaggaatcaatatctataacaaattaaaataaccaggaatggaccagtgatggaaatgtgttccgaaaatatgtttaatataatttggcacaactgaagtgataaaaatatagtagttagaccatttatattcacaattatttaacattgtatcttattttctacctcaaatgatttaatcttttccatattggtatggtcctggccgataactctttgtgtggcagcctgagagaatatggaagacactgtcagtgttggaagatggtggttttatcacttttcattgcactgtctttaaaacatgggcaaattgactaaaagaagactacagaagaaataatggtgattgtgaatttggtatgaagcatggatgttaattaatcacacatgttctctgaggtccattgtaaaaggagacctagtcttcagggagagagccactaatggggagatcttattcctagaattttgtggttatattattattcatgaaccaatgaataataaatgaatgatataaaggaagaaaaacgtgcttggaccaatgatgagtaccatggggtatctgaaacaggatttttgattaaacccatatgcaattctgaggtccattacaaagagacacgtattattccttttttgggaagtgagcctatggtaccttttccttggactttgtggttcttggggatggattgcatttttgttataaaatcagcccatgaattaaaaatttatcaatgagtaaaacataaagcataagtcatgtacttattatcagtgactgtaatgaaacatggattattattaaaacttatctgagactcccaataaattaatacccaaggcttctaccattctggtaaggagcatatggtcatttgtatgcaagagtcagtttttgttctgtgttggtggtgggttgctgactattttatgaagaaaatgaagcatctttaatcatataaatagttggttaaataaccacttaattgagaccaagcagagaccaatgatgagtgtattaatctattttttaatggatttttattaaacaaataataaaagaaacacagtctattcttcctgagggcaataactctagacagatgtaaatattcttcagtgttcttgtccagtgctgtgagatcacagatactgatgtcttttgtatatgagaaggaacttgcatttttatgtctcagtttatattttagagtcagcaaaccatggaccaattaggaacaaatgttatgatatgagaatgctgattcttgtttttttttttcatgatagacattctaagaaaaactctaggctctctcattgtttttggaatacatacatggttctttccaagtag

SEQ ID NO: 78015 - DNA, 3605 bp, Homo sapiens
tcatataattattattcctgaaaccatgaatgactgagtcagttcaacaaggtataaatgaatgaagaaatagaatgcctagcctggatcaatgatgagtattggtggaggtgtctgaatcaacacttttgattaagccctctgtgtaactctgagatctgttattgaatgagaaccagcctatattctctgtagaaattacctaatagaagttaggaaaattcaataaaacttgttcctgaacttttgtagttcaaagatatggaatgtattattttaagtgaattcaatgcgtaaatagagaaatgtgtatacatgagagaagattaacagtcctacttatggaactattctttgagtacaatgaaaaagtattataaatattaacactggcaataaaacaagtataattattaatctgaggtaaaatcctattatacagaacatattgtatctgcagttgagacaatttttttggttttatagtttgctttttttttaattaagaaaagggaaagtgtttgcatcagccagaaatccattaagtaatatctacttaacagatttttatatagacaaatattcataatcattacagatcttattcttgggctaggtgacgcattagtgtctattatactatttaaaactaaaagttcaatactggcctgaaaaaattgcatttttgagccaaggtttattgttatctagttctgcttgactaacatccattgagaaaaccgtatatctattctaaatctgcctttttccctccagagtggacataggccagctgatttaataatttaagaaagaactgttatcctgagtaaggagcatagagacaaatataagtaagttccttatttcaagttctttctttgaatggtttgtttttgggtgttagctaaaggatttcaaaggaatcaatgtctacatacgtgaaataaataacacaccccaaatgcaccaatgatgggaatgtgtaatgaaccatgaattatgtttaatctaaatcgtcacaactgagttgattataaaagaagacaaaagttaacttattctcagagcagctcaacattattctttatttcatgccatggttattttacacgttcccttatgggtagagatcctggctgacatccgttttggggcagcgcatgagaatatggaaataggtgatttcgttgttttttatcaggccatcgttgacatatgtatgaattaaatagaagtgggctatatcagaacgaatgctgaatgtgaactgagagcatgcaggggcattgaccaattcacatgtgcacctttacgtgtcatggcctaagaaatgtagtctagctctatgggccaagagcctaaaatttaatgatcttgttttggggatttttgattgtatcgttatttgtgagtcaataggtcaatcaatagatgaaaaaaatgcacatcatggaccagtgatgaatatcatggggtttctgaaacaacatttttgattaaacccatctgcaactctgaggtccattacaaagagacacctctttattcttcatggaaaatgagtctaggaccttgttcatgggccttttgtggtttgagggtatgaattaattattataataaacttagtccatgaatatagaattttatcaatgaatgaagaataagaaaggtatgcatgcacttacctactaaggcatgtaatgcaacatggattattattgaaacaattttgaggttcttagtcccaataaattagtggctaaggctctattcattttggtaaggagcatatggtcatctgtgcacaagactgaatgtttttgttctgtgttgaggcaggttactggttgatcattttattaaggaaaaagaaatacatttacataaataaatagttgactgagtaactgtaattgagagagggagagcatggaatgatgatgagatctatatacaacgacactcatgattaattcagtcttttatggaattttacttaagcaaacagacaagtttggtactagattcacagcgtttattatattatctaaaacaaaaaatttcatggtgagagatatttcatcttgacaaaaacaatttatgtaagttaataaatagaagtgttctctcttctcaagtgttcagaatagggtacaaaacaaggtttatgattgtttactacagagctatgattcattttaaagagctaaacatatagtatttgattctttttaaaatttgcgttttatgctgcagaatgaacgcactctacctgatttaattatagtcttctggtgaagatcttgctgttatctctgtgaatcaggagagaagagattgatgtaagtaaaaatcaaactttgtgttctcgcttgggaaacttgatcaagtttattcattgaattatttcaaaggaataaaaggctacatacataaatgagtcaaaggtggttatgcatggaacaatggtagaaatgtgttatgaattaagaattatgattaatccatttcagcacaacgaaattcattaggacaaaaagttgaaaggtatttctgtcattttcagaatgccttaatatgctgtttttgtaccatagtggatttaaatacttccccattgtgattgttattgacagttaactaattgagggaagaacataagaaaatggaaaaccttgcctatagctgtggtataacttggtggttataccatgatataaccatagtaacgtcttaaaaatacggatgttaaatgaaaaaagcccaaccatggactaatggaatatatggaattgacgtggtgcaatttgtggaatgaattaattcacctttgcaatactgaggctcattacagagagagccagtcctctagttctgtggaatatgaatcttacagacatagttacttcttcaaggatctttttgccctctaattcatggatagtgattttactattagtgaatcaatgcctaaatcaagaacagtataattgaattaaagcacagaataccaagtctggatcaatgatgagtatgcgtggggcatctgaatcaaatattctgattataccctgtctgtatctctgaggtccattgcatctatgggaaatgtgcttggagagaaagttagacatattcaaggaatatgtttttggtcctttttggttaatgggtatagattgtattataagtaaatcaatgaatgaataaagaaaaatacaaataaagacaaggaaggcttcatttcattcaattatgaaaggagctaatgatgttttgagtttatataagtctgctcctccttcgagagcatatagatagatatgcactcagtgttccgagttagtggcaagtttctggttgcgtgtcttgtttgatttagaaagggataaaacatatacttaaatgatgtatttagtttaataatacttaatataataaatattagccaataaaattaacattcatattcaataataacaatattgcaaatcatgctaaacacattaacataatttttataataaacaacaatttaatacaattaataataaacactaaaatactaatgattaggttgtgaaatgtggagaaagtct

SEQ ID NO: 78016 - DNA, 2473 bp, Homo sapiens
gtgagaaatgaaaatgaaagttagtctttttctaaactactgatgctgtcttcctggttaggtgtgggaatatagacattgaacatgaaaagcatttctgttgtgggttcttcatgagtttactgctctgtgtgtgtgtgtgtgtgtgtgtgtgtgtgtgttagtatttgtgaatgtataatgaaatattccatgcgtcataacataaacaaatcaaaacaataaatgaattcatatataagtagggtaaagcatttaccattggtgataatatgccatgaatcatgaatttaaattcatccatttctacacatgttgagtccattaaataaaaaagatgatctaaagcggttgcctgtgtaggtgtctatagacagatgtgtgccatagtcatagtttttgttttgggtgatgaatttaacagtgtttattgtattatttaaagttaatagttaaatcaggaaataaaaataagtgcagttcttgggtcagtgataaaaatgggatttgaatcaactttatgattaatttaatatcacacaactaatgtcttttaagtcaatctaaatctgtactgttcattcttttgaaaatttgtattcaactccacagaatgaagaccatggttgatttaatcagtctctgctgatgaagatcttggctgttacctttgtgtgtaaggaagctaaagacttaagtaaataacagtccaaaaacttgtcaattagggtaaatttttcattaatgttcactgaattatttaaagttaaggcatatgtagatcaatgagatgaatgtgttatgaaacttagattgtggttagtccaattaagcacaattttggttaaaaataagatgaaagacattttattcatttttttatctgattaataattcatcttattttgtactgcatttaatttaagatttattcactaataaaatctatggctgcactgttcaatgtcgtttcctctatccacatgtggctatttatatttaaaataattaaaggtacatgcacttttaaatgtaatttcttggttgcattagccacatttctagtgctcagcagctgtatgttgctattggtgactgtaatggagaacgcagttacagtacgtttacattatatgcaaagtcctgttagacagctctttaatgagggaggaatgcatggaaaggtggaagataagtggaatgagatggctaggaagcaaggatgttcattgatctatacttgcttcactgtgggccactacaaaaggagatctagtctattgagaatagggctagtctatgcgaaaagagcctgtaaacagatcttggttatattcaaggatactgtttgtggatgctaaaataacaatgggtattgattttattactgctactgaatcaatgaatggatcaataaacaaaggtataaatgaaggaaaagattgcttatcctggatcaatgatgagtaccctggggtgtctgaatcttggattttgattaaaccctataactctgaggtccattacaaaaagagtacttttcattatgtctatgggaaatgagcttattccagaagctaacaataatcaggatttagtttttgggcttctgagtatggactgtattatttttagtaaagaagtatatggataaatcaagaaaagtacggtataaataacagaatggttattcctgctccaaatatgagagtacataaaataataggaatcattactaatacgtttctgaagcactaagtcccagtaaaataaattaatcaaagctgaccctttgggtaaggagcagttagataaatggatgttagagtccatgttgttgttctgcttgagggtgttcatttttttttttttaaagaaaagggcaaaatgtttactttaattattgcttaaattactacctaattgagagagagtttacacatggatctatcttgagaatatgtcaaatgaccagttataatgaattctaataatcttcactatttaaattcagttcctcagtttaatttacgaaagcaaggaaaatgatctgaattttctgtctaatgagcatgggatgggcattgatattgtccagtttctgtgaagtcacagacataatgattttattataaatgtaaaaaggaacaaattaatgtctcaatcagttattcaaaataaggccaaatcatggaccaatgagggccaggtattatggaacaaaaagagtgattaatccagttccatacaacagctctccagtattgtcattatttccataaacaaaattgaggtaggctcttgcatttttggaatggtgaatatgtttatatatttggatagtatttccctttcagtctcattggtgcaatttccttaaaacacggaatagacatgcctccatgtgtaactatttaactttatatgtatgtgtgtatgcacgcatacacaattgttgagaatgtactcgaat

SEQ ID NO: 78017 - DNA, 1566 bp, Homo sapiens
tattcatagctatttattttatgattacagcactattaatgaattgattaatcaaaaaacgaatgtagatagacatgaatgaagaaagatagagtcaatcttggacctatgatgatgactggtggcgtatgagtcattgacggtgaatacaggtctggaagtctgaggtccaatataataaaaaatctagtcttcaccttctatcctagggatagacattaggaatatttgaggatgttgttcttggtcttcacgttcatgcattttccctctatttttataattggatcaatgaatcaataagcaaatatattttaactgcataaagataaaaataggcgttgtccaattatggaaatatatggtgaaataagaaatactattcacatttattaaaaacactgaggtcttctttctattaacaaataaatgactcagaggtattactcgcttgctgcaggatggcatatacagtaaaaataataataacgtatgtgaggtcatttgggtcaggaccatgttcatggttgtttgttttctcaagaaaaaatagtttcacacatacttacatgactaatagaatgaaaggagaaatgtgtggataaatggacagaatatttccatctttttatcttttttgctttgtactctcacaatgaacaccctcaagttgacttaagcacccttccatggtcatgaggtttctggttgcctctgtgtgttagaagcttggagaccaatgtgagtatagtcaaagttcttgtcttggttctgggtttttaaggggtagtcattgttttattaagaacattacagataatccaaaaggttaaccatggtccaggggtaattatggcattgccatgaaacattatgttgattatctaatatttataaaattaaaaatgattaatgataaaatcactgtgagagatgatcctatagagagctatacagtatttcttgttcttaagtttttgtaacattatttaattactattagtgaaaggatgaattaataaataaacaaatgtagaagtaatggagaagaggagggccagtcttcagtcaatgatgactctgcctctgttgaaaataccataccctatagacagatttaagaatacacaaggctcatgttcttggtttttgcattaatggattttgattctattattataaatagatcaatgaaagaatcaataaagcaatagaaacacacatgagtaatgaaatcatcgtacaattatgaaactatgtagggaaacgagaagccatttatatatatatggaaaaagtctgttaagaaataaatgtttcaaatgtgttacctctagctaaggatgatatagaggatataaataatatagatagataaaataattaataaacaaatataaataaatctgaataagtgaagtactgtccaattacaaaaattgtatgagtagataaaagaaactattcatatatattgaaaacaatagagtctattatgaaatagtcaatatacaaagaaacgctcttgatttgtgtcagtgtcaagatcaatgttgtttgttttct

SEQ ID NO: 78018 - DNA, 1090 bp, Homo sapiens
tggacgatgaatactacgtgtctgaaactctgaggtccaacagaaaacataattggatagatatcagaaatgtgcaaagatcatattcttactttggattaatagattgaggttcatcatcaatagataaatgatagaacaattaaacaagaataaataaaggtgaatcattgttcaattatgaatatacatgatgatgtaagaaatattatcactaaaaattttaaacacagatgccccttaaagaaatggatcatgagtcccgccactgcactccagcctgggcgacagagcgagactccgtctcaaaaaaaaaaaaaaaaaaaaaaaaaaaaaagaaatggatcatgagtatcagctctttggctaaggttcatctagactcttaataagtaagagtcagtttcattttctggttaagtctcatttgacattgttccttttgttatgagagaaaacatttccattctgaaaaattaatcaatataaaaataactgaataacagaaatatggaaaggatcaatggagataaggtttgaattttttctaaaagagttacctgctctttgtattctgcagaatggatgcacttgagccgacctaagcattcatggtcatgagatttgtggttgccactgttggttaggagcatagagatcagtgtgagtaataaagttcatgtctttctctaagagactttttaaagggtattcataatatcatgaatgtgtgaaaaattatccaaaaggccaacctcagccaatgataaatatgagattggttgaaacagtatatttgctagctcatttatgacacattgaggataattcatgaaagatatatcaaagtggcagattatatagaaagttgtggaatattctatgctcttactgtttggatattatatttacatgggttataatattaatattcatgaattaatgcataaataacatgtaaatgagaattaagctaaacagtcctaagcctgagccagtgatgaaaactggtggcatagaagtcaaggatgctgaataatgtgtgtctagaactctgaggttcaatagaggaggaaatatagtctattgc

SEQ ID NO: 78019 - DNA, 1283 bp, Homo sapiens
aaatattgtgtagattaatagatattttaaacaatgaacatgatgaatgaaggaagtattaatatactaattgaagcaaatgattatgtagacagatactaggaatacttaaggatcttgtccttaaaacttggtgatccagaggtatttatgttattgttagtgaactaatgaatcattaggaaacagcttacaaataaaaggagaaaaagagggccaattctggctggattgatgatgaccactggtggcctatgagtcatacaatgaatacgtgtctagaactctgaggtccatcacaagcagtatctagcctagtccctctgtctgaaaaactcctgtagacagatgtcagggaaatacaagaaccttgttctttttctttatgtttatgaattttaaaaatattatattattaaaatagcaacgaagaataaacaaacatgtataaatgaatatagatgaggatgaagtattgtttattgttgaaatgtgtagtaaagagaaacaatactaatataaattgaaatggttggataattaatggaccaagtgtaatacatctttgactaaggatcatatagatagcagtaagtaatggttagttgcaagtttcacatttgttgtattaagaaaaaattaataaatactcaaatgactatgtaaatgaatggtgaaaaatatagattaatgtaaagaatattcaattttttaatcatcttctctgctttgcacttttcaggatggatgcaatgagctgatcattttgctgtgatcaaggctatgttgcctctgtgttaggccaatgtgagtaatggttcttgtcttggtttaggttgtttaatggtattcctgatattattaaaaattatttaatataataaaaagttaattggcttaatgacaatgtgcaacattgaggttaattaatgaaagagatgtagtctctgtgggaaattattgtatagacaaatgtaaggattcttcaaatatcttgttcttgggttttcaaaatcatgtattcattttattatcaaagaagaaatgatttattcaataaatatttagaaatgaatgatgaaagagagacccaactatgaatcaatggtgaccactggtggcatataagtcatggatgatgaatatgagaagaaaagaatctaggtttttgcttctgttggaaatgatcctgtagacaatgtcagaaacatacaaagatcattttcttatcttggggtcatagatttaggtttattattactaatatatgaatgatagaacca

SEQ ID NO: 78020 - DNA, 1905 bp, Homo sapiens
tggttgagtcgtgtttatgtagaaagaatatacaaattatgtgaaaaaaggctaaggaaggaccaacgatgcgagtggaatacattctgaaatgtgttttatgatcaaaatatctgtgacctactgcggtccactacaaagagggatttaagtgtttatatctgtaggaatgcctacagatagatttcagtgatattcaggaatcaggttctcagtctttggtgcttcatggattttgattttgttgttattcaataagtgaaagaataaataaatatgtcagtgtataaaaatgaatagaatgaagttatctaactatgaaagtatggggtgaggcaagaattattattaatataacatagaaccactggagttcagtaagtaatgctatctttaccccaaaatgtaaccccttaatgcatcaaaggggttacattttggggtaaggataagtaagcaagattgtgatgtatgttcttgctttgagtcagtgatgagttcaagtggccacttactgcagagggaaaaaaataaattatgccataaaataataaatacctaaatgactgagcaaaggaaatggggaaggcatgtatcagtggaaagaatatctcagctttctgttatttgctgtgcttatattcctcagaatgaaagctcctaggtgatttaagcattctactgtggccatgaactcttatgtgttaggagcatagaaaccaatgtaagagtcaaagcacgtgtcttagtatgagtggcttgtttaaaaatattcactgtactgtttacaaaatgtttagtcaaagaagttgactatggtgtactatggcattgatatgaaatgtatgttaattagtggatatatacaacacaaattaattaatgaaggttatatttgctgagtgaatttactctgtagacagttatggatacttaagaatactgttctgtggaatttgtggttcatgtacatttattttattgtaattaatctattgaagaactaataaatcaacaaatatagaaatggatgaggaaaaagatgtcaaatcctgaactagtggtgatggcttgtggcatatttagtcacagatgatgaataaatacatgcctgagactctgaggttagtacctagacagagatctagtctgttatttttgatggatgtagtcctgtaggatgattagttatacacaaaggtgatgttcttggacttttgtagttcatgagttttgattgtattgttacaaagcaatcaatgacaaaatatatacaattgcatgaagatgaagagggtgaaacattgtccaattatgaaatgtgaggtgaggcctgaaatactattaatataatttgaaagtcctaaggtccataagtaaataagtggatcaagggtgtcacctctttggtacagtatcatatagaccaggggtccctaacctcagggctgcggaccagtatcagtgcctggtgtgttaggaaccaggccacacagcaggaagtgagtagcaggggagcaagcattaccacctgagctccgcctcttgtcagatcagtagtggcattagattctcataggagcagaacctgttgtgaatggtgcatgccagggatcaaggtcacatgctacttatgagaatctaatgcctgatgatctgaggtagaacagtgatctggaaaccacccctccctgccctggtccgtgggaagattctcttctacaaaacccatcctgggtgccaaaaatgttggggaccattggtatagacagtgataagtaacagtcagtgttattgttctgcatcaatggcaagtaccatcctgtcctatttttagaagagacaaataataacatcaattagtaaacatttacgtgaataaataaatgaaagttggaaagccat

SEQ ID NO: 78021 - DNA, 1027 bp, Homo sapiens
tatgattaatgaaatgaaatttccttaacagaaaatgaaattaatatgaagtccaaataacgattgcataaatgactaattatgggtgaaaagcaagaaacaatggtgacaatgtctcaaatttgttttcatcttctcttctctgtactcatcagaatggatgtccttgttctgatttgaggatgcctccaaggtcacatactctgtttgcaccacgcttaggaaggagcgtgaagaccaaggggagtaatagtcaaagtccttacctttgtttgggtggtttgtttaagagtaatcaacgtattatttaaaagtgtgaaatacagtcaaagatggccaatgttattccagtgatatgggagtgacatgaagtattatattgatgatgcatatataaaaaacaggatagttaatgaaacacccaatgtttgagtgattctgtatactgatagggaatatcaagagtgttactgggttttgtgaatcacgggccttgaaagtattattaatgaataaatgacataatcaatagacaaggtagaaatgaatagcaaaaaaaaagaagatcaatgatgactactgttagtgtatgagttacacatgatgaatacatgtctgaaactctgaggtccatcacaaaagaaatctggcccattccttctgattcaggtgatcctatgaatatacaatgtgtttgcttttggtctttgggtttgttcacttcactgtattattataattggatcaatgaaataatttatacgtatacatgtacgtatatgaaggggatgaagtattgtccaattataaaataagtggtgaggcaagatgtattattattattatattaaagcattatattaaagctttaatatattaaataaaaatctaatattaatatataattaatgcaatatttaatatatattaaatatgataacatattaaaatattatattaaagcattgaagtcctaagggaaataaatggtaccccactgtaacgtctttgactaaggatgatacag

SEQ ID NO: 78022 - DNA, 1024 bp, Homo sapiens
gcacagtgaatatcatgtgtctggaactctgaggtccaatacaatgggatctggtccattcccccttataaatagatgtcaggatacaggatatagaaggatcttcttcatgatcttcgtgctcatgaatttaaaaaaatattattgtaaaagaatcaagggcaggatgaataaatcagtgtataaatgaagaagataaggaggtgaagcattgtttattactaaaatacgtgttaagaaaaatggattttaatttaaattggaatggataatataggcatggatgaaaggtgttatgtcttggaccaaaaataacatagattgtgataggttatagttattactgtcagttagttgcaaccttgaagtctattttattaataaatattaccattaattaataaaagccaaagtgacaatgtaaatgaatggtgaaatgtatggattgatgcaaagaatgtctcaatatttttatcatcttctccactttgcactcttcagaatggatgcactgagctgattatgaatttagccctgatgaagacttgtgttgctgtcatgatatgaaagattccagtgtgagtaacagccaagttcttgtgttgtttgggtggtttgtttaaggatatttactatgttactgaaaataaaaaaagtcaaataatgtgtatgtatatataacgaatattggtgatagaattgaattatgtgaaccataaaatttttataattattatacatgaattactgaatttatcaacaaataatgtcgaattgcatgaagagaaagtgggcccttcctggaccaatgatgacaaataccggcgtatgagtcttggatgatgaataatacgtgtctggaactctgaggtccatcagaaaagaaaaccagttctttctgctcatgtattttcattctgttattataattggatcaataaaagaatgaatcaacaaatatataactaaataaagatgattcgtgtgaagcattgtccaattataaaaatagatggtgtggcaa

SEQ ID NO: 78023 - DNA, 1108 bp, Homo sapiens
gagtgttgggtgatgaataatacgtgtctagaactctgaggtccaacatacaaaacacctcaataagcaaggatcagtggaggaatatctagtttaaaaaaaatcatcttctcttttttgtactcctcagagtgataatctcgaggtgatttatgcattcttccatggccaccagccttatgattgcatctgtgcgtcacagcttagagatcaatgtgagtaatagtcaaagttcttggtgtggtttaggtggtttaaggtattcactgcatcactaaaaagtgtgaaatataatcacataaggcctgctgttacaaatgacaaatatgaagcatcatattgattaatacatgtgtgaaatgctgaggataattaaagcaggagatacatggagatgagatggtaatatgtacagattaataatatcaaggctgttcttggggttttgtgaatcatagggttttaatttattgttagtgaactaatgattaaatcaacagacaatatagaaatgaatggagaaaaggatgcccaatcctggatcgatgatgaccactggtggcgtatgagtcatacatgatgaatatgtgtctggaactctgaggtccttcacaaaagaaatcgagtctttctgttcatgcattcttatgttattattatgattgggtcaatgaaagaatgagtaaacaaatatataagtgaatcaaggtaaaatgggggaaacattgtctaattataaaaacttgttgtgaggcaaggaattttgttaatatatatagaaaacactaaaatgcaaagagaaataaatggtgcataatggtttattttggcaaaggatgatatggacagtattaattagataatgtttttgttctgggtcagtagcaagttcaaaattgttcattttaagagaaaaggaaataaatatactccaagtaatgattgcctgaattaatgattaaatggaagatgataagcaaggatcaatggaggattttctcattttttaagtcatctgttttgttctgtactcctcagaacagatgctttagaggtgattcaatctctcatccctgctcaccagcacgttggctgcatctcgtgttag

SEQ ID NO: 78024 - DNA, 1005 bp, Homo sapiens
tggtgcctatagttcattttatacatcatattcttgaaaaatgctagagagtagatgttaagtgttctcatcacaaaatgataactctgagatgtaatacatatatcagttagatagatttagttattccacaatgtatatatacttcagaacatcatgttgtgcatgataaatacaagcaattttatctgtcaatcaaaaaattttaaagtattaaattaatacacagttaaccactgctcaataatgagtatgactgaaacagtatgttgtttaatttctcatgtgcaacattgaggtcaataaatgaaagagatctagtctatgttgaaggtgactctgtagatgttatagatattcaaagaccttgttggttttgtctgaaccatgtatttgtttttattaatgtcaataatatgatcatttaattgataaaaatgtaggaacccatgaaggagaggagacccaatcatggaccaatgatgacaaatggtggcattggagttatggacgatgaatgatatgtgtctgaaactctgaggtccaacacagcacataattagtgtattctctctgttgaaattgacttacagagaaatgtcaggaatatatagataatatctatgtattgattccatagattgatatttattattaccattggatcaatgatagatccattaaactaatataaattaatgtataaagaacaagagggtcaagcattgtccaatatgaacatatgtgtggagtcaagaaatattactaatcaaaatttaaagcactgacattcatttacaaataaatggataaaagatattaccacttttagtaagaataatatagaaattgataagtaagagttgattttattgttctgggttagtctcatgatagaagtgttcctttgcgtaagataaatacacacacacacacacacacacacacacacacacacagtgaacaaataataaatacctaaatgacctagtaaatgaaatacag

SEQ ID NO: 78025 - DNA, 1109 bp, Homo sapiens
gaatgtttgccttaattactggctaaacggtagacacaaagcagggaaccattgccataaggtctcaaattttttatcaacagtcctactttgtacaccttagaatgggctcacctgagttgtctcaagcactccttcatgccctcaggctgtacagttgcatctgtgtgttaggagcttggaggccactgtaagtaatagtcaatgttcttggcttgagtgcttttttaaaggatagttactacagtattaaaaattatacaatatataaaagaaggccaactgcagcccagtgacaaacatgaaatccatatgaagtagtatattgattaattcattgaattaattcatttaagaaaactgaggatatttagtaaaggagttacattgacctgagaatgattctatacacatattagggacatcgaggcttttttcaggttttgtgcattatagcactttaaacatattattagtaaattgctgaattaatcaataaacaatgcagaaacaaatgaagaaaagatgggccatttctggaccaatgatgatgactggtggtgtatgagttaaaggtgatgaatagtaagtgtctttgttagtggcaagttcagagtcgtttgttttaagagaatatgaaataaatatattccaaataatgatgatttaagtgactaaatgaaaggtgaaaggcaaggatcattggaggaatgtctgaatttttaaatcatctgttctgtttatactcctcagaatggccccattccagctgatataagcactcttccatggcatgtgcactatggttggttctctgtgttaggagcacacaaaccattgcgagtatgcattcatttcctctctttacaaggtgcagtaagttggtgtcagtgatatacaagaatctttgtgttcatgcatttttttttttttttgagatggagtctctctctgttgctcaggctggagtgcagtggtgtgatcttggctcactgcaacctctgcctcccaggcatcatcattggtccagaaatggcctatcttttcttcattcgtttctacattgtttattgattaattcagcaatttactaataatatgtttaaagt

SEQ ID NO: 78026 - DNA, 2585 bp, Homo sapiens
catagactgggtttgtttttggtctttgtgctcatacattttcattctatttttattattgggttaatgtgagaatcaataaacaaatataaaaataaagatatattggttgaagtgttgctcaattataaaaataggtggtgagacaagaaatactattaatatgtattggaaatagtgaagttcaaggaggaataaatggtacgtgtctgtcacctctttggctaatgatgatatagagaggataattatagacagtgtttttattctgggtcagtggcaaattcagaattgttcatctttttaagacaaagtgaaataaatatactgtactctaaataatggtagcctaaatgactaaagaaatgtgaaaagcaaggatcaatggtgataatatgtcaaatttgttatcatcttctttgcgctgtactcctcagaacggacatccttgttctgtcttgagaattcctctagggtcacatgctctgtttgcaccgtgcttaggaaggagcgtgcagaccaatgtgtaatggtcaaagtccttattgtggtttgtttaagagtaatcaatgtattattaaaaagtgtgaaatacagtcaaagatggtcaatgttatcccgatggtagacatggcagtgacatgaagtattaatataatactgaggataattaatgaaacagataatatcaatgttagaatgattctggatacagatcagaaatatcaaggctgttcttggagttttttgaatcataggctttgaaattattattagtgatttaatgaggcaaccaacagacaatgtaaaactgaatagaaaaaaggagggccattcctggatcaatgatgaccactggtggcgtatgagtcatatgtgatgaatacgtgtctggaactctgaggtccaccacaaaagatacctagtccattccctctgttttacatgaatctatagactgatgtcaggaatatagaatgaagttgttttggtttcattttcattctaatgcaagaatcaataaacatataaataaagataaaatgcgtgaacagtgtacaactataaaaatatgtgttgagcaagaaatactattaatgtatattgaaatcggtgaagtacaaagagatattgtacatacctgttacttctttggcttataataatgtagacagaataaattacagataatgttcaaattcttattcacttgcaagatcaaattgttctttttcttaggagaaaatgaaataaatattagtccacctaatgaatgcttaaaggacaggctaaaggcaaggtgaaaagcaaggatcattagtgagaatgtctcagttttgttaccgtctctgctttgtattcctcagaatagatggcttgtgctgatggaaggattcctccctggtgacatgctgtgtctgcctcttgattgggagcacgcagacctacgtgagtaatcaagttctggtcttagtttgggtggttgggttaggaggatttgatgtattattaaaaagtctgcactgtaatcaaaaatggccagctgcagcccagtgatagaaatgggagtgatatgaagcgttatattaacaatacatgtttgaaaaactgaggataattaatgaaacatttatcagtgtgagaatgattctatatgcagataaagaatattaatattaatgctgttctgaggcgtttgtgaaccaaaggttttcaaattactattagcaaattaatgaattaatcattagacaaggtaaaagtgcccagagaaaaataggacacattctggatcgatgatgactaccggtggcgtatgagtcatatgtgatgaatacgtgtttggaactctgaggtccatcacagataaaatctggcttattctctgtttcgaatggtgttacagacagatttaaaaaatatagaatgtttgttttttctgtgtgattatgaagttttcttctatttttataattggatcaatgtgagaatcaggaaacaaatatataataaatagaaaatgattgaaacactgcccaattataaaaatttgtggtaaggcaagaaatgctattaacacatattgaaatcgtgaaatctagaaagacataaatggcgtatgatatagatagtataaattatagacaatgttcatattctgagtcagtggtaattttgaagttgttcattttattaagagaaaataaataaaagaaatataatccaaataatgattgccaaaatgactaataacaggtgaaaatcaaggatcaatgttgagaatgtctcaattttgttatcttctctgctttctgtcctttcagaatgatgcactttttatgatttgagaattccttcatggtcacgtgctctgtttttatcatggttgggagcctgcagagcaatgtgagtagtaatcaacattcttatcttggcccgaatggtttgtttaagaggactcagggtattatcaaaaagcctataatataatcagaatggtcaactgtatctaagtgatagaaattggagtgatatgaagcattatattgataatgcatatatgaaaaattgagggtaatgaaaca

SEQ ID NO: 78027 - DNA, 3931 bp, Homo sapiens
tctgccttctgggttcaagtgattctcctgcccccgcctcccaagtagttgggattacaggcgcccttcaccacatctgccaattttttgtatttttagtagagacggggtttcaccatgttggccaggctggtctcgaactcctgacctcaagtgatccgcctacctcagccttccaaagtgttgggattacaagtgtgagccacagcatccggccagaagcactcttaatatcttttgacacagcgaagtccacagagatataaatggtgtcttctggtgacttctgtggctaatgatggtatagacagtacaaattatagacaacattcaatttctgggtcaacgacaatttcagaattatgcatttctttagataaaatgaatatactgcaaataatgattgtcaaaatgactaactaatgataggtgacaagaaagggtcagtagtgacaacatctcacttttgttatcctcttctctgctctgtattccctagaatgattgcactttgctgattgaaggattccttcaagtccatgtgctccacttgcaccatttttaggatggagcctggagacctatgtaagtaatagtggaagtcctcaccttgctttgggtggtttgttcaagagggttcaatgtgttacaaaaaggtgtatattataatcaaagatgagcagttgtatttaaataaacatgggcctgatgtgaggattatattgaagatatatacatgagaaactgaggataattaataaaataaatattcctatatgttaggaatatcatggctattcttgtggttttgtaaatcatagggcttaaagttatggttagtgaattaacagattagtcaatagacaaggaggaaacgaacccaaaaatagaagatcagtcctggatcgatgatgactactggtggcgtatgagtcttttgcgatgaatacgtgtctagaactctgaggtccgtcacaaacaaaatctagcctattctgtatgtttgaaattattttacagacaactgtcaggagtatagaatgtatatgtttttggtattcatgtttacatgttttgattctatttttataattgatccatatgagaattaataaacaaatacaaataaagatgaataaattcgagcattgtccaattatgaaactaagggacaagataagaaacacaattaatgtatatgaaacagcgacatccacagagaaataaacggtacattcctgtgtcttctttggctaatgatggtatagacagaataaagtataggtaatgttcaacttctgggtcagtgacagtttcaaaattattcattttattttcagaaaatgaattaaatatacttcaaataatgattgcatgaatgactaactgatagttgaaaagcaaatatcaatattgaaaatgtctcaattttgtcattatcttctctggtctgtattcctcagaatgaacaacttgtgctgtgttaaggattcctccatgatcacgcgccccatttgtacaccatgcttgggaaggtgcatgcagaccaatgttagtaatagtcaaaattcctgtgtcggtttgtgtggtttgctaaacaggactcaatgtatcatgaaacagtgtattatatagtcaactatggtcaactatgtcccagtgatatttatgagagggatctgaagtatttattgataatgcatatatgaaaaacggagaagaattaatgaaacagatatatctgtgttagaatgattctgtataaagatagggaatatcaagtctgttcttagtgttttgtgaatcacagagtgtaaaattattcccagtgaattaatgaataaatttaaagacaacatagaaatgaatgcagaaaaagagggtcaaccctggatcgatgatgagcactggtggagtatgagtcacatacgatgaatacgtgtctggaactctgaggtccatcgcagaagtcagtttcctctgtttcaactaactctgtagatagatgacaagaatagagaatgaattttttttgtttatgagtttttattttataattggttcaatgaaagaataaaacatatatgaataaataaataagttatgcattgtccaattataaaaatgtgtgatgaggtgtatttaatacgtatttaaattgatgaaagccaaaaataaatctaacatacctaacctttttggccaataatgaagagatagtataaattatatgctattttcgtgttcttggttagtggcaagttcaaagttgttcatacttcaaataacgattgcctaaatgtttaactacagataggtaaaaaggaaagatcaacaatgagaaaaatcacatttttgttattattttctctgctctgcactcatcagaatggacgtacttgtgatgatttaaagatgcctccaaggtcacgtgctctgtttgcaccatgcttaggaaggagcgtacagaccaaagtaagtaatggtcaaagctcttgtcttggtttgagtggtttgtttaagaggattcagtgtattataaaaacgtataatacattataaaaatgtaatatattgtaggaatatattatatatatttctataatataatgtagtataaaatacattataggaagatataatacattataaaagaggtaatacattataggaatatattactggaatatcttatatataaaatatatattataggaatataatctatatataatatattccaatatattataggaatgtaatcaaagacggccaactctttcccagttagaggagtgataggaagtactatattgaaaacacatatatgaaaaatggagaacaatgaatgaaaatatatatcaacattataatgattctatgtagggattaggaatatcaaagctcttggatttttaaaaaccaaagattttaaacttattatcagtgaattgagttaattattagacaaagtaaaaatgcatagagaaaaataggaagaatcctggttcagtgttgactactggtgtcgtgtgagtcatacaatgaatacatgtctggaactctgaggcccatcagaaagtcaatttcctctgtttcacatgattctataggtagatgtcaggaatacagactcagtttgttttaggtctttgtgtgttatgcatttatattttattttataattggatcagtgagaatcaataagcaaatatttgaataaataaagatgaatcaggttaagcattgtccaattataaaaatatttgatgaggcagcaagcactattaatatgtactgaaacagtgatagccaaggaaaaatgaatgatgcatgcctttggcctcttgcgagtgatagtgtagacagtataaactatagataatgtttaaggtatgggtcagtggcaagtttgaaattggtaattttcttaagagaaaatgaaatacacttcaaataatgattgcctaaatgactcattagatgaaggtgaatcatgagcgagaaagtccccttgtatgctctgaactcctctgtgctttgtgctctgcagaatggatgaattgtgcaccttgaaaagttcttccatggtcacctgaggcatctgcgtcatgattaggctccggatgactaatgtgagtaatagttaacattttttacttccttctggtgccattttaagaggactcattgtattataaaaagtgtgtgacattatcaaagatgtccgcctgcatcccagtgaaagatatggaaacgatacgaagcgttgtattgataatgcatatataaaaacctgaagatagttaattaagaggtgtatcaatgttggaataattcagtatacaaattaggaatattaaagttattctcaggatttttttgaactataaagtcttaaaattgctattagtgaattaacaaatcaatc

SEQ ID NO: 78028 - DNA, 1770 bp, Homo sapiens
ttgtaaaaaatatttggtgaggtaagaaacactattaatatgtattgaaaatagtgaagtctgaagagaagtacatgtacatgtctgtcacctctttggctatggtgatatagacaggataattatagacaatgttcaaattcttggttaattgtaagcttgaaattgttcattttttaaagaggaaatgaaataagtttactccaaataatgatagcttagatgactaactaatgataggtgaaaagcaaggattgatagttaaaatgcctctcttttgttattatcttctttgctctgtacttagaatggacgtacttgttctgatttgaggacttcttcatggtcacatgttctgtttgcaccatgcttaggaaggagcatgtgtaccaatgtgagtgacagtcagatttcttgcatttctttgggtggtttatttaagaggactcaatgtactgtgaataaacatgtaatataatcaaagatggtgaattttatctagtgagggatattggagtcaaaagaagtattatattgataattcacatatgaaaaacaggataactcatgaaacattaatataggaattatttgggatatctttttgggttttgtgagtcataaggtttaaagttattattagtaaattaatgaattaatcaacagacaatgtagaaaataacagagaaaagaagggccaatcctggatcgatgatgactactggtagcatgagtcatatacagtgaatacatgtctggaactctgaggtctgtctcaaaagatatctagtctatttcctgtttcaaatgatcctacagacagatggcaaaaaatagaatgtatatgtgtttggttttcatgtttatgaatttttattttacatttatgattggctcaatcagagaatcagttaataaatatacaaataaagatgaataagggccgggcatggtggctcacacctgtaatctcagcactttgggaggccaacacgggtagatcacttgatgacaggagatcgagacctacctggccaacgtggcgaaaccctatctctactaaaaatacaaaaattagccaggcatggcggcatgtgcctctaatccgaggacttgggtggctgaggcacatggattgcttgaacccgggtttcaaaaattgcttgaacctgggaggctgcagtgatccgagatcacgtcactgcagcttggcaacagagcaagattctgtgtcaaaaagaaaaaaataaaaaggataagattaaggattgtccaactataaaaatatgtggaaagacaaaaaacactattaatacatactgaaattggtaacaactaaagagaaatcttgcatacctgttacctctttgaatgagatagacagtataaattttgaccgtattcaagttctgggtcagggacaattccaaagttctttattttcccttcctttcttccttcctttctttctttcctttcttccttcctttcttccttcctttctttcttttctttctttctttctttctttctttctttctttctttctttctttctttctctctctttctctctctctcttttccttccttccttccttccttccttccttccttccttccttccttccttccttccttccttccttccttccttctttctttttgagatggagtcttgctctatcacttagggtggagtacaatgccacgatctcagctcaccgcaacctctgcctcatgggttcaagcagttcttgtgcctcagcct

SEQ ID NO: 78029 - DNA, 1011 bp, Homo sapiens
atccacctgcctctgcctcccaacatgctgggattacaggcatgagccaccacatctggccagttattcataaaaaaatgaaatatacctcaaattaatgaacatataaatgagtataaatgtttatacatttattaatttgaggtatatttgaaaagcaaggatcaatggagagaaggtctcatttttgttgtcatctcttctgctctgtactcagaatggaagcacagaagctggttttaatagttaagagctgtatggtccatctctgtgctagaagctggagaccaatgtgagtaatagtcaaagttcttgtctcatcttgggtgttttgtttaaaggtttatagtgcattaacaaaaaatatgaaatataatccaataaggccatgagtagcccagggataaatatggaatggatgtggaatgttacactgagggatgcttatatgaaaagcatgtcctgtattattaagaaaggtaataatgaggggatatggtattgtgaggatgagtgtatatacaaattagagatatcaaggctcctcttggggttttgtgagtgatagtgtttaaaagttattaatggtgaattaatgaagtaataaataatgtaacaatgaatgaagagcaccagagctaatcctggatcaatcatgactactggtattggatgggtcttcgtcagtgaatgcctatctggaactctgaggtccatcagaaaagaaatatagtgttttccctcttttggaagtgatcctatagacagacgtcaggaatatgcaagggtcttgtttttgctctttgtgagcacgagttttcaatctattattataattcaatcaatgaaggaaccactaaacaaatatacaaataaagtatgttggatgcgactaagcgttctctaactgtaaaaataatttgtgaggcaaaaaaagctatgatatggccaggcatggtggctcacacccgtaatcccagcactttgggaggccaaggtgggtggatcacc

SEQ ID NO: 78030 - DNA, 1005 bp, Homo sapiens
accccatctgtactaaaaatacaaaattagctgggcgtggcggcgtatgcctgtgatcccagctacttgggaggctgaggcaggagaatcacatgaacctgggagatggaggtggcggtgagccaagatcacaccactgcacttcaacctgggcaatagagtgagaagaaaatctatgatatatattgaaaacaccaataccattaggaaataagtggtatgaggttgttatttatttagttagggatgttatagacagtggtaaataataatgaatgtttatgctttgtgtcagtggtgtgactgatactgtctggctatgtagagtaaataaaatatatgttatctcaaataacctatgtgactgaatcagtggaagatagaatgcaaagagtaatgcagataatgtcttaatcttttctgatcatctcttgtgctctgtactcctcaaaataaacacactctggctgattttatcattcttttttaatggtaagatccatggttgcgtctatgtgttatatggtgtgtggagaccaatgtgagtgacagtcaacattcttggtttcagtgttttttaaaaaagatattcgtagtattattaagaagtgttaaatacaatcattgaaggtaaactctggcccatttgtaaaaataggattaatataaagcattatgttgattaatgtatatatataaaacattgaatttaactaatgaaaacattgaatttaattaatgaaagaggtgtattgctgtgagtaatattgacatagacagatataagagctatttaaggattttactcacaagtttttgtgactcttaggtaattattttattgttagtgaactgataaattaatcaataaaaacacgtagacacgaattaagaaaaggaggtccaagcttgagcaagcgatgacagccggtggtgtgtgagtcatggaggatgaatactaagtgcctggaactctgaggttcaatataatagaaatctaatcta

SEQ ID NO: 78031 - DNA, 5541 bp, Homo sapiens
ccaatgataagattgtattataaatcaaggttcatgatgactactgttttgcacaacagaagccctttttaaaagaagagctctacatttttagctctgtgggtatggaatatggagtcagatgtatgtaactctcataggttttatgttgggtggttcatttaagggtattcctgatattgttaaaatggataatatgttaattaataagatggagctccattcacgaaccagagataacaatgtggcataaatcattgtttgtgttcaatttctacgatggttacttcacgtttactaagtcgaaacctaaatctaggtcttttcagttggtaatttcctctttcatttggtaatatcatctacaggatgggtagaccagagctgattaaattattctcccattgatgaggaactttaccttatccctcagagtaaggagaatgtcatataatgtaagtaataaagttcttgagttgggttgttggttcatgatttctactgtcatttaaaaagataattaaattttaaaaggtcatactaggcctatgatgagaatgtgttgtggaccgaaattaatccaatttagcacaaatgaagtgtaagaaaaaatttagctttcccattcattttcaatagttaaatgtcacattgtatgtttgtctcattgattatttaaagactcttctcttgataaaggctgttactcatttatggagtcagtattctagttgttgagtaggatggtggttcaagtttgttcatttgatatctaaaagttgttcaaattaaatgtagaggggccatgtctggaccaatgatgtgaatggaatgcatctgaataaaaattatgatcaatcagtttttggaacaactgaggtccactgcaaaatgaagaactaatatgtaaacctttgtgggaataatgtcaggaaagtttgagaatctagttctggagcttgagagggttcacaggtactgattttatatgattagcagatccacttgtgtggatcaacacacaagtatattcatgagtaaagaaaaagaggttaagacatggaccaattctgagggcatgttgtaaagcaaggaatataattaattcaattctgaaataccttggtccatcaagaaaaaaaacagattaaatttgtcaccactttgggtaagaagcatctagatagaagtacttaatagtcaatgttctgttcttagtttgctgtgggttcccagatgtttgattcattaagacaaaaaaattaaaattaaacaaacaaatacgtgtataactaaataaatgggtgccaagtatgaaccaatgataagggtacttcattattttctatatctgctttgtaaccccacagaacagaggtaacttggctgttttaataattatttaaaggatgaagatcttgactgttacccatgtggcaaggagagtgtagaacagggtgagtcagattaagtttttattcttggtttagccttttgttagagatgatgattaattattatttgaaaagaagaaatgactttatgcagtcataaaatccaagaagaccatgcctgaaccaatgataagaatgaatcctgccaagtgtcatggttaattcattttgcaaaacgagatccatttaaaaagaggtttggtttgctatctcttagattaaggagattataggcagattctagccttggtcaaagatcttgtttttgggttagttgtggttctcttgagttttgttattttattaaaaataataaatagttaaacaagtacaaagcatttatgctagtaaaattacaatggccactcatgaccaatttggagattatatcatgaaacaaggatttgtttaactttggttaactgttttatcactgtttgaggaggtcatggaaagatttaaatgatagtcaatttctcccctctttcttgggagtagattctttgttgttgactttgtttttgaaaatgagtgactgactaaattaatgaacgacaaaaacactagaatggacaagaatattcaaatgatgacatttcatgaagcaagaattatgatcaacacaattctgcttccctgaaatccatttaacagaaaagagtcaatctgttttctctgtgtataatgaggtcagaaacaggtgttaaaatattcagtgttcttgtttttgtattttggtgggttcatggagttgattattatgattaaggaaataagtatatgaaaaagtaaattacaagagggtaaatcatgaaccagtgattaaaatgtgttttgaaacaaagattgtaggtatttcagttctgcactgtggacttttatgaaatgaaaccttaatcttttgtatctttattttaatagtacatagtaccattctgcatatactatggatatattttagacattttctcatgctacttacattcagtttttttcactatctgagttataaattctagtgaattgatttatttggaggtggtggtaggaaacccctatgccccatattttaaaattttctggcagctgatatctaagagagtactaaaatgactaatattaaggtattaatttcagctcaacaagtattgatgctaactcttgtcagaccccatatgaggagtgaaatttatatatgaatttagtctagttccactcattgagtagctctgtgagattagatggagacccacttacaaatgcagcaattcaatagaatagggcaggtagatgggttctctgtgagactagagggagacccacttatacatgcagcaatttgataaaataggacaggtagatgggctttctagaagcacagaaggtatgccttcagctcaatctcagtgtcagttgagttgtggaagagatgactcctgagccagtgacagactcattagtccatagctccgcaaagctggggaccacactcctctccttcactgctctgccccttgtgccttacatggacagcacatgcaataagcatctgttgaatgaataggtgaatacatggtgaataaaagaatggaggagtgaagcagtatatgaacaaatgagtctttgagtagacaaaggaacgaataaatgaagtaatgaaaatgggaatgagtacacgaatgagtgaatggatcaatgataggtccatgagtgactgaatcagtgataagtggataaatgcatggcgagttaatgagtgggtgagttcatgtgtaagtaaaaatgtcacaaagtgaatgagtggatgatgaatgactaagtcattgagcgaatgaatggaagattaataggtcaagtagtcaagaaatgaaagacaaacatgtaaatggatgagtgaatcaatgggtccatgaattcttgaatgaatttatgaattaacagataaatgaaagtcaatgagtaatgagaaaataaatgaatagatgagtctatgtatgaatcaatcaatgagttaatgactcattgaagaaccaaatgaatgaattaatctaggaattagtgagtttactaatgaataactcaaagaaagaggaaacaaccaaataaattaactggataaataagtcagtgaatgaaacaaattatgagcgaatagatagacaaagggatggataattgatggatatattacagctagtgaataaaagagtgaattagtgagtgagcaaatgagtcagtgaatgagtatgtaatcaaggaataaattagctctgggaatgagtaagtgaataagtgaatgagtcaataaattagtgaattagtcacttattgaagcataaggcagtgagtgaatgaactcacactgggactctttccctgactgttcaacagagagtagtcatgccccagcttcacaccacagcataaataactcaatcagagcacccaccctacgctatcgtgggcgtttgtttacatgtcatcactaaactgatgtgccgcaggggccaggaactgggtcaaattattctctgtatccctggtgcctgcccagctctgagcctcggaagagcacagtaaattgttgctgaatgaatgaacgatagctaaaaatacattggcttttttggaaccaggatggcccatctgagaatggtctgggagctgttctttggggagatgtgctgtgtgtcagatggtttgtggcatcctcctacgcaagtctagattctgccttgaatccagcttcctgtgtccagtgccagacagcgagacaggatactggcagttcggactgccctggacattgccccatccttgggcaatgctggcatggcatggtgaaatgaaagccctaggtcttcccgaaagctgcccttgcctctgccaagacaggagatcagaaataacccggtcttgtttttatgcctccagcgagtgggcccactccatgcctttccaagcaaccacattcctccttgctgtagttgtgggacactgggttgaagcaccccttgacctttatctggtagatgagaataacaatccctgtctggctgggtggatgtgctgctttacgggagattatttaatacatgttacataggtagcatggtacctgggaggaaagagatgtctcagaaatgttacatgccagttttcatcatccccacctaacgtagctatatttgattatttcaaatgcattaatttaaaagctctcaaatggatgtgatactcaaattcccctcttccagaagattggagagttcaactgagttctaggaagaacaccagtctggatggtattctgggctagtccagaccttcaagatggcatggcacgcccttctaccagggaacagacaaccagaaaaatgaattggcaatacccacgctctatgtaggacacatacacaagacccacccttcacctctctacccttccctcccttccttcattcaacacataggtattcagggcccactgtatgcctcacactgaccatttcttgtcttctcttgtcttggctggctcctgaccctggatttcatctctcactggtgttctcacgtccttcgtttgaacttggcgattggttcttggtcatctggtgtggatactgccctctccttcgtgaggacttgatttgggcttcctacttcagagcacgccaagtagactcccccttcttagtttggggtattgggacccctattctgactcttccagatcggccgttttccatctgggtgagctccagccccttataagaggagcttaggctgtgttggtggcagggagacctctgaacgctggggttgggcagcaacgtcagcacagaaggcttcggactagactctgaggtttgcttggtgcctggaagctgatctaggagagaggagttaggttgtcactgcccctctgtccacagaattccttggataatgaggcaaaacaacctcagagcattcagcaacttacaattaatttagttttcccatccctcccactggttactcacctgtgctgggcctgacacaaatgtcaccccctctcctatcttcacagccccctgccctctcc

SEQ ID NO: 78032 - DNA, 1081 bp, Homo sapiens
ctggtctttctgctcccacctccactctgttctcttcctgggcgatggagttagagcggtctttctagaatgcatgacccagagtccctgctcctgagagcccgctcatggctcccacaggccccaggatggaggcccagttccttccctcctgccacgcctcccactacatgccccctgcccttgtgtgctgcctggcagagcctccccgggtctccgggcgtgtgtgtctctatgcctttgtccctgatcccctccctgtggtcaccctcccactgctccatagatgcaagacttctcttgcttccctccccaaggtgggctatgttgccccacactctgaactgttacaaggccatgaacttgaccttcattcataacatctgttgtttggtcatgatttgtttaggtgtctgcttccacaaccagaccttcagctccctgggtataggtgctctgtcctgggcacctcagactcccccactgtccagtacacaacccagtgcagaggagctgatcattaagaacgttagttgaattgaaggaatgagtggatgcacaaaaggatagttgtatggtcatactggggcacaaattatatccctggcagagaactggggtccctggcatggcggaatagcacctccttctccagccaactccactttgccttccacctgcgactcattaagagatatgtaaccttaatccttgaaattgcctgggacggagcatgttttcactcaatggcatgaacatggggatttttttcctttcttaaataaatctcactcccccaggaagcttggacaggatgtgggcaatcgaactagctcttgaaactgaacgttttgcaaaaggcccctttcgaaatttgaaaccctgtggccaccggccagagctgagtctggcttgtggggttcgcgggggcctcctgaaagaagggaaggaaagattgaaaataaacctaggctgatggtttgtgagacagaattccgaggtctggttttgcttctctgatgaaacttgagtgagcttggctatcctctttagctcttctttcgaacctttggccgaaggc

SEQ ID NO: 78033 - DNA, 2395 bp, Homo sapiens
tcctatcagcgtgacaccgtgaatgcctctcctcctcgcttccttccagttgcccctgcctggtcacaggcctcatcctccctctctggcccaattggatgccctctgcttgcttgcctcgtctctgactgtatcctgtgggtgacatgcatgcatacccggtaccacttaaaccccccatgggctccaggggccccacttgtggtgtaccaagccactctatccccttggccctgtgtcccttccttttcctctcttgctccagccttacttgtaattcttcagttcacacctccatcatgtctgtgagtctcaagatctcctagcccttctccagacctgttcaagacacccctagcccttctccagacctgttcaagacacccctagcccttctccagacctgttcaagtgcccctttcatcactccccatgtgcagttccatagttgtccatttcacattgacttccatgtatctggagggcaggagccagctctgacccaacttgccattcccaaagtaccctctcagtgaatgtggatgggtccccctgccttgttaataagtcatgtgattgagcagattgtgtgacttgcccctcttgtcttggaaggtcatcctgcccagagcttgtgaaggtgcagtggcctgagccaggcttccaagaggacaaccgtgatgggctctgtgtgcgttgctgggtgagctctgcctttcctggttacactctgaaatacttgtgtacctgtgactaagggccaaactcagactagatgataggtgatcaaagatgggctttgtgacaggctggagtgcctgcgatggcctcagacaggggctggaatgcatgtgcttctcaccaagaacattagcaagcagaggctgggtcatttctgacagctgcttctctgagcggagggcagggctggctagagaagtccctcatctctggtcccacctaagtggtgggaggcgtgttactttgcagctgaccagatgccagcttgagatggggctcagagtaaccttcacatccctgcccgaaggctcttttaaaaattacgtagctaattgcattctattaacttattaccgtaatggagagtgcaataagcaggggccatgtacgttttccccataaaataacctaagctaatggctaacatttattgcacctaatttttacaaatatttttcccattaaaaaagaaatacatgtttattataaaaagcttgaaaaatattgaacagaacaagtgtaagagcaagactctccctagttcccccactcacagatcaccattgccaacattttggtggccagcctccgccttttgttttttttctataaattaggtgtgtacgtgtctgtgtgtgcttaattgagtttatcattgccatcctgtcttttatttccactaattatatatcctgaacatttcccatgccattaagcaattccttatcttgtgctttttaatggttacataggattctagcaaatggctatattgtaattaatttaattggtttgcttttattgaatatttagatccatttagaggttggattgcataagtctgggaggacatctttgtttattcattgtcatatacatgtctggctcattttctgcagttcattctaaatgtggaatgtcgtgtcaaaaggtgtgatcattttatggccaaattgccctcttaaagcttgtatcaacttacgttctcagaattagtttgagaggtacttatttctctgggaattatcaaggttgttcacctttgccaatttgtcaaaacacagtatttcgttcttttcattggcagttcttttattacctgtgataaaaaaaaacatttcccccgatctcttttggttatctgtatctgaattgccagttcaggtttttttcatttttcatttagtttttatttttgtcgaagtcatgcatatgcatcgttttaagagtcagatagttctacatgatcgttgtagagcatcaggcctccaactctcccaactccaccctaatattctgcttaatggaagcaatagtttttaactcctttaactattctcttgacatttacatccatatgtttaagtaacattgtttttctcttctacttcttgattttctttttcttttttgaggcttaggcattatcgtgactttacaactgtagaagatgaggatttgactccttggcctcaccgccccctcctcccttccttctgtgcaccatcctcaatatatttagtacatagttcgggtttgatccaaattgagagttcatctttttatgagagtgtaagcattcctgaaatctgagcaacacagcactacaatttacctttccttcatgactattatttttctcttggagttaata

SEQ ID NO: 78034 - DNA, 4541 bp, Homo sapiens
gtcaggagttcgagaccagcctgcccaacatggcgaaaccctggctctaccaaaaatacaaaaaacttagctgggcatggtggtgggtgcctgtaatcccagctactcaggaggctgaggcaggagaattgcttgaacccgggaggcggaggttgcagtgagccgagattgtgccactggactccagcctgggtgacaagagcgaaactccatgtcaaaaaaaaagggtcattcatatctatatataatgcaatttttgtctgtcactttatctcatctatttcttttcctttgactagatcttctaaaacattatattattgataacagaaatcttgtcttgtttctggttcacttttaagtatggttgcaaatcattttttagttgagattttttaaataaatgaagtatttatacctagttaatataagactttaaatcaggattggagttagaattttatgaaatgcttttttgatatctgcagatatcatgttgtttttctctgttgatctgttgatacaataagctaatgtttcgtaactttgaaacatttttgattgaattctacttgattatggtgtattgttgttttaatacactacaagatttgctgggctaatatttcatttagaattttccaaatctatttgttgttgaatttgggtgtcaaagttatgctgactttgtaaaataaattagggaacattccatctttttctatgttctgtaccatatatgcattatttgaatgatttagtccacgaaagcttgaaagaactcacgtatgtaactatcctgggataagtctttggtaacgtctcttatttcttctgtatttattggattctttaggttttctacgtctttagaatttttgcttctttttctaacatagctcagcgtttaaatgcgcaggcactggaattagacaaatccagtttaagattttggctctctcattttccatatgatggggaaactgtgtcacctccctagttcttagtttcctcacctgttaaatggttaaaacgaaagcctccgagggccctaacaggaccagcgtgaggattcagagataaagtaccttgcactggttctggcacataatgagtgctcaataatgtttttagatattatttatcctagaaaataatagatttttctgagatttaaaaacttattcacataggattataaatagtatttttatactagaattttaatgtatttctatgattacttcacttttgtcattcttaattttgtatgtgcatactttatctctttttcattagatgacctagaagaatatctattttagaggtttctcaaagaatctgttcttgggataacttgtcagttcaactggtttttgtgtgcctgtgttcaaattaaataatatctgtctttattgatttctttcttctgctttctttaagtttgttttatggatttgtccatatatgccctattgttattcttctttaataatgaaaatatttcatggtatgaacttgcttctgttcacaattttgactgcattttcatgtgtcttaatatgtggtcttcagaacattaaaatatttgttataaggcttcttgtttcttcttgttattggaagaaatgattatctgagttaaatgttcaaaactagagctgattttaaaaaattaatttctaattttttaaagttgtaagttgtttatacttttaattcaattgtggttatcttttattgtggcttgagaatgtggacacatacattctactttgggggaatttattgatgccttttttgtgcataatataattgattttgtaaatgatttttgtggacatttaaaagtaggatgtacttgtttataaggtatggattttgatgtaaagacatttagttttattagctttttagtctttatttggattttcttagtaaagaattacataatctataagcaaccgtattttgaatctcaatctaagagtttactggatgtacctggtttttgtttgtttcattacattggttggaactttttggacggtgacctaatgttgatgagatgaaggggcttctttcctgtttttctcatgttctgttaagtttgttgttgcttctagatttgaggtatgttcatcactgacttcttacttatttgatatttttaggactggaagagttttggatacgatgtttctattctttttccttgttttggtgctattttatttctaatgcaaatgttcatgaatgctatgtcattgttgtggattataccttccccctcagagaggtgtttaatgacctgaaatcacagaagcacatctgttttcttttcatttgtgttcctaagctaggtagcctcactttctcatgtaattgtttctgcaaagtgttgtttgaaagttgaactggagacttgcatgttccaaagaattttgctcctcgagagctcaatcttccaggcaatttctaacattccatggatgttctttagttttgttcttttcaaacactcagtcgactgccttaaattcaattatcaaggccaaggactggccacgttgggtccgcctaacgatgtccatgtttatactaatttcttaagtatataggagatcggtgctcttaccacaggtatcagcaactttgtttttccattttccacttatttataaaacaatgggagcaaaatgtaattaaatacttgctttcaaaggcagccaaaccctttattcagaccaaatattacccagaagccccataagtaaaatagatcaagtcagggctgccttgtttcagggctgtgctgtgaccccaagctgttggtgctgggcaccctccttaaaatgctatgggggaccccaaatgcccctgagaataccctttgaaagcctctgcaaagaaatatttaaaattgcacaagcaaactgaaaaaaaatggctatgtaggcaaaactgggggtgccattgactgcttgctggcagtcagcttctgtctgcattccgtggtttggaggatgtcagtgcatgattgtgtgggctgcctgggattccagtgcatggaaattgaggccatcctatttatctgtgccatccctcaactttgaattttcttgagttaatttatttaaattgtgtctcagatagaaaacatatagtttcagttggagtcttttgacccaaactgagcattctttttggaaaggatgtgtaacccatttacgttttgtgtcttatttgtcatgtttgcgcttaaaaacaaaaatgtacttaatgcttgttttatttttttcacccttttttccctgctatcttttgttatctcacagagactacattttttttaaattttaattttctctgtgatttggaaagtacataaccagcttctatgtctgttagtgcttacatttcaatttttgaaaaactacgcttacatctattatttctctatggtaacaaatgaaatagtattctctgactttgccctttgtggaataattaagtttcatattcatctgcttcctccctttcctcccactgttacgccctcccaaacgctaaggaaggtgttgagttttatccctgccttctctactcaccatcccccccagtcctgtgccatgtgctttggggggcacaaatggcctctctctgcctctgtggtctgcccccccgcagtaggtggggctacttactgtttctggactatagatcgtgtagaccttgaatcctaccacttcatgcactctgaattaactgatcaacgtcatgtgggttgagtatctgtttttcccttatccagcctctgagcccctggaaggcaggagcactgagtcagtctcagcctctgcgcaaggcatgctagaaaatgcatcgatggttgagtatccgagagagtacctgagcgagccaatgggaggatgcgtagctgaggagcggatgactctgcggaggagtgggttcttcagggagaggggtgtgtgcaggagtggatgaatctgtgcacctttgcaagaaaggatggatgagggagtggaacagtgactggggtctggggagtgagaagggttgccagccatctgtggtcagcaggagcttccaggcccaagtttggtgtgttgggaggctgggtgagaaggtgggtccacccacctctctagatacccaagaggctagtggggacccaggccaatttctccaggaggacatggatgcttttggggtctatctcttgtactccttccttcctcaccatgctgtggcatgcacggcctgtgctgggaactaggggtacaaagctgaggccagcacagccctttcctgccccagaggagttcccataccaaggggggacctgagtgagttccccacccgccccccgactggagcctcccccttggctcttatgttctagtccctttatgtttagatacctcaagaatccgccttagctcccctcacctacctgccatcttcttggcggcttctctgtatctcacttctttgtggctcccaaccccaccactcca

SEQ ID NO: 78035 - DNA, 3556 bp, Homo sapiens
cgaccatgttcatctgacccatgctccatccagtccatgctccatctggtcctctgcttttaccctacagtgtccactcttgtcctctctcttcttggcttagtcccctcatcctttatcttctaatctaaacttctgagaagttttcctgattggcgagagcctcttgttaaatgctctctgctccttcacaacactttggcctcctcacattttgaaaccaattctctgcaataactactttaatgttggttttccccacaacgctagcagctgcaggaaggcagagactgtgtcttatttactggtctagctccagcacctcacagatgttcagtaaacacaagtttatttctacgagtgaccacatggaaaatgtgagtgggctggaggagaggtgcaggcagggtgctgtggagggtcagggatgcaaaggcctgagttggctgaggtggggtcgggctcgtggaagaactgccatttggttgggcttcagagagatgtaagcagacacggggtctgggtggaggagtagtgccagcaaaggcatgtggacaatgcacggggtatggagggtaatctcttagactagactagctcacacttggagggagcaggggagcatgatgccttgaatgacttcctaaggagttaggacttcaacaactgagttgcagggccccgtctacactggggttcaggactttagaggacaaccgagctgtcctgcagggctgctgagggttctgcccttgtcctttccctggaggctaacaaatcattgctttgcattccattcacatgggatagttgtgccatgaaaggggatggagaaaatcaaggaagacctcctgaaggaggtggagaggttaatcaggagctggaggaacgcactgcccactcagctctgtggtttgagtctccaaaggtggtctagagcatggcgaggaccatcggaacttgggtgagctagggaagtttttacctagaggttgagggtccccttttatatgatgaactgtgctcttggagtgtcccatttgccatgcagaacaaaacactgccctttatcttgatgaagagatagttgaccacataatggccaaagcatggtcagtattgtacattttgccttgtcgcagtctttccaagttgacatggccttcctggaggaattaccacttagggtagaggcaccccttcccccatcaatgccactgccccacattggaggaggggttgtttatgttcaccatgtgcctgcttccaatgccaaatccagcctcagaaagctttctggaagtgacgccaacttcaggggcaaggccctggttctggggtcagcaccattccgtggttcctgaagagatggtagactatggaacgtaggcgttatgatttctgacctatgtaacatggtccactaactctcagtatccaatccatcctcggagggcttcctggaggtgttgccaacttcagggaagagaacacgtggtttagcttcagcactgctccacggcaatttctgtggctcatggttgatgtctgacttgtgcaacaaggcctggctcttctgggcactaaatgcactctctggggagttttctggaagtgatgcaacttgggctcaagacaccggttccagcctcagccgtggttctggaagagatgatttgccatgtggcctgtgcgaaaggagggatttgtgtgagatgggctaccacttcccagtagcctgccagctttggagggcttcgtggagccaatactaccttcagggggacccaccagtccatccttcattccgctgtgtggcattgaagagttgctttcctgtgttgaagttttctgtttataccaatgtccacctctgatcaatcttacattcagtctcagggttttccggaggcagtgccaagtctgggaatgagacagtggttctgtccttagggaggtggttgaccaaaacaactcctgctttgttcatgaagatggcatggtggttactgctcagaatctaatccaacctaagaggacctcctggaaatgcccttggtattgaggcagatatggccttagggcactttttttttttttttaatgcccaagactagagctcactaataggtaagatctgggcctcaggtgcccagtactgtttccttggcctggttagtgtaactagatggatgttctttggttgcacgtgggccattttgtatttctgattttctccccactcccctaaccagctctgttagccatgtgccatgtcctccctcccatctacccactccttcagacccagcacagtgcgcctggcacacagcaggcacttaatcagtatttatggagtgatgaaatccatatcatcgtccacttcttctcagtgggactttcggcctcgaagggcttcctggaggagttgccagttttggggatgagccactgcttcgagcattcatgtcaacccccgaccatgaagacgagactcctggcctgtgtgtgcttgtcgcatgatgcatgtgctgtgctcaacctcccttctggttccacccagctcaaggccttggagggctttctggatgtgtcctgagcctttgtcctcggcatctctgtgtggtacttggagagatagtagaccgtatagcgtacgctttatctgtgacgtatgtaacacggtccactaaccctcagtatcaaatccatccccgaggctcctggaaacaacgctgtcttcggggaggaacggttggacccaccaccacttctccatgacacccgaagagatgattttctgtatggcatgtgtttttctgcatgatgcaaaatggcataatctcgctcctcttaaatcaagttctgccttgggaaatcgcgccatccctggggaggagaccttgattcttcccggaatcagtgccattccatggtgctcaatgacgtggttgactacgctacgcttattcagtagacaccgtgacctgcttcttctcagcgtcaaatgcagcctagaagaagcgccctcaggcaacttcgtggacatgagccttcttccagccaccaccaccaccatcgtgcggtacttgaagaaatggtttaccgtcccacatacattttgaatatgtatgtgggatggtaaaccgcttcttggtatccagcccagccatccaaacctccctggagaaagcctggagttagaggagagccacgggtctcggcatccgccatgccatggcacttggtggaatggtagactcttagatgtgtgctttctctgtcaatgcttgtgatgcggtcttctcctcagtgccaaacacagcctccagtgacttcctcaggacaaggatgacctccaggaaggtgtcctactgcccacgttggcacatccctctggagtaattgaagaaacggtggctggtgccgcaaatgttcatgaacgagggatgtgaaacaggtcacctctcatcctcagagccctcctcagatgacttcaggacagtacgcccatgtaggagcagatatgggtccaggagatgatgccactccaggt

SEQ ID NO: 78036 - DNA, 2616 bp, Homo sapiens
attctcagtatcagccagccctggggcttcccggaggccatgccgacttgagagccaggcctgagtggtagccagggtgcagtgcaggtcaccgggtggttggctgcagacccagtcctttatttattacattggccatttggtccaccagccaagaactcagtaccggtcccacccttacagggcatcctggaggtggtagtggcattggatgtgggtttgtggtcattgccacattgccggtggctggtagttcatgatgcgcattgtgaggctttctggaggtgatagcaggtgaaaggaagagagccaggggtcagcgtcacttcctggtatttgaagatgcggttgaccatggtgtgtacgctttatttgtgacgtaggacacatggtctacttcttctcaatatcacatctcgccttggaagacttccaggaggtgatatcagctttgcggaagagccactgtcctggtgtcagtacggctgctgcttggtacttggagagaggtggtccgtggcgcgttcgctttatttatggcgcacattacacggtcgacctctttgcagtatctaatcccgccttgcaagctttcctggagctaacatcaactgcgggggtgggggccactaggtctgcgctcagtgtgacccagcggggtttgtgatgtgtttgtcttgtgtgtgacgataactcacgtgtggcagccttcttctcagcacactgctctggcttggcagcagggttaacttgcggacaaggagcgtggtgtcagcacgtgcctggatacatgagatggttgaccagagagcacacgctttatttgtgccgtttgtgacctggtccactaaccctcagtatctaatgcccccttggagaacttcctggaagaggtgtcaactttttgggaaagagacagtaaactggggccagctgcactctgttagactctgaagagagcatctgcgaggcgtttgcgacatgtatgccaaatgtggctgagttggactgattttcactccgatctctttccttggagggcttcctagatgtggaggcatccaagttcaagggaaggggcatgctgtctataccatcccaaagtcctccagtgatcagctgacctgagtgtatgcactttaatttacaaccaaggtcgcctggcccgtcacacctcagtctccactgggtccttagcaggacctttggtggagtcagccttgctttggggcatctgtgcctctcttgagtaactgagaaaagatggccctggaggttaaccctaaacgcgatagctgctgtgaccagcctttttatggcatcaccacctctggctgtgatgtcaacttccagacgtgatgtggggtctgctccactggggtacttggatagatggttggcaagcagcatgcatccaactcttggcttcttccggcaaatcaactaactaacgctcagtgtgcaattccatatttaacaggacttccagcactgaatgtcaagtctggggaagaatcagtggtgttcttgtcagtgttaatcagtggtacctgaagagaggttttctgggtttctgtttctttaatgaggacgaaacacacctggttaacctcttttccagtatcaaatcccatcttggaggccttctggtccagacctcagcttcagggaagggcgttactctcagctccagtccactggacagaaatctatggttaaccacgaagcctgtgctgtattattttgactgatgtcatctgttctactaaccccagtgtccaatccgtatttaacaggacttccaggactgaatgtcaagtttggggaaggaatcagtggtgttcttgtcagtgttacttggtggtacctgaagagaggttttctgggtttctgtttctttattgaggacgaaacacacctggttaacctcttttccagtatcaaatcccatcttggaggccttctggtccagacctcagcttcagggaaggggtgctgtggacataaataaggagacacgagcaaatggctgatcactaagcgtgccccatgtttctgaattttgccaccgattgcgctaaccctcaatgtcttatcccttcttaggaggacttttcaatgtgatggcagcctgggggaagacagtgtcaccacgacagtgtcacggaacatgcaggtgagttgtctgtggttgccttcgttgtgctcccaacggatcgtgtgtgtaattcaggctctttcggcatctgaccctgctgtagggggatgcctcgtccttgccacactcagtgatgggcttgaatgagcccagcccacagcaggggaatgccagcatgccctggacagatagtgcaggtgtcctgcacgcctgcccctagcctgcagtttattctgaaaggatgtcctggatataatgacaccttagggaagaaaagctgattctgaggtcaagaggagaccttgggggccctggaattggcccaggttgagacctgtttatttctcacaggaattgtggagttgacttcctttaaatctggaggaatccttgatgtcatgccagcttgaagggagggcattgtcaccagccctgatccaggggaagggagtggatgg

SEQ ID NO: 78037 - DNA, 8446 bp, Homo sapiens
gggtgctctgctggctacggaggggtcaaaggacaggtggcaagggtgcagagccgcagcctggccctgggattttcttctcagacctctgctccggggtccaccttcgggggaaaagagggcacaattttacaactttgtaagaggaaacctgaagttttctgacccctgattctccccagccctgtcaggattgatctaactctctgttgagatgcaaaagagtctggagataacagtactccccccaccatgaaaacaattattgtcaaaggagttttatagcaaacagaaaatccggcccagaattggctaaaacatttggggagctcacatcaggaaatgagattcgtttttatttcttgattctgctgaattggattgaaggcagcagaaggcattaagtgggatttgacctggaggaaggtggcctggcggtgctcctggcttccccgaccctccctccctagccgtgtgtagcaggcactcactttgcttacagcttcctcggtgccatgtatctgtttttggaatcacaccttgcctggaaggctgcttggacccatggccagtgccacacaggggcctgggcaccggctaactgcagacccagccacctgcttcttgaccacagaattcgagatttactcatgagctctcttgacgcactgactttgggatgcaaaccattatgactaggggcacttcccgtggcctggacttccacaaggaaaccctggttccaccgtcaggaaagctccaatacctggaaagaggttgtacctaaagtgttctctgtattggcggaaaatgtttcccgggcaacctcttttcattgtgaaggcttgaagagcttttggctgacttcccaaaagcaacctgggacacgcaaatagaagccatctgacgtctggtctacccagtgccatgtagattcggggaatcttcctggaggtgacaccaacatcggcgaagattcggcagttctgttttgattttttttgtttgttttttgatcagtgctaatcttcgatactcgaaggagaggttgtccgtgttgtcttctctttatttatgatgaaacatacacgggaaacctcttttttagtatcaaatcccaccctggaggcacttcctgttcctgatgcagccttcagggagggacgttgccggctccactctcggtaggcgcaagcgaggctgacagcgtgccatgcgtcgtgggggtgtggctctcaggccccagccatggagggcccctaggaggggaagctgagtttggagaagggcctgtgcttctgtggttgaaggaggttgctcattgtggtgtttgtctatttgttgattcacggtgggtggcgcctcttcagtgtgagatcttgcttggatggccttctggacacgctagcaacgtcattgaagggacgatggtgccatctgctctccagggtagctgaggggatggtagaccggtgacgtgcacttcatttacgatgtaggtcacccgtttgactatccaccagcgcccggtccatctgtgggatgacatcttggtgcacatggcaacttcggagaagatgtgggaggacgtggggcccgtgggactctgcaggattttaggaggggtttcccttcggggccccctcctcctacctcgttaaaatcaatataagcaatcatcagtgaataatctctcttttggtttcaaatcctgcccaggagggctgatagtctggccacagacaatgccaggattgcagaggcctgggcttcagtgccccatcagggaaagtcccaccccacaccacatgctgactgcaggaggtgtgtgtgtgacctggtacaggggtgtggtttatcctcggaagggtttgaggagtgttgtgtgtgtgcaggacagggcaggcgttgggacagctgtggtagtgagggccactttattctgtgctacatgaagagaggctgtctgacaaagcttgccatgtgtttgatgaatgctacgtggcccatctcttttccataggaggacttcctggacatgaagctagattccggcagggccactggtgtcagcagcactcctggtgagtcgtggatgggggactgaggagctggcagcgtgattgagatgagcccttcctgtgttgggaccactcagaatccagccgcttcgtgggcagcgttcagtccatgcttggggaaagggctttgttgccgttgctcatctctgtctgttgttcagctctgcttgccttacgaggccccagatgccctggatgccctcagtgtcagactgcggaagatgtgtcccggctgtgacacgcgcttcaggggagggctgttggcgtcaggtccatggagaggtatgggagtggacatcttgtctgagagcagacattctatttcgggtgtgtgtcttggtccgttcatcctcagtctccctcccatacctaggatggcttgtggagagaaggcctgccctgagggctgaagttgggacccacagctctcaccccggccttggtatgctcccatggctacggcagaggcacaagaaagtaattagaaacgcagaaactccttaaggccaaggctgggaactgctatatttctacccacagatcattgaccagaacaattacacggccgaacccaaggcaaggggcggggaggcccactccacccgggagggggttgtggtgaggtgtgaatgcaggaaccggtgaggatttgccaccaccaagtcagttgtccacgtggaccacctgagaacttgggttttattcattgctcattcatccctccctaacccgcagcttccggtctgccccgggggctcttctccggctcaggctgatcgacagtggtgacgctgtgccaggacccctggtcattccatctgtttgaggcaaatgttaaaaaatcccttgcgctacccattctatgacgactcccttggctcagaggctccatcagggcagacactttgctgtttgtccctaaagggtgggtggtagatctcatccatcttatctggggagttattgtgactctcctggtccctcctcatgtatcctcaggaggacttttaggatgcaaaatcactgtttctgtgccattgtcatattctgtgctactggaggagactttttgttattgagaaattgaacacatcgtgctcacaagcagctccaggacacaatgccacctgtgcagagggggcagacctgttagatgtctcccaggtcttgagggggttgtatgcacggccatatctttgtcaccggttgcccggtgcgcatcaggacccatgtgctctcaggaagcccgcaggagtgataccagccgcggagaagcagtgttgtcaacggtgctgacgtgcggtacttaatgagaagttgcccgtgtttttttcgctttatttgtgacgaaacattcgcggtgcacttctttttcagtatcctattctgccttgaagacgtcttggtttgggtgcaacttcagggaaggcacatgggcccctgtagtggacgctgatcaggacctccctaccccatgtcttttctccttcctaaatttctccttgttttttttttttttttttttttttatgaaagctcccgtcttcccgccgtgtgctttgattgcattgaccctgccccacttcctccaccagcccaggcttaagcgaatctcttgatctcttctcctttgccactgcaattgcttccggaataggcccatgaccccactgggccagtgataggcaaggagatgcttgctgcagcttctgggaaagaaactgtttctccctttcctgtgatagctgccagagtagacactgtctattccattcagctgggaatagacagtgaactttgacgtgagcttcgaaggtcccacagccgtttaaggactgagaggagagggcttggtgccacgcagacacagcagagggagtctgtaccatgaaaggcatcttggagacctagagaagagcctggatgatatcatttgagtccctagatcaaaccctgcctgaagcttgctctgtctctgtactttttagttatatacgtctataaatcccttacttgtttaagccagttggagttagatcttatcttacttgcaatacaaacagatgataccacagtgtgttttccagtgtgactgggaaagcctgcatttttttcaatgatgtgtttctcacggtttgcctatctatcttcagtgtcctatttaaggcagggttttggtggaaggtgacttttcttatggacttatgctttcaaagctttgtcttagtgatttaatttatggttgacaaatgatgcacaattaccgtgttttgtgtccagcaatgggtcactgggtcctctctggaaggcctgatggatggtgggccccagaacttctgccccgattcactctccctcgaatccacctctctctgggaggctgccctgcaagtgatgtggacttggggaagccgttgtcctttcctggcccctgctgtcctttggctctctgtgggttggctgtatttgtcacaactcacacttaactgtcagtgttttagaaccaagccatgcctccagggaacccggagcactttagagaggaggtgcagtggtcagcaccatgcaaggtgcacagagagatgggtccaccgagagccggggctgccttggtggtttgtttctcctgattcgatatctttgtcttcccatctccttcctggaaccatgggctcatggaggagattctatttttgggtccaggaccatcccattttctctgaagtgatgctctccatgagcatttgcagggttgatagtaaacattccgaaagccgtctgccctgattattgaattctgcccatgaagacttcctgggatcccgaagtagagggagtctgggatcggtttgctttatccgtgatgactgtccgcctctgctcagtgtcagcccagcccttcgaagcatgtcccccacctcccctggggtgagccaacttacctgatgcttttaggcttaattgagcataagtttgattggcagcgtctgcccggccctgccctcacgccctgaccctcagtgtcccttcacgcccaggtgtgcctctggcagggaggacgtgctcatctctggtacctgaaaagaagttgcccatgttattttcgctttatatgtgacgaaacaaacatggtgcacttctttttcggtatcaaatatctccttgaagtgcctccatccccgacgggaccctgagcatgggacctggtgtcactacctctcttggtatgtacatggaggatttgtcctggcagcccctcggtgactttgtgtgttggtgggctcagggaccatgctcagtcctcagtcctcagtccacgcccacctctcggacaggcacagttggcgaggcctcaaccacatgccagttccccgctgccagggaggctggggagatgcacttccaggctccattgagaagcgttccccaacatttgagaagagttcagatcatagcagccaagaaaaaaataaaaaaggaagcagctgccacaacaacaaaaacaaataagcaatgaagacccctgcccccatccgctctctccagaggcttgaggggatggctgaaggggacatgaggacatgccatctgggggactgccacccgcacctccacagaagaattgattgggggtagcaattgtggcagaaggcgtccctgtggttctgggagatgggatttctcagagtggtgatttactggagcctaatcctccctgccccgctctttctttacttttcttttctttttttctttcttttttttttgacacagagtctcgcactgtctcctgggctggagtgcaatggcacgatcttggctcactgtaacctctgcctcccaggttcaagcgattctcttgcctcagccttccaagtagctgggattacaggcgcccgccaccaggcccagctaattttttgtatttttagcagagacggggtttcaccatgttggccaggctggtcttgaactcctgacctcatgatccacacccaccttggcctcccaaagtgctgggattacaggcatgagccagtgcgcccagcccccgccccactctttctaggtgccagttctgcctctgagagatgtgctccttgatcaccagcatcagagagatggtgtctgacattggtgtctgccccaaatcgggagcagtgaacaatggctgacggcagaacacatgccttcccgaagacactgctgtccgggtgtccagtccccacattcagtccatccttgggccctggaagagaagaggtttccccagtgtgttcattttatttgtgacgaatcatttttggccactcttttttcagtatcaaatcccacttgaagggaaaggctgtttgagctgggagctttggtggcatcagcagctctctggggtgagtgatgggtgttgcccagagagcatacgcgtcatccccacggccacctggtcctctgaacctcagcatccctgtcccccgaacctcagcatccctgtcccccaggagggcttcctggagctctgccagccagaactagaggctgtgggactgctctccgggctacactttggtactggaggagaggttatctgtgttttttccctttatttatgatgaaaaatatggtgcacttctatttgagaatcatgtgccatcgggaaaggtcagaacccacttctggaaggagatgctaacggcagtccattggtgacactgggaccatgctggcctcagcaggtgcccttcagacagtgggcagctgctccacccatcctttgggctctggcctccctccagagaacttcccggtggcagaaacactttggagaagcagcaccggtcttcatgtcaggacattccatcaagaaaggctgtccaagctgtggcctgcatagtcaacctgttttactcatttgagtgccacctttctaaatgatggggtgcccacttcagggaaggtgcagctgtgggagcagaaggcaggccccacagtctgtatatgacacgtgccacttggccggtggaccctcagcctgaggacctctggaggggacactggctctgagtcccctgtggaaggggaagcacagttgttggatgacgcgacatggacagttctctttcgaccagatccttgtctcccatcgaggggggattctgctctcactgctgcttatgtcaggagagggtcactgttgcctccatcacctcaggtacgtcagaggagggcctcaaggaagccttgcatctctgatggtacgtatccttgtgtgttaacccttgccgtctgtttcctttgcaggaggacaccctgggctctggaagagagacagcaccccagaagccggccaggaatggttggagggaggctattggtgatgtgttcactctgtgtgtggcagataccccacagtggacctcctaaagcactgagtgcctccttgaaggacttgctgtacgtggtgtgaagttcaggaacacagtgtgggtgtctgtcagcccctcgcagagggtatgtgcgcagatggtggaacagctggcaagtgttttcctttatttgttttttcttttgagaattgagactttattgaatgaatcaccatataatcctgtttcctaaggtaaatctatacataaaaagttaggtcctacaccaccaatttcttgttaagaaatggaccaagaaatatgaacaaaaccatgtgtaacacagttttcagagttttagaagaatggcaaaatatacactagcttgtctcttgattgccaaagcttaaactctaaagaatagggaggacataggtatacactggaaaaaaaaatggcaaatacgtgaggaggatgggaatgtttgtgactacatgggaggcaaactgatttttttttttttgagacggagtctcacactgttgcccaggctggagtgcagtggcgcaatctcgactcactgcaagctccgcctcccgggttcatcccattctcctgcctcagcctcctgagtaggtgggactacaggtgcccgccaccacacccggctaattttttgtatttttagtagagatggggtttcactgtgttagccaggatggtcttgctctcctgaccttgtgatctgcccgcctcagcctccgaaagtgctgggattgcaggcacccaccaccgtgcctggctaatttttgtatttttagtagagatggggttttgccatgttggccaggctggtttcgaactcctgacctcaggtgatccgtccacctcggcttcccaaagtgctgggattacaggcgtgagccactgcatctggccagcaactttttgcatctaaaaggtggatgttccttctatgcttacaggatttatggttaatca

SEQ ID NO: 78038 - DNA, 5630 bp, Homo sapiens
agccccgacctgggggaagtggccttgctctggctggtatgtgcagaatgcttgtccatgtagacgtgctttatttatgccaaatcgtgcttgggggcttcgggggatcagacttgcttcctcaacaagctgtgactgcaggggagggactggctaatagcagacaatgggtgttatctggtccactcactgatccattcgccagtaggaggaatgtctaactctgcatgtgtgagaagtagtggttttcaagtacaagacttttttgaaccagttccagctttagagaagtgagattggtgtaggttgtccgtgtgtggaatgtgaatggagggtgggacatggagcatacgctttgcttgtggaaaatgtctcctggtcctcagaactgaagccgttttagcggcacttcctggagtgatggcacccttgcgagatagggtttgagtctgggattattggtccttcattttttgctatgggaggcatgtgttgtcgctattttagtaagcctctgcatccactccaccccaaaaatgatttttctggaagctgtgatcattgtttttggagggtggtattagtggtggtggtggtggtggtggtggtggtggtgatggtggtggtggtgatggtggtgatggtggtattggtggtggtggtggtggtggtggtactgatggtggtggtggtggtggtggtggtggtggtggtggtggtggtggtactgatggtggtggtggtggtggtgttggtggtggtggtgttggtggtgttggtggtggtggttgtgatggtggtggtactggtggtgttggtggtggtggtgttggtggtggtggtgttggtggtggtggttgtgatggtggtggtggtggtggtattggtggtattggtggtggtggtggtggtggtggtactgatggtggtggtggtgttggtggtggtggtgttggtggtggtggtggtggtggtggtggtactggtggtggtggtggtggtggtgttggtggtggtggtgttggtggtgttggtggtggtggtggtggtggtggtggagggtggtggtggtaggggctggtgagcatcatgttttgctacctctctcagttgtatttaaagagacattgtttttgacctgtttgcctattcctcagtctgtcacaccaacatgaccagtcctgccgattgaaactttctggacacaagcttcagtctctggaagattcttgggtgtccttctccctccaaggtatgtgaaggatgctccagcccacagttacatgacattggtcattaggtgccttgggagggcttcatggaggcgatgtgactttaggaacctgacaggcttattttctttttgtttttgatatttttcgaattcaaagcatagaatccctactttgcctgctttacttgtggcaaatttttgatgtacattcactttttttttttttttttttcagaattaaatgctactttggaaacgctcttgaccatgaagcctccattagggaagagacattagggttacccccacccagacgagtgacagcagggcagaccccaaacttacgtttgcctgcataggagttccatctctggatgtgaagaggccaggggtgggccctgcgcttcccacgtgggactcgcaaagtgctcacctgcttctgttaccttctgtctttcatgaatcatgtttgcgtttgtgctctccagggctgttcccacttttcccatctaaaaggtggatgttccttctatgcttacaggatttatggtgaatcatagaggaaaatccgcattttcagtatctaaggctgcttttaaaacatttctgaacatttctgagaggaaggttagctccctcccccatgcggagagtgatggaaggtgaatcccagaacctaagctcttgttagcaaggtctgtcctgggacatgcgtcctccgcagggcccatgtcactgccgctagcccgggaggcccctgccgactgcacctatcctgtgctgtctttaattttgatagattgtgcttaggttcatgctttccaggactcaatccttctttggtatttaaaaggtggatattccttctatgtttatgttatttatggttaaacatagaggaaattccacgttttcagtatcaaatgctgcttggaaacattcctggactgaaaccaccatcagggaagagacaataaagtccccccccccactccagggtaagtggaaagtcggtggacctcagaacatgtgctgaattcgtgccatatgtctgcggaccacccacccgccttgaggagacccctctcgcaagctgcccgctcggccaagcggctgggctccgtcgtcattttctccatgaggccgaatgctctcctctgtgctatgttacttttgtgtttgatggattgtacttaggttcgtgctttccgggatgaaaccttctttggtatttaaaaggtagattttccttctatggttacgtgtttgatggttaatcatagaggaaaatccacgttttcagtatcaaatgctgccttgggatcatggctggactgaagccaccatcagggacgtgaggtggggctgagccctccagggtaagtggaaagatggtgggccgcagaacatgtgctgagttcgtgccatatgtctgctgaccatcacctttagaagccccctttcgctgaggagccagcttggtgcacaggctgtggtgtgttgtcacagctatgctacgggactgaaaacggttgctttactgtcttgcttccattttccatgaactgtgttcagatttgtcctttccagagcccagtccttctttggtatttaaaacgtggatattccttctatgtttacgtgattcctggttaatcatagaggaaaatccatgttttcagtatcaaatgctgctttggaaatgtttctggaagagaccgtagggcctgagtaggtgcaaagatggtaggccgcacgtcgtatctgaatgaacggggtatgcccgagaaccatctcgagacgccaacttggtgaagattaaattgtgggtctcgtggtgccagttcttccctggaagctcgtctgcctcatgtgactttcttttctgatgactcaagcacaggtgcacgctttcctggatggaatccttctttggtatttaaaaggtagattctccttctatgagtacattatttatgattaatcatagaggaaaatccacgttttcagtatcaaatgctgctttgaaaacctcggaggacgtgaagtcgccatggaagaggagatgttatctgtacccctcctgggtacaggacggacagacacagaattgtactttgtatgaaatacgccgtcagcttctctgctgtttgctcactgcccttggtgcacacataatgtgttgttacaaggctgtgttctcagtattgcctcattgaccttgaatgaagtttgttctctgtatgtttaccatgattgcaatgcattttctggaatgaacctcttttactgtgactagttgtaccttagagaatacctgagtgggctgtcaatttcaggaaggggcactgcttcaggggctatggaaggaatagatgtgtgattcacccacgggcctgcacttcacacctcggtgtgctgctctcaccatgcagatcccatctgtgtctctaaggcttgctcctggagctggtggcaacttagtcacagaggaaatggccttcctgtcactgccatcatttgctacttgaagagaggtaatccttcacgcatttgctttacttgcaatgattatacaagggcagactctctctggggagcaaatcctgcctgggaagccttcttgggaacaaggctgactccagcaacctgttagatggccaggatagccctggggtgtggatggttgaccacagggcatgtgcctctgtcttgctgtttgtgacctggttctctgaccctcctcatctcatgcttccttccaagaactttctggaagagatgctggctttggagatgatatagggttttctcttcagaccacctgttctgcctagcaaaaagggcctaccttggccgggcacggtggctcacgcttgtaaccccagccctttgggaggctgagacggtggatggcttaagcccaggagttcgaaactagcgtgggcaacttggcgaaaccccatctctgcaaaaaatacaaaaattagctgggtgtcatggtgtgcgcctgtggtcccagtacttaggaggttgaggctggaggatcacttgagcccgggagttgggaggttgtagtgagccaagattgtgccactgcacttcagcctggctgacagagacccctgtctcaacacaataggttaaaaaaaaaagaaaagaacaaagggcctcccttgatgggccctacttatcacaaagcatccatgggctgctactccggcaggtctgcccagcatgatgccagcctctgagaagaggtctcgtggtcagtgcatctcccagatacatgaaagaatgaccgtcagcaaagtcaatgtctaatgtagatgtgggtcatctggtctacccactctccatacctagcccatccttggagtgacttttggacctcactgtccacttgagggaaggccagtccacaggaaggaggccccagagcacccagtgtggctacaggacttgctgctgggacctctaagccccactgctctcttagtccattggtgtcctttagggattcttgccaatggaaagacccttggattcctggtgttagcatgtgtttattcagagagagttggcccatgagaatctcattttcctttgacgaatcttgccctagatgaatacttctgagtaacaactaactgctcagatggctttctgaatacaatgccaaattcaggagaagggacacttgtcatagtgctgctttgtgatttgcaaacggagtgcgttggatttctgtttctcttttttctttaatgatgcatgtgactgcatcttctaacctcccttagccagtgttcaccaggagggcttcctggaggcagtggctttgggcagaggcagaggttcttctcccagggtgtttttgcaggccctaaagggatttcagccattttacatttacattatttcaaatggtacaggattgcctgtcttttggtaaccaatcctgtcgtgaagagatgctgggaagtaaagtcaactgtatggcaggccccagctccagggccagccagatgaggcttgtcacctggcccctcccccttggtctcaggcctcgcaggaggagatgtccactccggcgaagacccggcatagtcctcacctgctctttgagccactctttggtacttgaagagaggataccctttgtatgttcacttgattaatggcgaatatacagggggagactcttatttgcgtatcaaactctgtcgaggaagacgctcagaccctgctgtctccaggacaaagcctcggatgtcagcccctctcaggtacggcttggcttccctgtctgggaacgtgagcttggctgtgatcctagcccttgggttctgccttcgctctctgtgctggttcttcctgtggactccctggaggc

SEQ ID NO: 78039 - DNA, 7309 bp, Homo sapiens
ccctcccccttggtctcaggcctcgcaggaggagatgtccactccggcaaagacccggcatggtcctcacctgctctttgagccaccctttggtacttaaagagaggataccctttgtatgttcacttgattaatggcgaatatacagggggagactctcatttgcgtatcaaactgtcggagaagacactcataccctgcttgtctccaggacaaagcctcggatgtcagcccctctcaggtatggcctggcttccatgtccgggaacgtgaggttggctgtgacgctgcccctgggttctgccttcgccctctatgctggttcttcctgtggactccctggaagcagtgggagaggagggacctttttgtgtgctccaagtttaatggtggtttgcttttttaaggataaatcacacattgatctgcctcttcttggtaccaagtcatacacagaaggcttcctgttcccagcatcagccttagaagggggacctggatgttggatcatttcaaggggaacacagacagcagtgatggtggaccacggagcactggctctgtctatgctgttttcgagcctggtaggccagccccaggagggcttcctggaggtggtattgaccttggggaaggggctgaggtgtgctcatcagcgctttttttttttgatgcttgggtgttcatgatccagctcgcagtccccaggctgaatctgtaagaatggtttgcttctatttgtcatttgtgattgcccatgaaggcagcgctggggatgagccgtgggagctgtcagccccgcaccaggtgcgtgcatgtgggaggtcagagggcgcctgcttctgcctcgatgtctgtgccccgtctctgactgctggctttctgctcacacctaggatggctgcctgagaatgggactcttgttctgtgtttgtggagacactccttgggccgtgtgactgccggctttttacaccccgactgccatgggggtcatctggacccgaagccagcttcaggaaggacattcgcagcatcctcagcccaaggaaagcgaacgtccagctgaagagaggtgagcaccacgcctgggtaatgagtcacataacctgccacctggaccaggcggctcccgctcctctccccttcttgaaggagagaccactgtggggaatgggctgtgggtctgcttcctcagttacttgggggtacgtggggtttactactgttgaccctgtgctctttcttagcatggcttcatggccacgatgccagcctctggcaggggtggggcaagggctggcatggagaatgacactggtgtcaacggctctgtgagatggatgaagggatggtgaccacagggcctttgctttgtctaaggtgtaaattcatccagtgcctgggacctcggtgctgagtgcatccttaggaaaacttcctggagaggtgcccacactgggaaggagatggtggtcccaccccagggaattcctatagaaagtgagaagctgagctctgcgtgtgcccaggaaggcccgtggggtggatctccttttcaggaacaagttctaatctggagtgatgcctggaaaagaggctgattctggtgaaggggcactggcgtctgccccttcctggcccctttgggatggagagctgacctatgggcacacagctggcaggtggtgtttgccacctggtctgctgatcccgcatctcccaccccctcccccgccaggatgaaccccgggagaggaggccggccccgtgaatgatagtgaggaacctgcccagtgctattgtttggtacttaaagcgaggttgccctttgtatattcggtttattgacatggaatatacaagggcaagctctctgtgagtatcaaaccttgtcttggacccagtccacactcagcaagggatgcggtatgtgtgtgcatgaccgtgtgtatccgttttgtgtgtggcaaatcgttcacgggtccccacttcacagagaggacttcacgggcacctggatgactttagggaaggcagtggcctctgggacatcccctctcctggtgcagtgtgggcggggccaaaagcatgcacgatgtgtgtggtctgggtccctgcttcctgagcgggaagtcatcagcccgggccgatggctggggtggcgctcgtgtggggtagtggctttgtggtccctgctgttactcggtccgtgagtgtgcatgttctgcttggggtatgtgacccggtccactaaccctcagcatctaattcatccccaggaccgcgccttgaagacgtaccaagtccacccaaggcagtggctttcttttccgtgctaacctttggtacttggagagtggttatccctgtcctgttcgttttgctcatgtcgaatcgtacagggtcatccactttttcagtatcaagagcgcagactctggagctcgatttcctgtgtttggatcccacctctgacatttactaaccgtccaaccttgggcaaggatctcatcgtgctgtgcccattgtctcacatgtcaaaggggaatcacattggcgtccatttcttggggctgctggggctgaacgagttaagacttgtacacggctcagagcagagccccgtggtcggcacttcgtaggtggtagccaggacccttgtgtgctgtgaaactatcattggtggtggtggtggtggtggtggtggtggttttatgactaaaatctctccatgggtttttggaacagtgtcaaaacatggaagtcaagtccttcatcgggtatggaatggactaggaagcccagagcatacacggtgtttacaatgggggctagtgatgctcttgatgcttggcagctaagccattcacacagtggcttttgatacagaatgccacatgcagtgggggtcagcaggggtgccgagaacatttgctccacttaagagagacagtccctgggttcttgacctcggccactatctacgctttgaaggagtcttgagcgaggatgccaagctgagtgaggattctatggcatcttgcttccctggtgcttaaagagaggtcaaacttggtgcatgcattgtgcatgcctgtgtgtgcgtggtgtgtgtgcatgagcgagtgtgtgactgggtttgccacgaagcagtcaccatctaaccttgagccaaagacctggaggtggtggtccgtgctgctgtttcatacttgaggagaaattatccttggtgtgttcgctttatttatgatgaatcatacaaggacaatttctttttgagtatcaaatcttgcctcggcagacttcctggacgccatgacaagttctgtaaagggatgcacgcatcagcccttcccaggggctcacgcctgggtggggatgagggcgcatgcagttggtttgtggtggggacacttgtgccctaacctcagaaccctggaggcggggccacgcttggcagggggccacgggactccttggtgctatcagggatttgcattggccatgggtgtgtgttgtgggtgacgcagcattcaagctacttatcaaatcctgcttcttggaggcacttcttggacatgaagcaaaccttagggaccgatcattggggccagacccccttcccctgcccaagagtgtgactgacccccaggcatgggcttgactctcaatgtgtgaagctgacctgctaatcctcattgtttggactacctgagaagaactttctggaagagacaccaactttggagaagatgcccagctcttcttgatggcacagttctttggtgcttaaagaatggctgtccgtagtatggtctctatatttatgatgattaatatcggacaaccattgttttagtatccaaatttgcttcagaagtttttgaaagcacagtgctgacttcagtgaggggacattggtgcctgccccaccatggagtgtgactgtgttgatgatttataatgatgaatccagtgatctcagaatgcaagccaccagtgtgatttccttggacaaatgctagctttggggtggagatgccatttaggggcttggtgccatatctttttattggaagatgttcacaattatttcatctctctttctcttcttgttattaaatcttagccacgaggaattccttggagagatgccggggtcaagcctctctctaggtagatggtggaccggggaacctgggtccagcctctcctatctgtagccttcattctgagtatgaaacacttcctgtagggaatgcaaacattagtaaaaactccgtacatttcctgttactattactactttttggcagctcctaagcagctgcctgttgggtatttggattattcttggtggacgtggcatggcttcgtgccttccttgggaaccaccccatcttagacagactctcatggaataagacgttgtggtcgacagcacctctggggtgtgtgtgtgtgtgtgtgtgtgtttgtgtgcgtgtgcatatgaatagttggctagagtagtgtttctcaaactttaaaaatgctcctaagattttcatcacctagggatcttgttaaaaagcagattctgattcagggaccaagattctgcatttttagcaagttctcaagtgatgctaataccgccggtctgtggacaacactcacagtggtttggggctggagaccaggtgctttccctgtgatatgtgtcgcctgtctccccacatgccatataccgtccatcgtgggagaacggcccagaatcaacgtgccatgttttggtttgtgaacaagggttcactttcacatgcgtaaatagcatgagattacttttctttaaaatcaaatcatgcctcaaagggcttcccagatacaagacctgcttcagggaggggccgccggtgtcaagctgctgcaagattgtcgggtgcaggtcaacggcacgcttattcattattgatgtgctgggccctggaattctgtgaccctccgtttccaagcagtcatcgggaggaaattccaggaactgagaccatctctgcggtagggaccctgtcttcagggatcagtgacaccccattttatcggaaacagaattcttcatgatggctttgcttatctctgacatgcattctgctggttctcgtcatcaaatcccgtctttcaggaatccgtggaggaagctttcatatatttttaatggaacctgccttagaagtctttctgagcatggttccaatgtcagggttttgactttggtgccagggctgcctgggccctgagactgaggtacgggaatggaaggtcaatgccagtacgtgtgctttctttgcaggatgtgaacacctccctgccccaaccctgggattcagctcatcccaagaagaatcttctggaagcaaagacaacggtggggaagaggccatggttttcgtttcagaactatgcaaggatatttgaggagaggttatccgtgttatgttcgcttcattcatcatgaataatacatggttaacctctttttgaatatcagactctgcctcggagggccgcccccacaggagacgtgagagtgtgtgccttgtgtgagctgagagcccctgccccggctccgtgctgcgtgagggaagcttcctggaagtgaggctggtggagggaagagccctgggttgctttgctgtgtttgctgtgaatgcgatgtgtttttgcgagttatgtgaggttccctcctctttgaatgccaacttgtgccttcccccagtggctgggtctgtggcttagccacagggctaggtcccttcctggacccagtgcttttcagggtgggtccctgggggcaaggacaaggtttaccactccactgggacacttgaggagaggttaactcctccatgcggactcctttgaggacagcctgttttcctctcagggtggctccctggatgaagtccagcacctctgtgggtgtgtgaagggcaggccgacttgggctgtgttcccactcctcacccaggtcactggcccagtgccacttcctcctcaggtcagcttccctctgccagccgacctggtggggtctcctggtccattgcttggtgctcatagacactggcacggtgccaggttcccttcactccttcccgatggagaccatgcagctaatgaatcttcggctctgtgatgctgccttggagggcttcctgcacacagcacctggtttgagaggagaacacggactccagcgtgtcccctggttatggagaagggaggctgtccttgatcccccgtttggtggatgatatagtttggctgtgtctccactcaaatctcattttgaattcctttgtgttgtgggagggtcctggtgggaggtaattgaatcaggggagtgggtctttcccttgctgttcttgtgatagtgaatgggtctcatgagagctgatggttttataaggcagagtttccctgcacaaggtctctgtttgcctgctgccatccacgtaagacctgacttgcttctccttgctttccaccatgactgtgaggcttacccagccacgtggaactgtaagtccaattgaacctctttcttttgcaaattgcccagtcttgggtatgtctttatcagcagccagaaaatggactaacacagtggagggcagtggcaccaagccccgcccccttcaggatgtggtccctgtgtggggcagcatcctggagtggctgcaaagccccactgctctctgcctccgtggctttgtcctatctgaggtggccagtgcgctggggtccctgtgtggagtcagttctttatgggtgcctgcaggtgccggcttcacagtaagaaaactgtcagcttcgcctgaggtatgggcacagaggtgacgcagggatatgaactttgttgacgaatgtgttctctgcacagctaacccagagaattcattccaccctcaggagaagccctagaagtgatacaggctctggccgggggacccgatgtgctcgtgtcgcggcgtggggcttggtgaggaaccaccggagtgctcttgcatttttcatgacaaagaccacacagttggcctcattcctgcacagtgggagaatgtgtggaggtgtcccgccaccagagaggaggtctatgtcagcaccatcaccaggtacctgggggagggtctgctgacgatgcccaatgttcaatggcccaagcaacccgtccttgggggacttctgggcaagaccatttcggtgctcagccccactccgtgtcccaggcagagagggggctgaattgatgatacctattaaa

SEQ ID NO: 78040 - DNA, 11719 bp, Homo sapiens
tttgtggcttatcatattggaccactgtttttcaggacaaactccccggagatgtcccctggcaggaccctgacctggaggcagggtgctgtccatgataggggaatggatggttgatcagagaacgtacattttataaatggtgtatgtcagttgatccacagtccctacctatccagtgacttctggaggccacatcagctcagaagacaaggtggtggtttcctaggccatgctattttctggcacttgaaaggaccttctccttgccgggtttgctttctttatgcccagtctcatgagggagtgccttttttgagtatggatcttgctggggaagctttctggaaggagctgttgcccttcgtccctctccaggggcaagaatgcatggttggctggaaagcaagggcttgattgacattgtgcacccctcaactctcctaaccctctgtccccaattcatcctcaggcggactagctggaaggaaggcagactctggtgaagacgtgggccgtcaccgtcagccttcggtacttgaagagtggttatccctgctgtgttcgcttaatttatgacgaatcatacagggacatccagtttttcagtatcaaatactgctttggaaggcttcccggacagcgtcccgccttcaggcaaggggtcttggcttcacctcccacccaaggtatgtatgtgaacgggccatcgcagtgcactagcttcttcatgtgccacagccatgaccagaatcgaatctctgaggaagatggttacttctaaggctgtgattttctggaaggggctttggtgtctgcactacattattgggggaagttgaccagtgagaggcccattcacacaagacgtctgtcacctgctccaagtgaccctcacccttggtaagatgaatctctggagacatgctggctcggtagtgttactgtcatcagccggactgactgataggtaattggtcatcattattgcttttgttccagggcagaatttttgagtgccaaatcttgccagggaagggtttctggaagcagcaccgccctctggggagacttggcatccacatctgttggagtttgtggagagttagttgagcagtctgagctttgtttctgaggcgtctccctgagctcactctcctgccagagctgtgtcctgcccatggccataatggctattgagagggttggtgactttggccaccatgattttgtttcgataaagttctctctttttaaaaaaatcagattcttttgtttatagcataactacatggttcatgagttgatcaaataacaaggaatgacttggtcattccataaatagtgatggagtgcacactgtgttctaggtgattctggaccttagcagagagcagtgaatgaaatcaagttcttgctcatgtggactttacattctggtggaagagacggatgagaacacatgaattaggaagcgtaattttgtccactgctaggttttatggggaaagggaaagcgggttacagtgacagaaagaggtaaaagcaggtggacctttgtgttaaatacaggggtctggaaagctctctctgaggatgtgggtgggaatggagtggggtggaccagaggaaggtctggggtaggagcatttcaggaggagggcaaggcccatggaaagccccctggcatctttaagaaaaagcaagaaggccagtgggattgaaccgagctgctgggagtcgctgggtctgagctgggagaggcaggactccaggttttattctgagtgagatgggggatttggaagggttgtgagcaggggggatgcgtggtctgtgttggaaagatcactctgaccacaagggcattgatagagaatctacccagggcagtgatggggaacctaccaggagcctggcgtgcctgagctgggcagtttctctaggggcacctgcagtggcaaaagggggccccctctggacctccctagttcagtgggccctgcgggagcctggctggcaccttgatgtgcttgatggataactcagtgtgctctgttgagaagtccaaggccctgttcagaaaccctggggtctacacactgcggagtgctcctggcgtgtgacaagtggcttccctcttcttatttctaaaccttgtgcgtgtggattcaggaccacaatttcaactccagggaagggggactgtgccagcaccactccaagggaggtgagtgaagggttgcccaaactccagtgtgttcctaggacacccgtaagctgcctcactaatgctcggtgtccactctgtccacaggatggtggttggcagccactccccttggagaagtggaaggggactccttgtctgtcttgtctctgcttttctgtggtacttgaagagaagttgttcgtggtggattcgctttacttatgacgaatcattcacggacaacacttttttcagtaccaaatgctacctctaaggacttcctggacacaatggcagcttcaggaaagatagtctttgtgtcaaccatgtggaaaagccaagaatggatggcgggccatggacaatgcgctgacctagctgtaagtcacctggcccgataatccgagcctcccatgcacctataggaggtcttcccatgggtctcaccaactctggggaatcagctgtggttctgtcaccagcgtcacctcacaagactttgaagagaggctccctgggccccaggccgacttccagaagagatgttggtgtcagcaccgtccagggtgtgtgactggttgaccagaggggcatgcactgtgttcaccctgtgggccacctagtcaccaaccctcagcatcactcccactccaggaagactttccagagctcccaccaactctggggaagcggccatggacttgctgtgactgcttggtggactgcgatgacacgtgctcttgggggtgtatgtttacttaaaatgcaatgagtcagccttggcagccccttcaccactgtgacagcctccttgaagtgttgacttccgatgtgggacgccatgttgtcttctgttgagggacctgatgtgggccagcttttctcctgggtgtgtgactgaatccttcttcccagagcatgtgctgcctttgttaggtctgtcacgtcgtcctctaatacccagcatcctgtctctccctaggaggctccatggagataatgcggctttgggaagcggccatgattctcctgtcagggaccagtgagctacgcaaaagctccctgtcttgtctggaaggacgaactgcatccttgctgctggggagaaggcagtgccctcagcactcccttaaggtaagtgcgcctcgggtgagcatgcacttaatgtgggtgtatgtcactcggctcggcccactacccaatactatcccacccattcctaacaggactcccgagaagggcggccacctctgccagagaggcaatggatttctcaccagtgttcatgtgtggtacttggagagaggctggccgtgatgaattcgattcatcaaagcgagtcatacacggctctcctctcttttagtgtcaaattctgcctcggagggcttcctgagccagtgctgcttccaaggtaggtttctggatggctgaccccatggcaagcattttcctgaggatgcatgtaactgacctactaactttagagtccaagctgaccctaaaacaacttcctggggcactaccaactttaggaaaatcgagagaggttgttgggatgccctaattttttaaaagttaagattgaaatacacatggctgacttctttttttattcctatcaaattcaaccttggagttgaatcttgggcatctagaagcatcttttattagtcagccgtcgggatacagaagaaaacaggaacaggactctgtgcgacccctggtttactaacccacagcagccttacaccctccagagaattcctgtaagggaatcccaggtttaccaaggaggcagtgcttagcctgcttttgcacacacatttgtgtgtggtttgcttcatatttaatgactcctgtgccactgacatccttgcattattaaatgttgcctgcatggccagctgagcacaagaagtggtatttctgtgcacactaatcctggcttggtgaacctggggttggccggagagcatgggtttgagccacctggtccactcatcctcagggtcccatccaccctcagaggccactcccaagctgcccaggctgtgcagaagatgcaggaatgctgcgagcagtgccacctcatggtactcggagggaggttgtccgtggtgagttcgcattatttaatgatgcccaatacacggtcgacctcttttcggtatcagatctcaccaggtgtcttcttggacctgatgccgatttaggggacaccatactcatgttggttccacaccagtgcaactgaacatgtgtgtggccctggaaccaatgggtaggtgctgctagcactcctaatcctcagccagtgcattcctggggaagaagcatgtgatctgtgctcaagacccctctgtgactgaggaagtggtggtgcccatgatgcttctggggttttgtgtttttttttaaagaaaaacaatgtatagttctcttctctttcactattaaatcttaccatggaggaaggacttcttagacatgttgacaaattcagggaaggggcgttgatttcagcattcttggggactcactggaagggtgactcaccacatctgttgatctggaggccacagcaaatttaagaacagaagacagttgcattttcaatttcttgtttttcttttcaaaaaggataattattctaccttattaccatatttatgaaaatgacacatgcttaataaaattcaagcgatgtggaaaaatctaaatgaaaaagaaggaaaattgcccaattctctggcacccagaaataaccattaagggctttagaaatttcatacacctgtctgagcatacatgcaaatagaaaaacaagacagacgcagggaaaatatgagatcacactgtacctaatcattttattaaaaatgctaactataattttccttgaatttatcataaaaaacaagctaaaggagattgaaatgattgataaatgtttctcgctttaccaccacaggtagcaactcctaaaagatccctgtaaaattaagaaaaattagagtgtaaaaattaagtggttaggattgttatggtttttaactatttcaatttcactcctagttcagaaagataaagaagtcagcattcttattcttcctttgcttactatctcctgctttttctcaattatacattttaattttacattataaatatctgcaatttgttctagaactataattcttgcaggtgttttgccatagttctatatttaaatgaattcatttctgaccacaaggtttgtttttttttaactgaggtttctccgttctttagtttttaagtttaatttatctctcaatggaaatgatcttattgtttctgtgagaatagctcatagacactacccttgagttcctgtgcatttgagagtatatatctctttatgcacaagggacagcttaactaggtataaaagtctcagcctacttgttttttctcagaaatttatagctattgtccactgttttttgcattgaggctttcactagctgtcttaatgtggcttctccatgtagctcttacttacctggactattttatctagcgatcttcacaaaccttgttggaaagactttgaggtactatgttctgtgaggtatttcgtctctgagaatgtctgaccattgctcttacaccttttcccatctgtccatttttttttcattctgttctatttggcctttatgatttcaagtttttaaaatttctttagtcactttaaagatatttattgtataatttctttcagctttagggatacaagcccctttctttgttgaatctattgactctcatgatggtgcttttcttcatggtttttgtagctttgtgttgtgaggttatcatcagttgagcacttaggtgtttctgttttgtttcaatccctatgcacatgagtttgcatttggttctgcctggtaccccaaggaatttaccagttggtaccagtttttcaactcattttgttggcttaaggattcccagacatatggctggcagaagtcctcaccatatctttgtcctgaacctttggtatctcacaggagacctcattctatccactccctaaaaatgacaaattctcttatccctggccattataaaattttctggttcccctttccattcccagatcaacttctcctggatgcacggtcatgtcttttcatcctgcttgtacttgaacttgactgtagacccttggagcctctagccagcacagcatcccttagatcccttagtggcaggttgcatgaactaattcttttcattaacacctgagggttttgcctttcagctgtatgtttatttgggaattgattttgcctgctgttgcattttatccaacacttctcaatgtttgtggaggagagggttccctatcagtgcttgttgctgggatggagcctttgagctgaatgatgggtgaacttggcatgacattcttggctcccagtttcttccctctgaactttgtaaacttgcctccattgctttctggtgttaaaccattgctgtggacaagcctggggacagctgctttcccttggatggatgaactttttttttttcctgcttagatttcctgattctttctttagtcttgaacgttggtgactttaccgggttatgactcagtcactatttttattcattagtttttctgaatcataatatgccttcttgatgagtagatttaatcgttcctttgtttcaaggatttattcattttatgagcacttttctactccaggtgttggttttttctttggtgaaataatctgttttgttcatttcattgtgtactggaggagaagaaagtctgtcatctggccccttgctgccatctgtctgcacgtcagtctgttgtcatttgcactgtgcatttgtctatttaaaacaatcctacccagatgccccctcctcagtgtcaccttccaccctggcaggatgccttatggcaatgccacttctgagatggtcgtgggagtcagcaccactggccaggtatgtgaattttctgctaacaatggaagagtttgaaaaaccatatatgaagtaccattaaccccaagcatgcaatctatccttaggaagacttcctggaaattatgctcacctttggggatgaggccatgattctgaggtcagtgccatgccatggtctaataaagtttgcattcaatgctgtttgtttctgtatgatcaatattgtaaagtcagtctctttgtcatggactcagctttggagggttcctggacacaaggcctgtgtaaggaaaggatcattactgtcagcctcgatgctaatgtgagatgagggaatgtgccctgctctgatccaaatgctgagtttctgtgcacttggcctctccaccatcaggttccctggcagtgctcctttagacatgcacccaccttggcaaaggcattgaggtctggatggctgcagggtccgggatggaatggttgaatacagggcgtgtgctttcttctcaaccctcttgcagtccgtctgctaaccgtcaatgttcactgtctcctagggggacttcctggaggaggccaactttggagaacaggcattgacattgggtctgcgctagcgtgtggtacttgaagataggttatccgtgttgccttcgctttatttgtgacgaatcatacacggttgacctatttttcagtaccaaatcccgccttggagggcttcctggagcggagtcttacttcagggtgtcagctcctctccagggtaaggaaggggaccattgaccatagccgacccagcagtgtgccctggccctaaccctgtgtgtgccccgtccttggggaggtttctagagatggtgccacctttggggaagaagtggagcttttcctatcagagctactctgtggtactggtggagaggtcttccatgatgcattcgatttattttttgaccaatcctacatagtggactcttttgaaagcattaaatctagccttaaagcaccctcgggtggtgccgagtttaggaactagaactggtgtctgaatgcctgaacgcacggcgaagctgacagtgtgcacactcttcttggtgggtcgtgcacctgcaggcgtcctgcttgcttaccatggcagtttcctcgaaagaggcggcagttccctcatcggctcactgcatgtttgacaagacaccgtcttgctgtcttccctgctgccctctcttcatgtatcacagatggtgctctgcagacctctctgctgtggcacttccctccctgaatggcttcctgcaagaggtgctaattgcaagtaagggatggagtgcggcccggaccgcagagcttatttcgtgggtggtgtgttgccaccttcctgactctcagtatcccgtccgtcctcaggcctgctgctgggacgcgctggaagcgagcacccaagtcaggtactcgaatggaggttgtccatggtgtgttcattttatttatgatgagtattacatggccaatctcctttcggtactcaattcttcttgggaaacgtcacgaggggaaagcccagccggcacctgcgcagggtaaggaagtggatcacctccgcatgacaggtgctctctgtgtgacttacatcacttggctcatatcccggccatcattaggaggaattccccgaaatgatgctgacgttttagttgacatggtggtcttctagtcgcatccttgaagactcgtcagtgaataaaccacatttagtcaacctttttaggtgtgaaatcatcttggctgtgtggcacactttagggaaaggaactcctggctgaatggaagacatccacattacgccctcaaataccttatcttctgggtgacctctgggaagcaaggggtgaagggggtttcctcagcagtgagaattaatgttgtttaaagacacatttccatggcacgactcggttattcctactgcaagacgagaattgttaatagcatttattactaccttatgttgccagctgtgtgcccttggaaaatcccttcacctatcagctctctgggcctcagtctcttcctctgtaaagcagggttaacagcggagtggaaacgtgctctttgtgaagtgtctagacagcgtctggcacgtggctgtaggataagcattgtttctgaggatggtcattatatgaatgttatgtcatctgcactcattgtcctctcgccactagaatggaagctccctgagggcagagtccttgtctgttttgcctggtgctgtgtcgccagatgtgcacagtaggtgtgatgctgaatgaatgaataggcagcgtgacctgttttcttggttgaactctctttgaggcctcctggaatggagtgcatggagtacagtcacctgagcctgtgctgtccctgtgacgcagccccacccaccctctgaggatgctgcgctggacgaggagtcgccagccttcaggtcgggtcctccctcaaacccctgtaggctggactgaacacggtcacatggttcattggcagcccccttctctgtgtgaaatcctgcttcagagacttccagaggagataccggctctggaggtggaccttggtgttccagcccctctagggtaggtgaccaggggctgactctagctcgggctgacctgtgatgtgtgtgtgcatagcctcgcccccactgcctgctccagggctacagaagctggtccatgaccaaccatgttctgaccactgcctggggggcttctcggaggtagagagagagagagagcaagaggggagagagcgagccagcaagccagcgagcctgcagctggagtcagcagggaggtcccgcaggcaatgccgcctttggtgaagaggcatctcggtgtgttcttgcccgtgctgatgtttgacccttgagcagaggttgcccttggtgaattcgctttatttatgttgaatcacacaaaggcaacttttgtttgagtatcaaatcctgcttgggatggcttccgggacccagtggcaagctcaggggcatctacacccctcccgtgagcaagaatggacggggtagacgtgggtggtctgccctctgcggtcctctgcggtggatgagaacagatgtcgctcagagaacacaagcttcattcatgatgggggcggggctcgcggcccggggaggatggcgttggtgtcgcgtcggctttagctcttaccctggaccctgtctctttacatcaccattttggctgtgttgatcccaaagacattttgactccaccatttttttttcggaaggtatttgacctcgcggatacacaaagagctcacacttggcagggtctgtgacgagtctgcagccccagacccccgtctagctcacaagcactgtgcttctttctgcacctttccttgtctctatctttctctttctatcccccaaccaaacattgttcccaattttctcctgggttatgaaacaaatagaggctatcagtatctcatcccatttgtattaaataatactgataaaaataatcaacacaaaataaaactaaaaacagctgaaacggcacagtgctaaatgtgttcagttgactacaaattggcagaggaatccaattttcttgacaacatttcagctgtgacatttgacctggggaaatagcaagctgccgacgtggcagccatggaaggaaattcacggtggcggcggtgataaacagtgatatttgatgtagacaagaacacattgaggaatcaaatcttcatgcagatttttaaatggaaaaaattgatcctaatgaaaatgatttggggaaaataacaagggaaataagagaaatgaaaacagctcaacagcgcggtcaggaaagctaaacagggaattggattagtataatggcattggctctgaaaaacacgtttctatgaatatcagtgttggtacaattcttgtgaaggtggttacatttgtgcgtgtttacagtggagttggtggggtcagtaggaacctagggtcaaaaaatgggatacagtctccccctttatgcagttgatcttttcttgctgccccaaaccttcccgagagcttcccggaaaggtgtgctgacttcaggcgtgacacactggtaaggcgtcctcccggggatctgggtgcatgttgtccccagagcattcatacgtaagtgacaggcatcacctggtctccctccatccccacggagggttctgggtgagacgctgactccggagggaagcagaagttctacggtcagtggggtctggtctttcaggacagttgcttctgtgaactcagaaaatctgagacagctcttagttaatttagaaagtttattttgacaaggttgaggatacacccgtaacacagcttcaggaagtactgtggtcaaggcacagcttggctttatacattttagggagacatgagacatcattcagcacatgtaagaagtacattggttttgtctgcaa

SEQ ID NO: 78041 - DNA, 3904 bp, Homo sapiens
agaggcaggtttatcctgagcagcttccagcttgagttttccttagtgattttaggggcccgagataactttcctttcacacttccaaggctattgatgaacacacaggcatccaggaacattctggggttcagtccttcctcagactctgctgttgataccttacatggttccatgctggccccaaggacgtgcccttcgttggtgccgaatgtcatttggtcatagaggctgaaagtcattctggagttgatgtttccaaggtcaaaaaccttgctggggctgtggaaagagctcgttgtttgctggcctgctttgttggtgaccagcattgcacatggctttcttttcagatcaaaccctacctggagaatttccagaagcaacagcaccctcaggaggcggcctgcagccggagccctctccagggcaggtgcctgagggccgcccatgggacaggcccgattgtacccacggtgcatgtcatctgttccactcctgctgactccggtgcgttccgggaccaccttgggaggtgatgcctgccccaggaaggaggctctgatgcaggtcagtgcccatggctcctgaagggaagtcgtctgtgacatcttttctttctttacagcaggcctcgcatggctggcctcttgctccacttgtagcaaggcgcagagggctctctgagctcatgccaacgtcagggaaaggattctgctgtcggtcccactccaaagttcacagaatgggtggtgggcacagaatctggactctgcttgtggcatccatcgtctggcccgatgcttgctggctgcccgctccaggaggcaccttctgggtgttctctgagtctggggaaggttgggttctgaggtcagggctgccctgacccttgtgaagagaagacatctgtgactcacctgctttcttctgctgcatttatccccccagtcccttattttgaatgtctcacttgctttatgaggctaatcagatggtcagccagctgttgataactgtgaagttactctttgagggatcctggggtgatgcctctgtgggctggagatggtgctggtgagaccgcaggtctggggtcagcgttgtgccccgttgagctcccgccaaaggaatcctctgctgggagggaggctctgtgcttgtgcaggggtccctacagggtcaccccctctcagggtctgggaatgaaaagcgggtgcgagcagggtttcattttcatctttagcaaggtgcccaaggaaggttgccgtcttttcagtataagatcctacctgggtcttgcactcaacttctgggaagagtctctagattcattctggaaggggttggaatcgttggacttggtgattgggaacgtccttggagagtgtgaggctctgggctctgaatgcccagaccttgtgctgcccttgggggagggtcttctgcaagcacagccgcctgcaagcattcaccttagtccgagcatctgagcctctccatggtactcggggagaggttacccgagcaactttgcatctggacgacgaatgttgctcggtgaaccccttttcggtatcaaattccaccagggaggccgtcttggaggctggggcacctcggggaaggacgccggcatcagcaccattctggggtacggggatggatggtcgaccagttggaaagtaattgtttctaatgtacttcacctggtccactagccgtccgtatccgctgcagcctgtggggcctgcgggccggggagccgatcgcgcttcagctcagcgcctttcctggtacttgaagggagatcgaccgtgttatattcgctttattgacttcgaataatacatggttgatcttttctcagtatcaaatctcaccttggaggacccgttggagatgaagcccttttgagggtaggagcaggacgggtgctttggagtcgctgcctcagtggggcctggtcaccgagagtgggccgggcaggggtctctttcctgtctctgtgtcttctcacctttgatgtcccatccgtcctcaggactgcttcccgggggcagcgctggcaccacgggacgcggcagccacgttcttgagccgatggcactctgggtacctgagaagaggttgtctgtgatgagttcgcttttattaatgacgaatataacacagatggcctgttttcagtaccgctaccgcccggtggtgtgcgggcgccacgcctgaggcgggactttccagggtacgtgaatgcatgggctggtgtgacatttgtcatcctttcccctgacccccgccattgaatcattttgggagagctttcggggggccatgtggactttggggaagatgctagggttgtgcactgtggtggggggcggtcatgaagctgatgagcaatggtgacggggctcagtctgtttttcatggccagtgtcatcgaggcagaggacacgggggagctagtcccgctggaaggcatcctgctggaaggccacccacccctcgccaggatgttgggggcggctgcatgcattccctgcacctgggctgccttctgctcatctcagtgctgtgagaccctgggtgggagctggtgccttgggtggccgtgtgcgtgtgctgctccttgtggtgcctgaggagaggtggcctgtgttgcattcacagaaatcatgacacacaagacacgagcggcctctcttcagtatcagatcccacctgcatgattcctgcacctgctgatgtcggggaggtccggttgcgcgccctgtgggcccccagaggcatggctggtggccgagcacgcgcttgacttccacctgcagccctgtgctggcctccatcctggaggcgggtgggtggcagggcccttccctgtggaagaagcctcctccctggagtcagtgctgctcagtggtacctgaaataggttgcctgtgaggtgttcactttctatatgatgaatattatacagtcaacctctttccgatatcgaatcccaccttggatgccttcctctttgctgtcaactccaggcagcagctggctctgcgctggttgaccctgtggactttgtgtaggacctgtgtcacttggcctgttaattttccagctccactctgttctggggggctttggaagtgtgacagaatggcatccccaattccagtgtcagcgggagcacccgccatgcccttgcttccggttggcacatcccccaggctgggctggctctcagctacccgatgcttatgtcatatttgcacccctggcctgcccagactacaggaagatgaccagaggcctgtttgcagctgacctggagacttagtgactccagaacatgctgcccatgcccagggtccagggctgaaggcaaggagcacctcaggagtgaccccaaagaatgagctaaggctgtcctttatcactcattgttgatcagtgagctcctgggctcgggagatcttcctgagctgggctcccgtcatcccctagttgagacgtcgctgccttggaagtcacagcctgtgcctgccctcccccttgtcctcctcctcgggaccgctcctctccatgcctagcatgggagtggggatccctggcaccatccctctgggctgcctgctcccactctccctcagcacccctcttccccagcccctgggccacagccctgctggagaggccgccccacaggctaggtccctccagcctgtggcacttgggtctccctccagtgcccctccctctgccagggagagcatttccaagtgcagagtccagctgtttaactccgctgcccagggcacctctgcaggccccttcccttgggcttggtaccaaaatgatccgaggaccccccaggccctcagagtggcagcccccctcttctttt

SEQ ID NO: 78042 - DNA, 3699 bp, Homo sapiens
caaggggatggaatggctcttgttcagcaaggtcatccctgataaccctataaaagcagctccccttgcctcttccctatcacattctaccagttgccccgttactgttttcttcctagcttacagttctctgaaattgcctaatgttaatgtctaccttctttgtgccctagactgtgagatttctcattggcagaaatttctctctctctctctctctctctctctctctctctctctctctcatcccctgctgtgttcagtagcagaacagtgagtgtttgttgattgactaatggagtccccaaaggcagggaccggatcagatgaattcccaggcaggtgctgggcacaaagcaggcagtcaataagatgtggtgatggagtacatgaatatgttaattgatttttagaaattcttcccatttgttcaaagctgtttggttttctagctttttctgcccttccaggatgaggctgagattagctgcaggaggcacgagtcagttgggtctgggttctctcttccacttgtcggggggtgggggcaccaaagccccagaggaagtgacaggccctgtgttcccctgcagatgccgactgatcgcgcccccgcccctccagcaaacgccccagcgctgagagccaaatgctctggggaactccatctgcaacgggctggagcgtggtgttagggctcatattttatgcatggggctgactaaatgggaacatttggagatgaaaattgctgttaatgcatctacacatctttggaatatattaaatgtgtgtgtgaggggaagagtgacattagccttatttaatagcttcaatataaccatccccgcacaccacggcgttaacaggcacggcccccccgccgagtctcccaggccaccactcaggaagagtgctgggtgcatcacgcgccacttgagaattagggggtgagtccggcgtcggcccggcatgcagcagcgtgcatgttccccgccgatttctaacccaaacacagtgaccctgtgccacttgatgcagaatttcattaaaagcaaaaatgattgatttatctattgtttgcggagaagaaaaaataaacaaagggcctttctcatcagataagccaaataagaacgtgtgccccacaggtggccaggatgaaagtctccatggacccttcaaccagaggctctgtgacttgtcccgtcttcagtgcggtgtgtaaaccctgccgccggtccaagttcacgaggtgtgctcccttctccagtgcaagggcccggtttatccccactatgtctcctggacgtggttgggaaattgaacaacctggacctccgttcccatttccttgttgtttcagcgggagataagaggagaagtaatagctgtcgtgttggggcgcttgccttggtcctgggccccatcagctgctgtgaggagacagtttcttttccatagttgaggaaatggagcgcagagaggttgagtgagtcaaccaaggtcacccagctggaggtggggcagggtctggctccaggctgtgtgctctcacccaccctgcttgcacgggctttaggaatagcccctgtgtcctggaagacagatcgctcaccgaatgggcctcttttcttggtatcatatgatgaggtaggctcactttcccccagacttagcttgccagaatattcatggttttttctctgtactcacctgtcatctctccaacttggtgccatcacccatgaagtgggatgctttggtgcgtgtctggcctggggagagggctgcttgctttgtcagaagactcaaagcatgatgggcatccaaataccaaagacctatgttgacctgtgtttttcactccgcttgatggcagttgagggctatattcactgcctcagttgcatggagtgaacaagacctagtgaaggtggtgggtgcgctgagaccatctggttgatctctcctgggtgggaccaggtgctcccctcaccacccccacccttgtctgtgtaccaccactctgcacagacacgttggctggtgcagtcctggagacccacggagctcacggtcgtcaggggtcctcaaggattcagagaacccccaaatgtcagggctgctcccttcttgtcctgcctctctgctcacacccttggacaggtaagaaaactgaggtccacagagggcagggtgcattgctgtggcttttgttctgagcactgtctccccagctttggggttgagactctggggtcaagacccacctctgatgaacgagcggcttccttctttgtaaaaattgaggcgacccagaccaagaagggctgcaaaatcaccaagccaggacctcaatacccaaggggctggggtttcggccaccctgtggcagagcttttagaagccagggcccttggctcggcagtgctggctcatagtaggtgcttagttcatgcctgtctccttggatgaaatctgaccatagacaccagtgcaaagcaggtgttcaacacaggagggtgtactgaacccgatctctctatcaccaggaggaagcacacgggaggcactcagagaacgtttgtggaatgaataaataaaagcatattttgagggaataaagaagcagaaaaacaaagaagaatctggggaagatgggcataaatctccaccaagtgctgccaaggcttcccaggcgaggctgctgaaaagaccctgtggaggtagagggacaatttgtcatggatgggaatgggcttgagggccgggaagcagggcatgatggggcctcattcatcattttcccgttatcccagcagcgtgcaggggagcaggtacagcacctgcctgtgcagctgcactgcctgcccgaaggccctaggccctgggccaagtgagtgaccagagggggactgggaatggaaaggacctcaaggaaggacaagctgagctctgggaggccacctcctccaggaagccttccctgattcatccttcacaggcagtctcaatttgcagtcagatatccactgctctgattcttagatcagcaagtatctccctacccagactgcaggctctgctggggccgcggctgtttctgacttgtgcacaatggcatccctgtacctagcacaggactgagtccagagaaagtgctcagtgatgcttgttggccttgtctctcctctgtgggcagcacagggcacccggcgggtcctgagggtgtggacatcccacggcagagcctgcggttgatcccgaccatgaaccaaggcctggggcgggggtggccacatcaggccacttctgccaggagagatgtggctgtgagctgggggtctggcctgtccccggaggcattccttgggtttgcatccatcagaagatccactggttgcctctatttgggcctggagcagggatgggatttttccaaggtacatggggtctaggggagacccaggcccattattagggtcggtcttgagaaggcagagatcaggccaccactttatttggtgtagctcctcgctccattggtgtgtgctgagtgaatgaatgcatcagggactcctgcttcctgcccagagccccctccgcaccccacacagccttgctccaaggagaaggggtcagagccaactggacagtgctacagcatggggagcctcgaccaggctcggccctcga

SEQ ID NO: 78043 - DNA, 1297 bp, Homo sapiens
agggggctggttgggagaggaaaggctggaaggaaaggaagagaaacgggcgggtggcctgacacccagcagccaggtgtctataggttttctgtcctgggagggggctgtcagggtgatgcccgcctgcagagagggggtcattctgcgaggttgggctgcagacccctgtgccagcgggcctggtgattcggaaatgatggggcactgtggagagaccccaggaaaacacccagtgctgcttttgacattctctctccatctcccctttcagcggctgctctgcctgggataaacacatttcaagagtctcagtccccgctttgccaccatctcctcctctgatctcctttcctgcttcaaaagactccagaatcttctcggttctcagagaaggctgaatccacctatgacctagtgggagcaccctgtgccgaaactgtttaccttctggtccccggagccatgggtcacgacctgggcctcatgtaggcccgctcctcagcagaccccaatctgcggcttctcccacctcactggggaagaaggagagccctggggatgtggagaagccaccccccaccccgccacatcccccacatcttacagaatctcgattgaatccccgggggcacatccctcagcaggacagcaacagtctttgccgcagcctggggagggctgtgctggggatgagcgccgagtggccgtggactaagtgaaggaaatgaccatgctcttctcccagctggatggcgaggccgggcaggaaccgcggaattcctgctcttcgttttcaaacactttgctgtcaagctatttgaataataaatacacattataaaaatgtaaatatgtttgtgtgtctgtatgttcggagatgatgtttgttaagcgggaggtttaacaacggaggccatctgccttcagcagggattcgcacagaatgtcactggccttcgcccaacaagcactttgcagggagcaacctcctgaagtcggggctcactcctgggtccccctccactgcatgcgagccccccgttccaaggcaggagccagggtcacgaaaatgcatgcttcttcatcaatccgaggtctcaaacggctcccccagccccactgcctgcccgttccaggcctggggctggcagcctgggccccacgagggggcagaggccagagcccggcggcagagcccgtgcccacgcctcgctgctgccagcctccgcttggtcacgacacagccaggctgactcagacacagccccaagcgggagcctcataaatgacatca

SEQ ID NO: 78044 - DNA, 1036 bp, Homo sapiens
taattgtattttcagctcttgaagtttgacttacatctcttttcattacatgtctctacttaacatgctcaatctttcctgaagcttcttgaacgtggagaattagaattataataattgttttctcatccggttgactaattccatcatctctagtatttctgaatcagttttgcttgattgggttttctcctgattatagggcatattttcctgtttctttgcatgcctgggtaatcttttcttaaatcccagacatcataaatgttaccttgttaggtgcttgacgtttatattcctataaatactgttttcagacacagttaagttacttagaaacagtttgatcctcttgaggcttggttttaagttctgttaggtgggaccagagcatcatttagtctagggtgaatttcaccccactactgggctgacaccctactgagtactctcctgggtgcccagaagctgtgagattgtccagtctggctggtgggaacaggcactactcccagcccttcgtgagcatgggcactgttgctgcgaatgcttctgggtgggtctttcctcccatgcagtttgcccacccatgtgctgatcagccctctactgaatgctaggggtcgggggagatccctctgcacatctcagaaactccctttctgtgcctctcgttcttctgtcctgtggactccagctgcctcggcctcatcagactcccagttccatctcaattcagaaagaccctggctctgtctcagtcctcctccctgcaccatggcctggaaactgtctccagacagcaagctggcgcaatcgcagggctcacattgtttgtctcagggattaccgtcttgaactgtctgatgtctcatgtctgaaaattgttgatttcacatgttttgtccagatttttagatgcttcaggagggaggggaattctagtccctgttatccttcctagtgagaggtaaaagttcatcaaatatttgctgactgtcaaatatttattccataccaatgattatcgagagcc

SEQ ID NO: 78045 - DNA, 1044 bp, Homo sapiens
ctcggctgggcaggtgtggggtcagccaacttgggttggaaggaggagagaaaagagcaagaggccggccagaattcctctgcgggaaagaaattgcctctgccctgaggactctccctgagccccagtgcctgtctataaagtgggcagaccctcttcgtaaggtggtgtgaggatccaatgagggggcagacagggagtgcccggcaggtaatcaggtgcctatccacacattactctcctctttcctgtccctgctgcagccaccttgggtttggcatctgtggcttatggatcctgggcgtggctttggatcagcacttagtagggccgggcaaaggtggctcctgggcatccccctggatgccttttctgtgccggggctttggcacacaaggagcttgggggcctagggagacgaggctggcaggggtaggcgcagttggtgcgtggcaaaccgaacctgtcaattccagaagcttttggcacattgttgaagcgactagatgactttgagaagtgtctgcatgttttttccccaagtgcagttatttttgctgctgtgaaatgttctgaaatctgacagttttgttttgagtcttagcccgatgggaagacggaaaggaacactgcctcccagttctgtggcacccgcttctcggggtctcctgaggacacccagatcctggcagaggtggccaaggagaagccaggggaccaaggtttccaggggggagtgtggagtaagctaggccacggagcccctggattccctcggagcacgagacccaaggacccactgcgtgccaggccctcgtctgctgagcatgtattgagtacctgttacattcatttgtcagacatagactatgcacctactacatgacaggttcctgtgcactgaggatttattgagcacctgctatgttcattcatcagatgcagactgtgcacctacttcatgccaagccctcacccaccaggcatttactaagcacctactgcacagtgcagggctgttggagggctctccgcagaggagtg

SEQ ID NO: 78046 - DNA, 1050 bp, Homo sapiens
acactgcctacttgattgggctcaaccacgtgcagtaagtagctggtgtctggcaagagccctcaggaaacagtaaccccattaattcaaatgcacgtgcctggaacaggctctggggggccagcccgggagtcccactccatgatggccaccctggggcctggcaggctgggctggcatcccaggcccaccggatactggctgtgcaccccggccaggccacacatctctgagcctcactttcccgtgtgtgagatgaggctagaagctgctttctcttgcgtgtgtggggattggcggtgacaacacggccaggagcccaggcccagcctacgcgagcagcctcgctccaggccacacgccccactcctgacagctctgtgcagcgagttcgtgcgcgagcgggtggctgtctgccaggcgaggggcgcgggtgcccaagagggcttcactgcttctggaaagatcacaaggaaaaaccacctccgcggcgggacgctacccgcgggccgctgcggtcccgctcgcggccggcagggggcaggatgtccccgcgagtcgcccgtgtcttcgggtgtcctcaggtcaccccgcaccgctcgcagcctccgcgcctagttaaagggcgacgcactcatttctgcaaagaaggagcccagcggcccctccccggggaactctttccatcaactcggggcctaataatttacatttaatttgttagcggtttaatgtttaattttaaaagcgagatgattcattaccatattaataaataataacatttattattctcctaatgagtgtccaaaatacagaagcaattacatgttttatatattttctcgtaatttgagacaccagagcgttaattacagagactcacgcgtggaccccattctgatccagggtcctgatcctgcctttgtttcggtctctgaaccagccgccctccggggcttctgcaattccctcaattagaggagaggaagtcgtacgtgacgaagctggggctctcacagaaccccggcgccccagacccaggagctg

SEQ ID NO: 78047 - DNA, 1036 bp, Homo sapiens
tgctcactgctaccccttgccgcccaggctcaagtgatcctcttacctcagcctcccaagtagctgggaccacaggaacatgccaccacacccaacaaatttttttttttttttaatagagtctcactctgtcacccaggctggagtgcagtggcgcgatcttggctcactgcaacctctgcctcccgagttcaagcaattctcctgcctcagcctcctgagtagctgggattacaggcacccgctaccacgcccggctaatttttgtatttttattagagacggggtttcaccaggttggtcaggccggtcttgaactcctgtcctcgtgacccgcccaccttggcctcctaaggtgctgggattacaggcctgagccaccgtgcccatcctggatctggtatttttaagttcatttcccacacctcaaacccagcaaccctcctgtatagattggtcttatgcagtctatggtgttgctatgttgcttttagctttagggtcatctccccaccgccacttccattgcaagctgccaggcaactcagtggttagttctttttcttccatcaccttgttttccttcaaaccacctctgctactgacgtcctgggctagctccctatttctgttgacggtcccttggcctctttctccaataatgttggtatttgaaaaaatttacctagttttggtattttattattgttcacattgtgtgtgtgtgtgtgtgtgtgtgtgggcgcgcgcacttgcgcgtcggccacttgtaaatttctttgcttcttggctttggcctcattgaggaacagctggaatgccaagtgagcattgcatctacttgaccaaggttgatgctgttccttcacaccgtgaagtgccttcagaggatttgcagagtcaccactttcctttgccttttcttccttgtgactaattgttgaactagagcacctagggccaagggtccaggagctgcgtggacccaggcagagccagtaggtccttttgaatccatgggtagcacataattggg

SEQ ID NO: 78048 - DNA, 1464 bp, Homo sapiens
ccacctttattcttgtccatatggctctccagttgtcccagcatcatttgttaaagacgctgttctttccctggtgaatgggcttggctctcaattttattccatcaatctgtatgtctgtccttatgccagtatcatactaccttgagccagatgcacttttaaaagatccaaggctgggtgcggtggctcaccacacctgtaatcctagcacttttgggaggccacagcagattggattgcttgagcttaggagttcaagacctgcctggacaacatagtgagaccttgtctctacaaaaaatacaaaaattagccagatgtggtggtgagtgcctgtagactaagctactcaggaggctgagggaggagaatcatttgagcccagcaggttgaggttgcagtgagctgtggttgtgcaattgcactccagcctgagtgacagacagaccctgtctcaaaaaaattaaaaataaaaataaagtatctgaaaagacatacaaaactaggttttgtctgggaggacaagtagtttggtattgctggaacatcaagtgtgcatggaagtggttgtgtgaaggctggaattaaggacgtgagagacagtgactgtgtgaaggagacgcagcaagctccggagcctgcctgagtgttggcagataacggggacatgagatgtgtccatgctctcaacaagctcagaatctctttgtagaagcagacatgggattccaagcctgatggaagtgtaagggaacccccttaagaacactgaggagatggtggggcctggctgcgtgtatgagtggggaaaacattaaagagaatggcatttgagctagaactgaaggctgagtagatcaaaagctttgtgtgggggtgagagtttgggaacgggaagagggcatttcatgctgaagaaacaggcattgaaacagggcagggtcagagaacatttgagaatctgagagtggcccagcattcctgaaataaaggagagactcatctctcccatacattgagagatgagtcctggaaaaataagtgtgggggagacagcggctgagctcaaaccccatgctacggagtttgaactttctcccgcaggcagtggggagccactggcatcttgtgagcaggggaatggtctgatggacctttagaaaggtcagtccaataacagtatgaaaatatgattggaggcagctgtgctcaccactgtaccaccaacactgaaaatacgattgggagaaagatgagggaaggtgttctgattgtctggtctatagaggctggggttaatgcagggaggaataacgtgttcatttggactattttcacatacatagtagtcgagggaatcatatagggaagccccaggtccccattgcccagccttggccatcatccactgcaacccatcttgtcttatccaggcctcctcctccatatgcatggccctct

SEQ ID NO: 78049 - DNA, 1085 bp, Homo sapiens
ggattcagttaagaatcttgagatgggacgatgattctggatcatccaggtgggtccaagggaatcacacaggtcattacaagagggaggcaggagggagacaagagaaggcaatgggacaatgaaagcaggggtcagagagagatgtgaagatgctacatggctgggttggaagatgcagggaagtggccatgaaccaaggcaggcaggtggcctctagaaggtgggaaaggctggaaatagattctcctctagaacctccagagccatcacgaccctgctgacaccttcattttggcctcatttcagacctacatgccagaacggtaacatagtaagtttatgctctttggagccactgcatgtgtaacttgtacagtggtgcaaggagatgaatacggctgagtatctcacaaaatgctaggtgttccctgctggctcaccactcagtcttgaacacccaaagcaggccatctgagtgcctccccttgagccccaggaaacgctccgctggagctgttctgctgccattgtcctaggctcctggtgtgcgtgctcattcccaggctgcaccatagctccagggctggtcaacacccctgcagccaacctgcaacgctgccaactgaactactcagcagaggtggagaagagtctgaagatgcacgaagcagaggaaccaggggtcccctgtcatccacagaggccaaaggagctcaccaagggggcccgtggagttcagctgtgctctgggccccccagctgaagggctctctaggtagcaagcagtgacctggcccacagctgtttgctgcgaccactatccagcagtgacagccaacagctgctgtgtccaccgtcaagatgatttacataatgtgctcgttgcccacccttctttctgcccaaagaaagggagtctgtgtctgcatatgtgctctttaaaaaggctgtcactctctgagacagtttgcttctgtgtccccacccaaatctcatctcaaattgtaatccccacgagtcaagggagggacctggtgggaggtgactggattgtgggggcagtttcccccctgctgttcttg

SEQ ID NO: 78050 - DNA, 1709 bp, Homo sapiens
tggatgatccagaatcatcgtcccatctcaagattcttaactgaatcccatctgcagagtccctgtcgccaagcaaggtcccatattcaccagttccaggaattaggatgtggacatctttaggcgtcattatttagtctaccacatcaacctatgtggtaaatatttagcaatcaaaagtttgaaggaagatacgagaaattaggcatctttgaatctttcagtctaatattgctgaaggtgggacataagccccatactccagccactctaaggaatgatgtcttccatggagtgaaggggaatgccccagagtaagactcatgtatatgtttttctatattttaatagtgctacaaaatacaaccattgtacatattcatttgtttttgtttttgttttggaagcaaatttccgtcaggaaaaacagccttgttgctgtcccgtctacagtatctgctaaaataaaagtaccagtctctcagcccatagtgaagaaagacaaacggcaaaattcttcaaggtttagcgcaagcaataatagagaacttcaaaaactaccatccttaaaaggtaatttttatttgtcttttaaaagttaaattgtggctgttggagtgaaggagcaatgttttgatagtgtgctaatttattcctttgctgtgtttgtattttgtggggtcatcttttctgtattgaggggtttttttttttttaggttgaatgtcattaacttacttactcaattaacattttaaattccagagctattcaagataaaagtttaacaacacagtataggcataatacactaaggaaacaggaaaagctgaacatctttttatttatggtattaagctagccagtttttcttttaaattaattttcatttgtttgtcttagaactgtagcaattccgaaaggaattactccaagtacagtaattgtaaaaattatagtagaagttccctatgtttctaaagtaaggactgtagctatagtacattatggacttgctttgttatgagtcatttgaggattacctctactcaagcatttcttatatgaaattaggaaaaagtgctctttactttgaatttccccccaaatgacacagccatctctttccatctcaggttgtttaatccctaaaagtcttcctttagattttgagattgaggtgcttaaaaccttatcaaggaaaacagagtaaggaccgtaaagtcaaatgtgaacctcttaaaacctttataattactaaaatataagacagatatactaaataaaataacatttttcataccttaaatttataataatggatcttttacaattaatttccactgaatattaattcagcaaccagtccagtggctcgcgcttataatctcatcactttaggaggctgaggcagaaggatcacttgagcccaggagttcgagaccagcctaggcaacatagggagactccgtctctacaaaaaaataaaatttgctgggcatggtggcacacacctgtggtcccggctactcaggaggctgaagtgggaggattgcttgagcctgggaggccaaggctacagtgaaccatgatcgtgccactgcacttcagcgtggatgacagactgagatcttgttctcaggaaaaagaaaagtaaatatgaactcagtgagagcaggcagtctgtcatgtttatagctgtattccca

SEQ ID NO: 78051 - DNA, 1079 bp, Homo sapiens
tttaagtttcccttgtaggttttgcatgtctcttactaagctaatgcctagataatcattatcatcgctcttgtaaatagagtcttttcttccattgtgtcttctagttattagttgtttatatgaaggctattgaatttgggggccttgctttcataacctgcttccttactgaattacctgattgtttgcatcagtttttcagttgattcttttgaatattcaggtattaattagagcatctgcacataatttcacctctgtttataattgtaaactcacatgtctttctctccagttgactaataaattcagtaaaacaatttcagtaaaatgttacatagtggtggtgagagtgggcatacttgtcttgtttctgacattagtgggaacgagaggcatgatttttagcaaccgtttattatttcattctgtggataccccagtttttcagctattataaatgatactgttctgttaatcttttgttatcgttgttgttcacatctttgaacctttccttaagcttgatgaaggaggtactggatcaaagagcaggcattttcaaaaacccttaatagatattgtctacacactttccagagagtagcaccacatacagagtatgtgagatgcctgtccatcatacctctccaatgctgagatcatgtaaaagttgtagttatttgataagtagaaaaaggtatttcatatttttatttttttttaaccagtgaggttgaatatagccctcagacctgttcattgtaagattattctgaattaatgccttcatttaacatttttggactggaaggtggaagtgttaaataaagagaccttttttttttaagatacttataggaagagtaaattaatcatggacttgttttttgaggccatttttagaaaagaaaagactaggagaagtcaaagttatagcagaataatgtaggacttattatcggctaactaactagagaccctggggcaaaagagttgccgagtatttggtcttttgtgaaagaagtcattacattattgttagaatttacttgaattgtttaaaattggctttt

SEQ ID NO: 78052 - DNA, 2136 bp, Homo sapiens
atttctcagtttggggctgtggcttctgttccattaatctgccttttttgccccatcacactgtcattaattcatacagctttatagttggtaggacttgcctttctcattagtagtgttctcattcttcttgttcttttattttttgcaggtgaactttagaatacttttgctaagtacctggaaaaatagaggcccacctgaattttaattggaaatactttaaacctgtagatcagtttggggggaaattatcagcatagctgcagtatttatatttttatatttccaattcagaagtacaccttacctttattcaagtcttcttttcttccctcatattatttgtttatttatttctatcttagagtctgttttatcaatgatggccagatcagccttgggttctttaaagaactacttacatgcatagggtttcaaaagagtgtggggtaaatcactaataaaggcaagatcctttgatctgagatcattaggaaaaatacatcaaaaagtgtcttcactgtttctttgactcctattccgtatattatatataaagctcttaggagcctttcccccttatttctgtattcccactcatcagcacagttgtaggataggcacattttttcatcttatctcgtatgaaatattaaatcattggagggcaggtctctgtctccttaaagcccagatcttcaataagcatctgctcctgggctccttcctgagcccctgaacgcctcgttcctaattgtgtctgagttcatctggcatcactcagaggaggaggaggaggaggaggctggggtgtggggcagtgagagtcatcaacactgcttcctagtggtcgttggtgatcggtggccatcccctccagacagacaacccacaggtcagcagtgaaggcttagaggcaggagggcagctaagatctaaattcctcttacccaactgaaagcacgtgctctttaaaaaaaaaattaattctgctgttcagatagcagcaaagtcagagcaggtgtgaggccggcagcctgctcaggtggtgcgtgcccactgcccacttgtgttagaaatcacatcatctcctggccggccatggaatccagcactgtctgtcagctctggggaaagagggggaagggtgggatttggtttgcttttatctatttattttagttgctattgatacacacaataaaagctacattcttgtgagggaggacttgattagcagccctgaagggcggtagcagttcccttactcattgaatgtatctggcgctaaaccctcagctggaactgcgagccctagctgtatttcaggtgtttcttactctactgtgaattatgtttaggaactaaagggcttttgtatccttcacaagtggggggaagagagcaggggaattgtgtgagaaactattaaaaatgaggagccatggtttggacaaacttccttgttggtgtgaagaaaggaggaatttttttcagttccacctgccgaagaggcttttcttatagttcgttttcatttggaactactaataacactcatttttgtagggaatcatctcaccgcaccccctcatgggatcctgcaatactccatccaattcagaaataatgtttttctccttggaatagctttttacattaactgtatttgaagatagaaaatttagatctgaatagcagcttttaatagccccataaaaataagtgaaaatatctttaattttaaatttaaacaaaatatctaaaacttaaaaggtatttaatatgtcagcatatttgcaatacaaaaataaacatgctccatttcatttttttgctttcttactcccacggccaggtgatataaatatttcaatttgtgtcactttctagctatcgaatttataaagcggctttcattttctacgtaagtttttaagcttaattttttcagggaaaaaatagatctcaagaaaaaaagtgtttgggatcataagttaataactcatcctattggtaagggaagttgaataagagtccaaactaatggattagaattgtgtaatatttgcttaaccatttgttaaaaaaaaaaaacaaaaaaaaaacactgggttgccagaatcctaccta

SEQ ID NO: 78053 - DNA, 1004 bp, Homo sapiens
cttccgtgggtagttaataaatggctattgtgcttcagataagaaaagcaggaagtcctttctagcagaattcaccccatttcgctgcagacttaaccagaggaggttgggtgtgtcactgcagtttggcattttacgaactacttacagaatttgaggcttgaaagaggccttgcatgcatagttcaaagctggtttttctgctttctgctcgctctcccatccccctttcaaagctgtgctgatgtcaaaggatgtgaagtcactgcccagggaaggtattgggtgggggtaggaaggagaggcgggcctgtcgcgcctggccaagttgttcgtacgcagagtttctgttacatatgtgtggcttaatgctgcaaaggttttgtcgaggacacatctcagaattaaagatgaattgcagtcagaaaatatgcacaattgattggaaaagaacttcctttaaaaggattgttttcattcttgccgtggagcctgagagagaaatatgctccactttgaaatattgaaatctatcgtgggtcatcatttttgaaatgttagcgttttcgtggaatattaggaaatattttgcatttaaataggctctgtgttgccagttggcttttaaaattttaaatggcaacaagttttcaaggtatatagagatcactgttttaataattagtttgcttctttttatgcatattttggtttcaaaacttagcctaaaagcacaactactctagtaattaatagcggttatattgaactacaggcatcagggtagtagcctacttattcttggtattttaagatatatgaatttttttttggtcataattgggtgaaatagaaaaatgattttaagcttcatcagatcactttagaatttatagtatcagagctgtgccccaacaaaactgtttctcagaatctcttttaaggaagggtgggagcaagatttctaggtgactaataatctctatgactaaaacgccaggcca

SEQ ID NO: 78054 - DNA, 1124 bp, Homo sapiens
tcacgttgtgtcttgaaccacattgattttttttttaaaattccaagaccttattatggccagtttgtatttgttgctgttggttgggtggttggttgcttgctgtataattgtggagggaaaaagcagtgaagtgtattagcctgaaagagacttgagtttttaagaagggataactttggagacctaagactaacttctgactcaaacagtgggggtaatttctaacttcaaaatttgaagaacgcttgatttactcataaagacttttctggagcgagcatgttaatgtgagatttagcaaaatttgatttatttattgggccttagagtcttagcttaacatccattgagcagctccggtgtgccaagtgctgagcgtcattacagtgattaagttgcagcccctgtcccaaaggagcgaatggagagacccagcataggagctctgccacgagagggctaaagcaagaacacaccggcagggtgcccgggagagcaggggctggtgtcaggagcagaaggaaccaaggagggctgcaccctgggctaccctgctcactcggatggggtgggcatgcgctgtccttcccgtttatttaggaaggaggggtctttcccactgaaggagaaataacttacccaaggtcacacagcctggaagtggtggagccagaatccaaacccagactgttgtgttgttttgttttggatctttttaaaaaaatcattttaaaataggaatgttggctgcttgaagaacattttgctacaggattacagtagtggtattttccccaatgccttaccatttatttggctcggtagcctctttttgtataacagttttgtaccttgggctcatttattaatcattttacaaatatttattgatccataccacatgccaggcagggttctaatgtggatatgagcaggggctatggcccagctttcccagtttaccatccatcagggtggggaccaagtaagtaagtaaggaaaatgatcacctgatttgttgtcacgatcgctttgaccattattgtctaccaagtagtctggactttgcgattaaaatggtgaatttgcacatcctaataagtttgagtgtgaaagggaca

SEQ ID NO: 78055 - DNA, 1118 bp, Homo sapiens
ccgtgatggccaggctgctctcgaactcctgacctcaagtgatccgcccgccttggcctcccaaagtactgggattgtaggcatgagccaccacacccggcctatctgatgtatttcttagctaaatacctcatcagtggaatgagaagctcatgagaagctgtactttatttttctttcaatcctctatacgctgtagttaacgtatttcaatgaaaaacatataggagatggcttttgctgcaaggcaaaaacctgctgagcagacgttatacccaagtgcaagagtaagactaccaaaaaggtgacagactttacacaaggcggctggttgaaagagcgacacaggtgcccactccactctaggccttgctcaggcgctgtttccgctccctgtcacactggaaataggaccgccaagtggtctaaacgtgggataaatcatttctctcactcacatcttggaaagacgctggctaaaatgcatgggggaaaccagtactcccacagcaggtagaagtctggctttatttgaggcccttgaattacacataaatcaaaaactcttctagtttaaaaaagaaaaaagactaaagagatataacaggtaccgtgagtgaatctagatcagatccttgttctaaaaagtgtgaaatcaaacctattagagacattttgaaggcagctggagaaagtggagtgcagaatgatgttggatgtgtggaattactgcgaactttctaggtgtaaaaaggtgtccaacttttgtaagggacttttcttattcttagggaatgcagaatgaagtattaataagtgaaggatcgtgatctctgcaactttaaatggtaaagagaaaagtgggtaaaaagcaaatatgtcaaagcatgaacagttgttgaatctagctgaggggatatacaatatacaattattcattgaaattctatggagattttaactttttcataatgtttgagagaaataaatatatatatttatttatatatatattatatatatattatataaatatatatataatatatatatttatataatatatataatataaaaatattatatatgtatatatattttttttttttgagatggag

SEQ ID NO: 78056 - DNA, 1826 bp, Homo sapiens
gtttttgtttggttttttggttgctcaggctggagtgcaatggcgcaatcacagctcactgcagcctcaacctccccagctcgagcattccgcccaccgcagcatcctgtgtagctgggactacaggcaagcaccaccacacccagcgtggttttttgttgttgttgttttggtagagctggggtctcactgggttgctcaggctggtctcaaacccctgggctcaaatgatcctcctgctttggcctcccagagtgctgggattagaggcgtgagccaccgcacccagcctcctttttaattttgcgtgacgaaatgcagagttcacatgaagccgttctagcatgctggagtgtgatggccgtctcgaagaaaagcgcccatgtgatgtgtgagttatgagccaaaatagccactttttccaggaactttaaattatgagaatagtaatgtaaaatcatttttacttgacagaacaaaaagcagacaaactgtggatattaagacttaaatatttggctgatattttctagaaaatctatgaagtgagcttatcaattgaggggaaaacaactgcgacactgtttttggcccatggtaaaatttgagctttcaagaaaaatttgaactttggagaacttttatctgccagtgtaaatgtggcagctcccagtgccacagactcttctgctgagaggggtggtgacattagcaagtggggtttcttgatgtatacggtggaaggtcacacaccacatgcagcagtgtgttctcagtgaccaacgaacgatgctacaaacaagcgtgggtgaagagccaccaaagtgtaagacacactgccgggtgttcatgtaactgacaggttcatcaacatggtttcagattcctcattgcaactaatctttaaggaactatcacttgttgaattttagcataggcaaagaagaacatcggcaattttttgagaagcattgaaacctcccttttcccaccagacgtgtctgtctgagcctggggtgtttctttacatatacttgaaccagaatagcatatcacagcaagttgaacacagaagcatgtcggcagatccgcctgtcttctgttgagtattgaagaaacatgcaaaaatgtacaacatggccattttctcgctggtttctttttgaaaataaggttattttcataaaatattacttaacatgaagtgaacctattgctaatttaatgaataagtaaatatttttaaaattttcaagtatggtcagtatcaatggatataacccccataatcaaagctctttagggttctccatactttctaagaatgtaaataggtcttgacaccaaaaaaatggaaaacacgtggacttggaagtttttctcgaatgggctggatgtgaccctgaccctgtttttaccaagcctccttggttttttccctcttttctctaaaaaaaaaaataaaataaaaataaaaataaaaaaaaattaagtagtcagtggaatcatctaaactggtctctgggaccatgagagctgagagcatccggagcccacctaaccctgagccttcctcttgccttggtcagtttccttctttgtttttcaaatctttttttaaaagccattttcaagtaatcaattaatatgtgaatacggccccatttacattttttcttcattgcaaataaaactgaaattttccctaaccttatcccctgagattggtctaccatccccacatctcaaagtgactgctgcctggagtttgctgtgtgtcattccagaccattttctccctgtggggggtgggtgggtgggtgtgt

SEQ ID NO: 78057 - DNA, 1137 bp, Homo sapiens
attaaaaataaagcaaagtttaagaagcatgtttggtaaagagttctttggcaggaaatggggacctatcagccaagctaatagccttagctatggcatccatagtaactaagacacgctgccgatgtaaatatttatgccagcaagcagtgctgcagaacccgggccgagcagttcagagcagtgaaattaaagcatcagccgccaatgtttgatttattttgtattatccggtattccaagcattaccatcattcatctcttctagggtttttcaaaatagtttagccctaagaacaagaatcctagaagaccagtttactcggagtaattcggtaccctctcccccacagcatgatagatacccaaatgagaatagagaggctgttattgtttgtcattagcaccctggaacctttttcatcttcaaagctcctcgcaaaagggttcattaaccgtcgccctctttcctgtgagagagtaaacaagtatgattagtcctactttgacagcggtggaaactgaagcagagaggttctccaacttgtctgaggtccaagaaggagctggtgacagagaccagataccggaccagcacttgggttttctgactcacggttctgggctcacccctctctgagcatgcactgagcctgctcttgcaggtttctttatcacagggatctatctacacggtactttctgctctcagctttttacagtggtgtagagtgcagtgcagctgaaaccaggttagttgatcttatggtgtcatctagaaaaacaagagatgcagattctgggtcacgaaggtaaggttgtacttttagggtttgtggttatggatgaaattaacttatctgagccttacattgtctcactaggcacagtgcccacttgttccgtggcacagccccagagctcctgttgaaggaacagactccaggactgactttccacttgattttcggagctcgcacatcccgagagattcatgttcaagctgcattttagacatagctggcaagagtattttcgtggtaaacgtaaacttactattggtaaagattcttaatgagtaattcttaggatttagtacaaaattagatatattctttttattcgtaatgatatagc

SEQ ID NO: 78058 - DNA, 1079 bp, Homo sapiens
agctgtatttcactcactcactaatatttagaaatcacccacttggtggttggctctgtgcttagtgctaagaactggtcgtgttataggtgctgtgggtgcgtgtctgcgctggcttcaggaggagggagcaggccctgtggggcccagcaaggcctcccaggagaagcagtgtgttagctgaagtttaatgaactaattggtggtcctgggatgcagttgggaagatgggatgattcagcctgttggggtatgtgttgggggtggttgttgcactgtggtgagaaaattcctggaaaagggtgtatgtcaaaagggtgtaagtagcatccctttatgactgatgaaaggagagcagccgagagcagttaagtggaaggcaagacgcagcagtggcttctcacgccatcttcgtcactacacaaggggaagttgggctaagaataaatttgttttggttccaggatgaaactcaagagatacagaagaaactgaaagtgatacttttggcagagggataggataagagggttttcagcgtgtgtgtgtgtgtgtgtgtgtgtgtgtgtgtgtgtgttgatgaatttattacttattaaaaaaatgtaaagaaggcatagcattaaaagtgggagacatatactgataatggaatccgggcattgctatctttctgtgtcttagaagttactgctatgattttagccacttaactggctagaacagttttgaaaggccaagatcatgggtttaagatttgagacttggccaaaaggtagctttcctagtccttatcgtagagtgcacgctcccagcttttgcccagcctatttggggtgcacacgctcatcgatgagggcaacagaacacagcatgcaggcggaactgtgcaggtcagtcaccactccacctcctagccagggtgtcactccaattccatcattcaggtttcactgaactttcatgttggcatttcatttagttgaatgaaccagttttgttgtatttcagatattctcactgtgtagttagcctgttcagtttttgtaggtgaatggtaaagctgtcaaaaccagatc

SEQ ID NO: 78059 - DNA, 1032 bp, Homo sapiens
tgaggtcatagaatgcatgcttaaagccccaggcctgtcaagtcgcttggggacattcatactgaggatttattaagatattaatttggttatcaggagtctggatggggatgagaggaggggatctttattacatgctgggaaaatcagaaatcaactctaattgactacctctactctttcctctcccaagatgactttgccaaaaagctgtgagaaaaagtcctcaaatctcagagattgacttggtacttgattatatccagctcgctggtgggcctgtggccacagagcctcagaagaaggttagaaggtctggccagactttagctttgctccacctacttggcagggtcaagcctacttgccagtggcttggagaagtgttttgttttgttttgtttactttttaggagtgtattcaaagcacattcacagtaaggaaaaaaaaaatgcagcctgtgtcttcagggactgggagtctctgattccagcacagccgactgtccagcaaccccagaattggtaggctggacactgggctgctcctcatggcggtgggagcatgggctgctcagctggggccatccaaggaagcaaagatgtggtgctgtcctgtggctgggggagcaggatgaattgggataagggaagcccagggcagggtgttggcacagagctgggaggtgcattacaccgaggaactgacgtggcctaaactccacagtgacttccacctgggatcacagtttacagtcagctgagtgctcaagagaactcagtagaggggaatgttgatgattcaggtatttggttggtgatcatgttatcaagtcagacttgcagttaaggtagtgtcccagacgtttgttcagagggctccttcccacttgtcatctgtaatactggctaatgggaaacctggcccatgtcaaatttgtattaggaaccattgatttcaattcacgggctttttccattgaggaatttaaaggtcttagaagtaatattcttgttaaggcatctgaggtc

SEQ ID NO: 78060 - DNA, 1391 bp, Homo sapiens
ccatctgagcgtcgccttaacctctctgtagacctctgtccttgtctatctaatggggatgatggtagcccctctgtgtgttcttactaggattagtgggctgggaaaagttacagtaatatattaccagcatgtagaaaatacccaataatgatgaactattagtattccttaaaagaattaaaagtgaaaatagtaggaaacactagtaagataaaatacaatgggaaattaaatttttttaattacttaaggaaattcctcaatccacaagcaacaataaataagaaactgagatttcctagcagctgaaaggtttttttttttgcagttgaggctgtgaagctgggcagggtttcagctgagctgaggttggaagtccctgaccttcagctgtggccgcctacggagcagcagggagagcaaacccatggagaaccccgcggcccccaaagcatggacggagctgccagccttctcccctgcccttcttcctctactcccgacctgccagccttctcccctgcccttctgcctctactcccgacctgccaaccttagcctaaaatcagagctgctagaatcacacacactgtcgtagctggttttgtattgtaaatgagtcattctgttattttggaaacttatgtctcatgccaggatctgcagatagttctttttcaaaatattgtttagacaaaataaatttctttaaatataatatctctactttaaatgcctggggtgttgcatgcatttttctaggctagcaaagcttaaagattatttctataatttcagttacatttacctttatagatgggttactctaagtaacaaattaaacacacatggatcttctaactttggctttaaatcctaagaagagataggtaatatataaaagagtattaaaaagaaatggagagtaaaggtatatgtcgggcagatgcagtagaaaagcaagggtcatgacgtcaatgctgggcaaagctaaattgtgaagacaaaacaataatgaaacagggttattcatcacgctaaagcgtacagtccataggatgatataactaccatgaatttggcctaaatgattgaacattgaaacacataaagcgagaactgtaggggattaaagacaaaatcagtgagtgcagtgctggtgggagaggcgcctggacttcttggcccctcacaggtcatgtggtagacataagttgttattactgtgagccagtagagactttcaggtttgatggctggaaaacaaatgctcattttataagtttttttttgttttgtgttttgttttgttttgtttttgagacggagtttcactcttgttgcccaggctggagtgcagtggtgcgatctcggctcaccgcaacctc

SEQ ID NO: 78061 - DNA, 1067 bp, Homo sapiens
tctggtcttttttaccctgcctgaacctaaattctgcagatatcacctggtgtcaatgtgtccacgccctttccccagacatggaccttactggttgcctctcattccactgcccgacacggtgcctgtgatcattgctgctcagagagtatttgttgaatgaacacatgtagatggagtttatttctaacagtgctctcaacatggtttgaaagagttaaaaagcataaaaacttcctcataccaaacatataatatgaccagcgactagctgggttttttcgttttattttctttaaggaatagcctttgtttaccccacccatctccttttttcttgaatctctattcaaaataaaaatagaagaaagcttaaatgtgtttcacaataactttgggttaagcacttttgtgatcaatatactttgctttctgcttttcagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatggtaagtgattacagtttaaccagtgtgtcccagttctgatttataaacaggacaggccaagatctctgagcctaacacagtgctacccaggagaagaatcctcctgttccagaatttgtagttgtgcttgaagaatgaaaattttctttgtatcctggattgtaatgataataataggaagggaagtcagttgtcttctagggaccagtctaagtgctttgcatttattaactcatttaatcctcacaactaccctatggagtagaagtgttagaatttgtatttctatttattattttatcttctttaaatttttttaaaacatatttaacattaatatactagtgcctttttatagttcagaagtaaacattttgtccatccatgtgcaggaaaattctaatgatgggatggagttgaaata

SEQ ID NO: 78062 - DNA, 1043 bp, Homo sapiens
ccaggcatggtggcgggcacctgtagtcccagctactcgggaggctgaggcagaaggattgctggaaccctggaggtggaggttgcagtgagccaagattgcaccactgcactccagcctgagcgacagagcaagattccatcaaaaaaattaattaattaattaaaaagataaaataaaaacaagctatccgtatgtaatatagtactgtttttatcaggactcttgttggtttccagggaaaactagttgatcacattattttaatccgcactgtctgtaagtgatttgatgttgacttacacgttttatgggcatgagagtgttcttaggatctgttggccgggtcctgggggaggtctcacaccctgcacccccagatgggtgtcctgtgcttcacttagggactgatgtggggcacgttccttcttctatttttatagctgatatttacagtgtgttctggaaagttttacttgctataagggtgatgatagtttgggagaggaaagaatgtgttgaattaagagggatagtacattgaccaatggagttgcagtcaaatttatttcaagtgaggatttaaatcatgcattcccaagtactttttgaaatccagagaatgatttttctactttaaatatcagtaagctgttttttagaggtttgtttgttcttacgattttgagattttcctttgatgtttttaaattataaaagaaatacatgcttatgtgataacaaatgaaacaaatacgaaagcattttaaaaagttaatctttttcctacttcacccctccccagttctacccatctctacctccaatcagccaattcatgtttattgtattttcagaaggctgctgagaaacttttgggatgatgagtatgttcattatctgattatatgattgtttcacagatatatgcatatgttaaatatcaaattttacactttaaatatgtacatttaattgtatataaattatatctcagtaaagctgggtgttttcagatgtccaaacttgttaggtatttcttt

SEQ ID NO: 78063 - DNA, 1833 bp, Homo sapiens
ggaggctgaggggagcggatcacttgaggtcaggagtttgagactggcctggccaacatggtgaaaccgtggtgaaatcccatctctactaaaaatacaaaaattagccaggcatggtggtgcacgcctgtaattctagctactcgggaggctgaggcacaagaatcacttgaacccgggaggcagaggttgtgatgagtcgagttcgcaccactacactccaacctgggccgcagagggagacgtcacctcaaaaataaataaataaatacatagatttagtacaaaataaaaataggttataaatgtatgacatggaaacagtaatcttttctgtttatgtcactgatctgtcagtatgtgttatacaagtccaaacagactgagagaaatctaacagcccatgcctgggcgcacagccatgctgcccctaccgatcctctgtgcccctgagcagtcctttctctggaaatgatcttagctgccgactcaaaggtcgtcccactctgactgttgctttcctcatcgttgcggattgcagaggatgttggtgccattgtcacacgggtcctccctgcgtgacgcagcccttgccatttccagcattttcagctgtgaatctctgctgcgtctttcgtcatctcatccctttcttactctcattttgagcattctccttggtcttgcacccactggatagtataagacctcagaagtcatcactgtgccatcagcctttgttggtgttggttgtcattcaaagtttgacagtcaagagtccaagtaactttggtggtcaacttgcgtgcgcacctgtccaaagtgatgtttcctgctgcagttttgatccaggctctctctgaggacccacacagcttctgcgttttgaggatacggaggagctaagttaccatgggaagcggctactgttagaattacctaagactttataaaatgttgtctgtaaatattttaaatgccctgattgtaattatagaatatgtggattttagtttgcagttaacatgtttcgaacattaccaccttcctccaatcctacgggagcggaatttgacccggaggaagatgaaccaacgttagaagcagcctggcctcatctacaggtatcgggctctgggtgatagactcggagggcactggtgacacatgggaatggcctgggatccacagagcgggcgcactggtctggccagatggacctctcctcctcagtagcatgggcctcgtaaacccatatgtacaagaaaaatatttcagcagaataaagttaatgtgtgtgtttgaccactttacaacagccagtgaagatgtgtaattgtgagtatgttctcagtgaagatggccgctgtgttgatggccgttgaattgaattcaggcccagaggtcctaagccaacaatctcccagtttttgctcctcatatttaataggtgcctgctgggcccccaggtcctgcgctggccactgcctttccccagggcatttgtaaggcagaaggttggttggcaaggaggcgccagggtcggcatgagcagagcgggggccaggtgtgcgggtgggagggccatccatccgtgacaggcggcccacgctgtcccacccagcatgtctgcacagggaaagaattgtcccagctccaggaggtcatgattctgggtccacatcttagggccctcttacctggcagccccagagttcctgtgtatttggttggctctgcgccttggcattgtgggacactcctaggcgacaggctgcaaatcccccctgcagagttgggtcatggcttggtttgtggcatctgtgccctgta

SEQ ID NO: 78064 - DNA, 1063 bp, Homo sapiens
gagacagacagatggcagatgagaccccccctgccaaaacccacagccctggcccctcccatcccgtgccggcttgcacagcctgcgtcgggagcaccctgcctttccgtctgcagtcattagggcccgcagccccggcctctcccatcccgtgccggcttgcacagcctgcgtcgggagcaccctgcctttccctctgcagtcattagggcccacagccccggcctctcccatcccgtgccggcttgcacagcctgcgtcaggagcaccctgcctttcccctctgcagtcataagggttgcattccctcctgacctgcacacctgatagggcatttcggcgtgagagcctttgattttgcgtgtggctttcctttgaactccttccaagtaccccacatctcgtttgtaaaatggagcccggtgctggacatagcccagacctgacacattaactataacagagaatgatgtcactttcctaaatgttatgtttctattttatgtttcttggtatcatgattcctttttaacaagatcattacttgcctggtatacttatctatgaaaacataatatacattatttaacatacaacaggtacaatttaaatttccagtcttcttgacctaaaattaaagctctacctaacatatttctgttttcttaattctagtaggttttgttcagatagcagaatcacaaatctattgaacatctgcatttaagaagtagaaaatgggccgggcgtggtggctcacgcctgtaatcccagcactttgggaggccgaggcgggcagatcacaaggtcaggagatcgagaccatactggctaacacggtgaaaccccatctctactaaaaatacaaaaaattagccgggcgtggtggcgggcacctgtagtcccagctactcgggaggctgaggcgggagaatggcgtgaacccgggaggcggagcttacagtgagccgagatcgtgccactgcactccagcctgggcgacagagcaagactccgtctcaaaaaaaaaaaaaaaaagtagtagaaagtgttttgtacctta

SEQ ID NO: 78065 - DNA, 1679 bp, Homo sapiens
cccctcgtggactgctctagaccaatcccaggtgcacgaggcttggggcaggagaggcttctttgtttctgtaggagccctttgcggggaggacattttcctgtttcctaacatgtccctgttccctctctttgtgcccggtttattcagcagacgtgttttcagcatcaaacagatgccaggcttgctcctagccctgggaacatagtcacgagaagtccttggccctgtctttgcagtggccccatctggagggagacaggctggcacagagggtagggtgcgtgtcctggggctcccctagaagcaggcgcagtggacagagatgtctcagaggaagggagctgggtctgtcgcagatgggtgcttcagaaagatcgcacctgagacagcacggaggatgcgtgtgggtgtcagtggggaactgggcaggtagaataagaggagttcaggaatcacttctaccctttgcaggaactgtgctaaatattgcgggctttaaaattaagtaagacattggcctatgttgaaatacagcaaaaacgtaagatggattaatgaacgagtaaaagatggatgaacagatgtgcgtgtgatcaagcagatggagcacattgctcgtggtcgaatctggtggttgaaatgggtgttcactgtagaattctttccgttttcctagatgcttgaaattttccaaaataaaatattgagaaaaaaattcgtgcaagaccaagttctctgccctcgaggcatttacagctgcaggccttgaggagtttctttggttcctgaagggctgcttgctcaccacgagcagtgtttgcacaaatagatgcgcttcttgttgcctggctccatggctcctcctagagcattgttttcttattcaggttagttcagtgtctaattctaatgggaaaattgttttttctaggtttatttatgaaacagagcatcataatggcatagcagagttactggaaatattgggaaggtaagcctctgttatgggtagcaaacggctgtagatggaatttataccagagtgatccatttcattgagtccagctgcccgctttaaagcaaggcagtttaaaccattctctaaaagaattcaaatacaatttcactgaaagcaggagttggtgagctcttagattagagcacgccaaatgacaaatctctcccatttttatggttctgtacgtagattctacttcgtatacctcagtatcattactatggaaacacaattccagttatttcctcaagagcaatgttaaaaatagttaacctaagaaggtttatattagaagcttgaaagaagaatagattgtacatttggggtatcatgtaaatgctaatatttttaattacttcagttttttatatgtatatttataaaataattaacatttcaaaactttcatcatctttatccaagtaaagtttttagttgcccttttttttttttttttttttttttctttttgagactcttgctctggcacccaggctcaagtacagtggcacgatctcggctcactgcaatctctgcttccctggttcaaacgattctgctgcctcagcctcccgagtagctgggactacaggtgcccgccaccatgcctggctaatttttgtatttttagtggagatggggtttcaccatgttgccc

SEQ ID NO: 78066 - DNA, 1023 bp, Homo sapiens
aacatatttattttctctgactgctcttaactggtaatatctttgcatccagccagattatcatattgttgtacaaaagaaattaatagttcagagatttaagatggaaccagattttaatttgttgttccccactgttagatgactcgttgattgtagtctgcacaaggaccccaagaaaatcccatcatactggattgacttagcggtggttagactaaaaagactgtttcctgatttatttttcttatttttatttttcagctttctgatctatcaccaattaatgggcataaatgttaatgcccgttaatcacacaagggctttgtctgtaccgtgggtccttgtcttgctgtgggaaggtgtttaacgatgattctagaagaagcacagcagcatttttatgttgaaatgttaatgctctttctccttttactttttagctggcatactgtgtagtgcagtttttagaaaaggacagcaccctcacggaaccagtaagtactgatgctagcgcgtcttgtaagatgtgtgcatttcactaaatgtaaatattacaacatctgcttcaccaaattgccattcattcagactttttcatcttaaattgcaatactaataaacaggctcatttcattcatgggttataggttttcaaagtatagtcattttaattgcagattcctttattatagtgattattttatgtaatgagattgccaccttgtccctcgttgcactttactgtttgaacgtaaagcacttgagcggttattgtagccactaaattttagtgtgcaattcagtagtttcacatctgcttggtttgacaacatattgaactgattatgatcagaggaattatagttagggtttgaaattattgttgtactaaagaggctttaccgccttgaaaatacttcccaagttacactgtaactattttatgatcattgaatcacaagtgaacgttagattactgctgttctgtgcgtggatctgtaattttttttcagcctcca

SEQ ID NO: 78067 - DNA, 4560 bp, Homo sapiens
tcgagaggccgaggtggaagagttgtttgagcccagggggtcaaggctgcagtgagctatgaacgcaccaacttcactccatcctgagtgacagagtaagaccctgtctcaaataaataagtaaatacaaatggaagggaaaaaaagctatggaaggagagatttttgaaagtatgtatttttctttcatgaattttctttgtgcgtatttctcatatcctgtagtggctgaacaattcaccaaatgccacattgcgtttaccacagacagaggctgctcccacctaagccactgtcccagcatctctatcccgccatccactgtctgtcagcctgaccctaaccttctccaccgagggctcggtgaatgagcctcaccctattctctcttccaccgaaaagtaacacaaaagcagagaatgtttgtaaaagtttttaattcccactaatatagtaaataaagtgaatatcactttgcaagagtgagagctgttaattgcagtcctgtctaaaagagggcaagagaccccgtgccggcttcagttgggtccttccggcgtaaatgttacatgcaggactctgacttggcaccagcacaaaggaggtgcaaaccccaccaacctaggccccgatgttcccacccggggacacttcattgcttagtttcctgctgcacagataatgtaatagtaccgtcctggctttagaaagcagattcaatttcctacatgttaagaacattcagaccctcatgtcagtaaattccctcttttgaaatgcctatttatgaaaacacaaaggccattttgtcttatttcagcattgaaagcttgttaatgagatgatcaaagtataggctttggtgcaggtgtacatctcttggtagcactaaggacacctggtgtccacgtccatctcccaggcctgcaccaaagggactcctgaagccatcaaatgtccaggctcaggaatgtttaaagtaagatccacttagaagactgagatatgaaggacatgtgttgccccatttgtagcctgtaattagtatttttcatttgctaattgtgtacagtgctcaaaagctttctgggcacatgaaacactttctctgttggaagaataacaaaagctcatcagagattttacagaagtaaaactgtgttccgttttcacccacctgcctcttcagtctcatcacattttactacatggcatagtagcggctctcctttctccttggtctaccaggacaggaagggggctccccaagactcaaggctggggccactggctcgcctgccctctgcagggagcgggcagtccttgggcttccaaaggaaaactcggggccttgtgctgcacccagcagcacacagccattgttgcctcggattcacattccctgagtagacaccctcctccacagagcacgccacactgacgcagcaaaatagctgataccgatcacagctcattccaaacaatgtgaacaggaaggcccgtgtgtgaatccgatcccagaaatgataccttttccagagaaatggaatagctaaatcggttgtgttgtatagttcacaaattaacatatttctcctaataaaattccatttgacaaatgaagagaaatagatgtaggaagtgatttccatctgctgtgtccttaatagtgattccaatacacgcaaagtgtggtaggaacacaataaatacttattcaatagttttgagctaggagaaccattaaatgatgcatttttagaaataattccttttaaagacacttgtatggtagatttttatgtcagacttgaaaactagcagcacttccttttttatttttatttggctcttttggggtttttgtttgtttgttagattcttggagtacagtggcgcagtcatggctcactgcagcctcaacctcctgggctcaagcaatcctcccaccttagcctctcgagtagctaggaccacaggtgcccatcaccacaccaggctaatttttaaattttgtgtagagacaggacctcaccacggtgcccaggtcggtctcgaactcctgggctcaagcattcctcccacctcgacctcccaaagtcctgagattacatgcgtgagccaccacgcccagccttactttcctttgtttcatgaattttggagttttataaagtgtaatatcataaaagattacctgggagcccaaatgccaaagcatcaaaacaaaatttttctaaatggatgttaaatgtccacctttttaaaaaatcactgtaatgactaaaaggctggcctgctaagccatgagttggtgcgatctactgagctggaaatgactagtgagtgaaaacgaccaggcggtcccgggggccagcacttgtggcaattgcacagcacaagagtcgggtagaagccccgcggtgttgctgtgacgaggccaaagagctgctctaacgcaccggattgcacttgtacaattcagtgtgtaagcacatatatgcacttcatatgcaaatgcctgttttggattgttgtactcttttagaactaagatggctaaactctaaaaatattatgaaatctgcatggattcacattcagtattttgtactggtatgattgtggtaagacatttggaaactacaggaacatataaagaaaggttgcccagtggaaattctttctagctgtctgacttggccaaggaacataaaacatccactatccacaaactgggaaaccactgcagtccgacgggctgtgcctggcagagagctggtggcacagaccctctgggtggtgacaatcctggctacagctgccactgcagcctgctcaccgcaggcccagcactgctcaggctgttgtatctgacgcccacaggtgtgcgcacagagagcacagtacgccctgcccgggaggtcccatcgcagtacctgtggatgtgagttaataaggtcagcttaattcacatcactccttttgatatattttaacacagttgaaaacactgtctatgcatacagaagtatgtgtgtttgtgtataaacacatatggatggttgataaatttgagaaagaaatgggttgtgtacacgtggcccacagtttcagtactggctgcttccacaactaaaatgtacacatgaattgataatgctctgtgttttctccgttgatcttattctttctaaattattgtcctaacttcttatttttttttctttttttaaaaaaaggaatggactcttactgaaatggtgtttgatcagagaaagtgggttatataaactaaaattgtgtaatttctgaagtgtataaaattaagccaggcaggtggtacgtgcctgtggtcccagctactcagaggctgaaagaggaggatcacttgagccaaggagttcaagtccagcctggacaacataatgtgacccatctctaaataaattgattgatcagatagataaccagacagacagacctacttctcaaatacagaaaatcacatatgatgactgagtcactgttccctctgtaaggaagatggcaccatctccgtgtgttgccttgcagtggggccaccgcagtgaaaacacagacttcttaccatgcaggtgttggggcctcgtgggcatcagtcactccacgtgtcatttcttttgtaggtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtatgtggggcttgggggacctgattaaattcttccagtgttcatttgggaaaggaaaagttccatgcgtagctggccatgctttgcctctcatgcaatttaaaggtaaaatccaagtttttacttgaattatacttcaaatacgatgctgtaacttgaattctatagaatacccttgagcatcttgtcccttctgccgcgatactttttctcactaagagcagtcatctggcttctctgtaaagctgtctttatcttcatgttcagtgtgcttccaagttcataaacaccctcctttccacacctgagcatcaatattgatagacaacgggtggccaaagcctcggctctgagatgctcttgctgccgaggcccttcgttcctgacactgtgtaaatctgtctccctttaccctttcaaaaaggctgagagctctgacttttgtcactgccaaattcctgtgcgagaggacgaccttggtcagagctactttctactttcttttcccaatttccttaacccttcaagccagcctcggctcatcacctcttttgaaggccacccccacacaccttcccagcctgcctgcctctgttggacgtgctagccacctgtccttttgcatcattgagcggattttattgtgcactcatcatgaacaaggtgaaaataggcacaaaataagcaagacctcccggtgcccagggagcaggccacacag

SEQ ID NO: 78068 - DNA, 1070 bp, Homo sapiens
tctccatgcgtgtcagagcctgagagctaagcattgattaagctgttttatgctcattttattttctctttcaaagctctgtgttgccattattaaaattaatttttctgtcctcagggaataagatgaaaagaaactgacatttataggaaatcaagtattgccattattgtcctctttataattttgtcttaactatatttgttcaagtttcaatgtttttaattcagtttctgagcaaggtcgtttttggctactgtcagctggagacagtgagtggagtggcctctgtggctatgtgagagccactgtgaagaaagtctcgggatgtgtggctgtcagaaaacaagtaacgcggaatgagcaggccttgcattttagaccttagggatcctgtgcgatgtgggactgttggaatatggagcagcctgagagtggagaggcgagggctcagcaggaatgcgtgctcccaggctcaccgtgcggttttctttataggacaatacatggcttgatatacaacgccctgaagctcttcatggagatgaaccaaaagctatttgatgactgtacacaacagttcaaagcagagaaactaaagtgagttgttcctttcacaagttactgtttccaggatttttttcttaatcctaagtaaacctcttccactgttttgtcctaaaacggtattcttcactcgaaagcaaaaccaagcctttcatacttggaaagcaaattaaaactgtgttataataacgtattttgaaagaacaggtgtttaaaggtagctattctccccccttgtattgccagattaatcatctttgcaaaaagtgcttatgtaagcaagaatttaacattcagaattttttcttttcttgggctataatgggcttaaaggctataatgtgtagtccattttcatgtttataaggcagggatttgaattatatcctataaggtttatcccagagagcaagaatcttcatttcaatgtagctttattctgatttaatgaactcagcgatgtgggtgttctctggaatctagtctgtcctttgcaaaatcag

SEQ ID NO: 78069 - DNA, 2890 bp, Homo sapiens
aatgggaatgctggctccttttacagtactggtccctttacactgtactgcatactcgttttttcagtggatatatgagcttcttgtcaaaattatgtgggtcccatgaagaaacatctaaccaggggaagggggaaggattgagacataagacgtacttatataagatttcttttaagaattccaatcttggacatgttaaatttttttatattttctcatgtttaaatctcagttcgtttttcatgctgtgctcagcacgtaagtgtggggaaatggagcaggggggctgcgggaggagccgctggctgggctcaacatgcctgtgccttttccccttcagtgtgttcttgtgtctgatgcatctctaacacagatgacattttactgtttttcagagagaagctaaaaatgaaagaacgggaagaagcatgggttaaaatagaaaatctagccaaagccaatccccaggtactaaaaaagagaataacatgaaaacgcccagggttacttgaatgtttttataagataggaatatatgtcttcaccatggggggggtctcgatttcactaacgttgtatatgaaaatgtctgcaataaaaagtacttttaaactttgtaaccctccttttgtacaagtacttattttgccccatatcgttttaccacagaattgacttttttcctctgctttttaaataagatctgaatcttatgcatatactgtggtaaaaagaaaacttgaatacagcctgagactgtgcctcctctctcagatatcatagatgctgtcactcaaacagcatttccctttctttttcatatgaaattagttctaaaagaaaggaaattagattggaaatagattaagtatgacgttttgatgtcctctttctttgtatgaggtttctgtaagcccagccttttatcattaaaaatcagctgaattctgccacattagcagccaaccctccttcccaccccagcagcgggtgccagtgtgctctggtgagtctgcgccgatggccggacgtcccggagctgccggcagttccagctgccggggctgccagggtccgggagggtttcctggtgtcatggtctttgggtttgatgtacgctgctgtaaatgactagagcgttatgacagtttcttcacgttctgtgtgcctgattataacagtgcctcttaaaaagaaaatctttttcagaaaatcttttgtctgaatctttgccactcttaagaattctcaagctttccttcaactctccagaaaagattttaccgaacaatgtatttcttttagtgagagatatgcatagttacctaagttggtttttagatttctctgacacttaataaaaagttatacatgaatataaagttaaaagtatatctttacctatataacaacatactggtttgtatactctgataaaactgcaatcaggaaactcaaatcaggaaaacggaatgacatttctaattgtgagcccttgagtccacctaaaacaggtagccagcatttttctagcagttatttactcatgctgacagaaatgctgttttaagattactgtctaaaactgtataatccttaattgaggtaggtagctataggcgtctccttttaacgaattgaatttatgttgaaagtgtggttaaaatactgatatttgttttaaaacatggtaacactataaacctgggcaagtttataaggcccagccctgcctgacgctgccctgcgtgtcttgctttgttctgaagagcctcaggcaaagtgggtgctgatagccctcaggattgtcaaggaccccagtacacatgcagttgaaatcagtagcctcgaaaacatgtgagaaatgaatacacacacacacacaaacacacacacacgaatcagaaggtctgattttatgtacctagaatatagagataacttattgaaaaattgcataaaattgttacattacaaatcaagagctggttgtttgtgttgacaaacatggcccagtttcactactgcacatactgtacgtaaccaatgtttcttctgaaatacgtattgttctcttttttctttttctcaacttttcctgaatgttctcaagtaactttctgtattctttttggttgctctctttgcaaacgtctgtggtggtggcaggcatgccgtggttctgcataggagctttgacgaactgtgatgctgggagcttagccctgccttgtcctcatgtctgtgttgacgccatctgtgacgcagtccccatgagtctcgtccacatgctctagtcgcatggcacatggtctcctaaacagaaaatacttcatgggtcaatacctcagagctggaaactctggcctcgtacttgcttctcattctcaggagaaaatatctaaattctgatcactgcttcccattacaacagcaacaaaaagtcaataattttgtggataatacagtctggttatttctgtagtgaaaatagttgggttttcaaagtttggttttccatctcagatctgcctgtggagaattggtttgcgggctttgtttttaaggtgggttcccagggactcgctgtgtgttccctgatgccccccgtccttgcagaccgagccttcgtccactcaaacgtgtgacagcacgtacccagcaggcgttggggacccgggaaggctgcggtgccctcaggagtgtgtcttatttgagcagttatggcaactttattggggtttttaatgtcacagatgatttaattttctaaaatcatgaaacattggcagtttctaacataaatgtgtttctcctaatccatcaaaaggggccatataatattttactactcacttcccccagcttttgtgggaatcatatgaaa

SEQ ID NO: 78070 - DNA, 1063 bp, Homo sapiens
gaaatggctttaatgacatttatgaaataggaggttacttaggaaatttactaaaatgcatgaattctgcaaattagaggtactgagtcctttgtacaagcactgcacatttcagaagaccagaatgccagtattgaacacacaggtcctcaaacgagtcacgatttttagtagcaagacatttttggcaaatttccatgataagacctacgccgtttccctgtggccagggtgccgccagcgagtgggtgaggcacacgtgcctcgcggttatcctttgacttccacctcagaagtaagcttgcttttcagatagcttagtttgtagccaacgccattgcatttctaattccaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtct

SEQ ID NO: 78071 - DNA, 2145 bp, Homo sapiens
taaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaatataggtaagtggcacaattatttttctttagaaaatatctgtaactttatgcattagtgaaatgttaagtaccgacatattttttaacattttgtaattcaaaactttttgttttgacattgtttatgaagagaaacttcatacacttgccatttaatatgctcttttatctaattttcaaaaactctaaaaaacggtgtatcatatggactaaataaagaacatgtgaattttattgctcatcatgaaactaaatttagccatggtgttgagcaagctggctctgacgttatcgggttcccgttaggtcagggccgcccacacacagggacgctgactgcagaggggctggccatctccatccagcccgcctggagcgctggctgcgccagatgcta

SEQ ID NO: 78072 - DNA, 1051 bp, Homo sapiens
aagtttctctggctgtgtgctattcgctgcgtccacagcagtgaagaagacagacgcagcccctgaccaacctcgccaagcccgggcgccgagccaggacgttgagccaagtccccatctcctaggactcgcagtgcggaggctgcgggccccgaccagcgccgagactacaagtcccagaagggcgcgcggcgacatcgccgggcccgccccccgcgcacgcgcggcgccgtgacgctaaggccgcgagcgagcgcgggtggctgcggcggctgcggccggcggggcggggcggggccacctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaaggtgcggggccgcggagggcagggtcgccagagccaggcctcgcggaatgcagggcctgccaggtcctccggggtcgcagatgtccccgggatgggaggagcccggcagctgcagatgacccctggatgggcagagcccggcggccgcagacgtcccgccggccgggtccccagggccgcagacgccccgcagaggccggcgcggcgcccggggctcgccctcgccacacccactgcccggcccggagcccccagggcgccccgctcctggtcgcggggaggggaaaggggtccccgtctgccgtcacccaaaacaatggggtcgctttgt

SEQ ID NO: 78073 - DNA, 2017 bp, Homo sapiens
ggtgtcccagccctgccttgtggggacccagaggccgaggcccacagagcgacggtgccagccccgggcctgcgagcatcactgttgtaggtggatgctctcacagcatccttgctgaacgggtgtatcctgattttacacctgaggaaactgaggctcaggttaagtgatttcacccaaggtcaccagctaatcttagtcctgagactagactcagtgtctcagctccccatccactgcttgttttcactgatcatacctcatatttgtttaatgcttcgatgatgttaatgataaccctgtaatatttgagtctaattttacagattaaaaaaaaaaaaaaagattcaggttaggcacctagtagggggaagaggctagagttagcgtgttccagctgtctcctcaaataatgatcgcccaccagcaaggttacattcatctaagtctggggcttgcctgcaggcaggctttctcatggattcattacaaccactttgtagcccattacaaccactttgggtgtggcgtgtccatctaagaacctaaggatgatgtccaaggttagcctctagggattggagattgtctaaaaatatttgccaacaagcttcttaaaatttcaaaaaactgtatggttctctcagtgagagaccctgtactgtctgccccatccttaacacacactgtgtttctgatggtttgtttctttcaaaggctattcttactcagaagatgcttccctgtagccttggtttcctgccagagattagcagggtgtaaaagaatatttttttcttatatccacgtggaatgttcaaggcaaataaaccatttgagcatatttagagtattaatgtttttgagggttgtttactgtgatgtttgggattatgtattcctaagtggaagccacaaaagttaaaaaaaaaaaatttatctactcttttttttttccaaaaaacatatagtcattgtagaaaatgtactatacagctaaagtaaaaatcactgggaattgtttgacccagatataatcactgtcagcatttttggtttatgtctttgtggtcatttttcaatgcatattcgtcattttattaaaatacattttaatctgcatttttaaagttaattgtattttgagtagcttgaccattgctaatccttgatatttttattgcatagtttatgtattagaatcagtgattttattttttttaccttgtgtcactctttttatgaaaaaaaatttaagttttatactttgcttctagagtgatcaccagtaattcgctttttccaggcatcttaaaattggacgttgctaaaattattggggtggggggactatgtttatgtagtacaatatctactacaaattctctctgttgtcttatgagtacctttttttctttcagcaaaacaaatatgcaggtatccaaatcttggctccataatgacttgcacttttgaaagttgactaaggaatgagactatctaaaattgaaatcctacctcatttctgtatttataacaatccttgaagtatttctaccaattcaacctgtctataatttatttttcacttacaaaaacctaaggaaagatttttaaattaatccagttttatgatagatggtctgtttgtcttattagcagcctggctacactaggacaccttagatataagtagagacccaggacttttggtaggagggctttcttcttggtggcttttatgagttagctttggcatttgtacatttaatcaaatatgtgcatccagtagttaattacagtgaaaagataggcatgcattaatgtagacaacagagctgaattatttaaactgaataaagatcaccaacaatgaagtcatgtaatttaatgaacagtagaaattacttttatttattttattccttccactttttttgtggaagtatccaaacacttgtaattgaatatagaaacatttttatgtgaaactatatatattttttatttgtttgtt

SEQ ID NO: 78074 - DNA, 1051 bp, Homo sapiens
ccagcctgggcaacatagcaagaccctatctctacagaaaattaaaaaataagccaggcatggtggtgtatgccagtagttccagctacttgagaaaattgcttgagcccaggagtttgacgctgtggtgaactaggatcacaccactttgctccagcctgggtacagagtgagaccctatctctaaaataaatcaagtacagcattactcaaagtatagaataaatgttgtgaatttaacaactcatcttgatactgaggaattggagagtttgtgggaaaaagggattaagttatagctcctcattttaaaaagagaaacctttgtatagttcctggcctgtaggaaattgtcttcctcatagtatgcttacagcatggtgacaaaataggtgctcattacttaactagccattttatgttaatgacgtttttgtagcattttttacttcaaggaccattttttggttgtgtatctccgttcggtggggtatgcttcagtttgcagctgatggaactgacatttccatgacttgtctgctctgcagcttgttcatgacctgcctgggattggctgctaggttggttggtctggatgagagcgtgtagtttgggttttttgtttgtttttggtggggaaagggttttgttttgttttgttttgtttgagacagggtctcaactgtgtcacccaggcaggagtgcagtggcccagtcatggctcattgccacctcggcctcctgggctcccagttcattttctcatttttttaatagagaggaggtctcaccatgttgcccaggctggtctgggacttcagggctcaagcaatacttccacctccgcctgccaaagtgctgggattacaggtgtgagctaccacaccccacgtgtttgtttgtttaacactccagtgtttgagacttggaattttttttttgagacagggtctcactgttgtccaggttggagtgcagtggcacaatctctgctcaccgcatcctcaacctccggtctcaagcgatccacccatctcagcctcctgagtag

SEQ ID NO: 78075 - DNA, 1363 bp, Homo sapiens
gccttccaagagctcacagccggggaggaagatacattcataagtcaaacccagaacagactcagataagtggtgtggcgcagcagagggcaaggctagacgaatgcttctcagtgacccttgggatgtttcttgatacttttcttgattggggtttgtcttgggcctggccttgatgaaaactggccatgctacattgtggtgaggagcctggacttcggaatcacaaacttctgaattctcacattgttgcttcccacccaagtatctgtgggcaagttactgatattctttatggagaaaacaaggataataatagtcacaccaaccccatagggttaaatgtatgatagctgtaaagtgcttagtaaaatgcctatcacacaggtgttgctgagtgaacggctgagcagaatattcttgagagcaggggtggaaagtgacttctgtgtttgaagcacaatgaatgagcttcctgggatgggatgctgagaacttggccatagccagcagcggctagcactgcccaccgccaggccctgttccagtgctttcatgcaccaactcagttatccttgcagaagccctggcatgctcacgctaccccacttcacagacaaccgccttgcccaaagtcacacagcaaagtcaggagtgaggaaaaaaacggataggaagggaaaaatagtgccaagtcatgtaggtgtcgatatgtcaggctgggagtagggagaaaatagtcattgtctaagcagttgataaataagaaattggaaatgttgatattaatttgatatatttattatgatttgtagaggacgtcggtgatgaaggagaagaagaaaaagaattcatttcctataacatcaacatagacattcattatggggttaaatccaataggtgagtagtacaaatattaccattatctcaggttataaatttgtgagaattaatatgaatcttttttcttttcaaactcagaaattcttactaagagaattaatataaatcttttttttttttttgagacggagtttcgctcttgttgcccaggctggagtacaatggcgcgatctcggctcactgcaccctctgcctcccgggttcaagcaattctcctgcctcagccttccaggtagctgggattgcagacatgcaccgccacgcctggctaattctgtatttttagtagagacagggtttctccgtgttggtcaggctggtctcgaactcctgacctcaggagatccacccgcctcagcctcccaaagtgctaggattacagacgtgagccaccgtgcccagcctaaaattaatatcaatcttaattgactcagacaaacacattaagaaaacactc

SEQ ID NO: 78076 - DNA, 1594 bp, Homo sapiens
atgagggttagaatttcagcagatcaatatagatttcttaagcaaaggcacaaagcacgtgatgtgtttagggaatgggacatctggtctaagtggtgtctcagggtgggaaagaggatacatagcaggaggtgaaacaggaaaagctgagtaggaccagactaaggggagcctggaatggcctcttatcaccttaaccagtgagcaacttttgtttacttagtacagtaaataaatgttacacattagtgtaagatcagatttaagtactacttatatttctagggcaggttagttttaggccaatattacgaattcaacccatgtatgagacaagttaactttgcctggtttcatgtttgttcacattctgtaaccataaccttgattcagtagctctcatgtactaaagaaagacaagcagtgcatttcactattagaaaagcaacacttcagtatattcttgtatgatttttaaattaataagcctaattaggagtgtaacttttctaatttcttgttttatttttctttttagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacaggtaaaaactgtggtttgaatgttatatttcacttaatgttcacaagatagtatagaactcggtgtaaaacttgggaattgggagggtaacgctagtgagccgaggggatataaaccctgtgtattaataaatatgtgtgtcattactatttgacagacctgaaatgatgggatctctttggagaccaatagcacactaaatgttgaggtatgaaatctgtttttagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtaagagcacaggattgaaagttatgtaaaatatgttactctttaatatctttgggaaaactgatctggattttgtaagtgaggtaaattatgtgataacttgttagtggtgccgcctcttggtcctgggactgtccagtgcaggactagccttggtctgggtggaatggtcaggggacagtgtgagattgcttgagtagtcaccctgatagagcattaatctcagcagtcgtatacctttgatttcaaatcaagccacttttgatttacagggaaggaaatctacttgaaatataaaaattgagttgtaatgcatgtgttttgttaacgatatctattctaccttgtttaaatagtgaatacccttgggtgttattttattttcaaaggtgaccaaact

SEQ ID NO: 78077 - DNA, 1582 bp, Homo sapiens
ggaggttgcagtgagccgagatcaccccactgcactccagcttgggcgacagagcaaaactccgtctcaaaaaaataaaataatagaaataaagtgcacaataaatgtaatgtgctcgaatcacctagaaactacccacccccccaccaccccccaaccatctgtggaaaaatcgtcttccacgaaactggtccctgttgccaaaaatgttgagggccactgatatagaaagcaaagcaaagcatggtaaattctctgaggctgccaccttcagcctttagagtatgtaggaattgactcatactcttaaataagcaaaaatggagcgccactagggttatcctgttaataacgtgttgttttttcaaatatgaatagtttttgtctcgctagatattttgcaacatcaaaatgttccattgtaatggcatattttagtttacttagttttgttactttatgtgaaaaccattaactctttctctgttaatataggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagtaagtttgaatatataagacaaccaacctcaagacattgagatgaaaatatgtcttaataataagcctcacttttgaaattatatcctaggttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtaagatttgcattctaaaagtttgtgttttgtttttgtttttgttttgttttttgtttggtgttttttttttgttgttgttgttgagatgaagtttcactcttgttgcccaggctggagtgcaatggcatgatcttggctcactgcaacctccgccttctgggttcaagcgattctcctgcctcagcctctcgagtagctgggattacaggtgcctgccaccacgcccggctaattgtttatattttgagtagagacaggcttttaccatgttggccaggctggttttgaactggccttcaagtgttccacctgcctcggcctcccaaagtgccgggattatagacgtgagacagcatgcccagcctgtttttgtttgagacagtctcattctgttacctaggctggagtacagtgaagtgatcttggctcactgcagccttcgcctcccgggctcaagcagtcctcctacctcagcttcctgagtagctgggac

SEQ ID NO: 78078 - DNA, 2949 bp, Homo sapiens
ggaatgctttatttagtctctttttcagagagtccttctctgtaaaacatggatagtaattacatatgcctgagatttataaaacaattaaatgactaatttctttatatatatttttttctcttctgaatttatctttcattcttcttttttgttttttgagatggagtcttgctgtgtcgcccaggctggagtgcagtggcgtgatcttggctcactgcaacctctgcctcccgggttcaagcgattctcctgtctcaacttcccaagtagctgggaatacaggcatgcaccaccatgcctggcaaattgtttgtatttttagtagagactgggtttcaccatgttggccaggctggtctcgaactcctgacctcatgatccgcctgccttggcctcccaaagtgctgggattacaggtgtgagccactgcacccggcttaaaataaattttaaagccttcgtttggtcagcatttcttgattacatatctttctcctttaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgcgaataccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtatgctctcatgtaatcctcaggtgtcctggtaacgaatgaagcacagtaatagcgagctcagttaaaacactagttctcccgaagaaggcatgcatggttgatgcagcatacggccatgtgagctgcaagggaggaggaccctttgtactcaccgggctatttaatggtgctgggttttagggaggccattaagtaacaacctgagtttagaaacaggtggagagctaaaggacacaggagtccaacagagagcagaatgcagttttattgctgctacagctgaaagcagagcaggctctaggtctcagccacgaaggccttacccagagcctgcggctgccagcggaccagatgcatacgacagcgaggctggctccccaggcacaggaggagcttaacagagcacgtttacttccttctcccagatttacccatcagaggccacctctcccattgagtgggagtaagggaagagaagctggggaggctccatgcattttcctttcctctgcaaggacatgcgagtggggattagtgttctcaccccagcagctaggattagctacttatggaagaactgtgcctggagcatttgtcaatgtataatatttgagaagaatgttatgtgagaataaaggaacagagtgtgagtgggtgttttaaatattaaatatttcttccttcaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggaggtaagggatagaatttgctagcattttcctcctttttcttctgctgaccctccagtaagcttattagtttgtcactaaaaagcatttttccttggaaattatctgtgatagttcaattcccctccaaaatctcatttaactagtgatagaactgaattgtggccaggcacagtggctcatcatgcctgtaatcccagcattttgagaggccgaggcaggcagatcgcttgagcccagaagtttgagaccagcctgggcaacatggcaagaccctgtctctactataaatacaaaaactagccaggtgtgctgatgagcacctgtagtcccagctactcaggaaactgaggcgggaggatcacttgagcccaggaggcggaggttgcaatgagccaacatcgcaccactgcactctagcagagtgagaccctgtcacacacacacacacaaaaagaaccaaattatgatactacatgtcagtactcacatcaagtttaag

SEQ ID NO: 78079 - DNA, 1125 bp, Homo sapiens
tcgtgttaccttttctagccctccaggtgtcctcctctgatgaccctgccactccccaacacccaatttagaaacagccacattctgcccccacccgtatccccgtagacaagtggggatgggtagaaggtgtggtatgtgtgcataaagcacacttaccaatccacgccttttcccactggtggacttcagagagcacaccagtggagagtgttggggaggaggatattttatagcagaggttacaggttgtgaaggattggtgattcagtatccaaagatggagaagacagcctaacaagtgatctgtggctgggagaaagtgagaaagtgagattctgagaagagagatatgaaggcttctagtccggaactgtgtatcttttatctgaaacacctaccactttctgattgacttgctttgtgagctaacttttagaagaaacactgttctctgatataacgttgtctgtagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaagtgagtgcttctgtggcattctatttactaataagtgaaataacaaaactctctcgttaaaaaacacctatggaaaggtcacttagtgtggacacctggcagatgccaccttaaccaggtgatgaaggtcagcctcaccagtggcgatgtgcaggtgtcatgtgccctctgatgtgatgcgatgggaagggcaggtcacctctgcgctctttctccaaaatccctcactctcatgtgagatgttaacattggagaaagctggtggaggatatgtggaaactccttgtacttcctttgaaactctcctgtaaatctaaaataattattttaagtcctaaaaaatgaaaaattaaattttaggaaaaaaactacactggaaaaaaacttcttaccattcatgcaataaattatttcaagaactgcatgtaatccaccagaagtcagtgttcagaccatgacattgaaacgtactccactgttttaacaaaggtctcagttca

SEQ ID NO: 78080 - DNA, 4746 bp, Homo sapiens
acaaaaattaactgggcatgatggtgcacgcctgtggtcccggctacttgaggggctgaggcgggaggattgcctgagcccagaatgtcaagtgagccatgtcgccatcgcactccagcctgggtgacagagtgagaccctatctcaaaaaaacaaaaagcaaaggacttggcatggtggctcacacctgtaatcccagcactttgggaggctgaagcgggtggatcacctgaggtcaggagtttgagaccaacctgaccaacatgctgaaacccgtctctactaaaaatatataattagctgggcttgctggcgcatgcccgtaatcccagctacttgggaggcttagaattgcttgaacccgggaggcggaggttacagtgagccaaggttgtgccattacactgcagcctgggcagtaagagtgaaactctgtcttaaaaaaattttttttattgaaaaatagattgctgagtagaaatgaaacctttctttcacagaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtaagcctttggtgactcgaggcacacgcctctgaccaggactctcatgggctctgtgataccacttcttcatggtgcttctttagataagctcttgatgttgtttacaaactccagacatcccaggggaaagttagggaggctttttgtgccctgacctttttttccaactagttacttggcatttgtagcttggtctcagtagtttcttcgaactcctgtccatgagcatctttgggaatctcaattcctgcttctccctctcctccccaccccccactttttattaggggaattttaaaacatacacaaaagttgagggaatcaagagccccccaccacacagctttatcaatatgtggacaatgttatttatattttctttcctacctctccacccccaccagattatcttgaagcaaatctcagatataatatactcttagtatatttttagaacaaaaggaaatctcaaaagaccatttagtccccagtgtcacttctgaacagaaccagtggcttcataaaaaaagatggcacaacttctgctattgcagactcttccagaatttagtgataagacattaaccgttttcttaactttgaatataaactcagatctttaaggattttttttgaggtagttaattgcctatggctaaaatcgtggtgatgtttcacctaatgctgggcactgtccagctaatcagaaccaagctatggatattggcttctgcccttcaaggagtctacgtacaatccttagcatcattctcatcatgttactcctgtttttaaccagccgtgtttctatttgcattgttctcttgcttatctccaaatttaacaaactaaagccagcagtctcctttttccctagagcccatcccctcactctcgtttagctgttctgccctctcttctgggtcttctttcagcacctaaacgggaccccatgtcccctgcaatcttcataaggaagctcccttctcaggcactcatccagcctcctccagcactgctctgtgtgatcgcccatagccccaccctgctgactagggggcttctctgtccttgtctcacctcttaactgcaagacttgatggaggctccctcctgcgtgatgctctggactcttcagaacaccgtgcctcctggttctcctcccacctcagtggctggtctcctttctcggttcctcttttgccttccccttaaactccctctaaatgttctgttccctctccactcctgtgcactctcattgtggtctcatctagtcttgttgactttaaatgccacctgcaggctgacagctctgtgttcgtatctccagctgacctttctccctactccaggcttgtctgggcagctactagcatggcatctccacttggctatctcggagtcgcgtcacactgagcacctcttgagccctgcctccccaagtttgatcttccctcagtctttcacttctcatccttcagctcattcaggccaaaaatcatggtattgtccttgattcccattgtgtgtctcttgaaaatgaatgctgagctgtttcactggcaccactccgtacaaggtaccatcacctctcacttggattattaatattccctcctatctgttctctctgcctttgcctccctaaaatctgttttcaacacagcagccaaagcaagttttagattctaagtcaatcctgacactcttttcggagcccttgaatgacttcctatctcactcatcatgaaagtcaaagccccagtggcttgctgggcccgtgtaatgtgttgcttattatttctctgacttcagctcctgctgcttctcccttcactggctctgccccatcacactggagtcttgctggtcctcaaacatgccggtagactcttgcccctgcgccttcacatttgttgatctcaactcagaatccttgatggcaaataatcacaacttacccctctcctcctggtttctcgcaattctccccttctcagcaaggcctttcctgacgtcattactgaaaatgcagccttccccatgctgtgcccacactccctctccttctcactcttgctccgtagttctctctcaccacctgacattctgtgtgttttgcttattccctaatcgcgtctctcctcccatagagtgtaagtccctgtgagcagggatttttatctgcttgttgtacctagaacagtgcctggcacataacaggcactcagatagttaaaatgagcaaatggcttcgtgcacttttcagctgtttttgcattgccaaatttctctgttgtcattaatgttcttgtattggtttgatgagttaaatataagtaggctttctggttacttgtggccagggtaagtggatgttatcccttaaatgccattttggtcatgagcttttctttcagttcattttaattaagtaaaaggtgacacttagattaccattttcatatacactgcttgcattcatttcggctttggttggctaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtaagaaactcctaatttcattcaaatgtgcatatggtctattctagacacttaagagtacaagatataaagaacatggagctaaaaggtcttgactgtatgtatggttcactagatactatttgctgtttcaaagcagagagtaaatgataggatacatctttttgagttttaaccatgacgttcaagaatcttttttgatatgaaaattctgagagtctgaagtgagaatttctctaatagtggtgaaagacatgaaccttcttaatggaatgtgaacataagaggtgccagtattctacaaaatgaaaactcaaactattatttaactgtgttcttcatttgcaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtgagccctgctgtctggttgaaaggtgtcacgggtagtgtaaaagcaacatttctgttagactgatattcatttgaaggataaacacgccagcaggaaagagctgatgatgtgttgtgtgctatttcaccctcaggtacaatctaaggtgaacttgaaatatgactcttggcataaggaggttcttagcaaatttgggcagatgctaggatcaaacatgacggaattccattcccagatctcaaaggtgaggacataggattctgcctctgtaaccggtctactggtgaaccccagctctgtgatgaaatactcccctctctctgaacagtcccgccaagagttggagcagcactcagtagacacggccagcacctccgatgcagtgaccttcatcacctatgtgcagtctttgaaacggaagatcaagcagtttgagaagcaagttgaggtgagctctgtgcatatttaaaaatttttggctgggcgtggtggctcacgcctgtaatcccagcactttgggaggccgaggcgggcggatcacgaggtcaggagatcgagaccatcctggctaacacggtgaaatgctgtctctactaaaaatacaaaaaattagccgggtgtggtggcgggtacctgtggtcccagctactcaggaggctgaggcaggagaatggcatgaacccgggaggcagagcttgcagtgagccgaaattgtgccactgcattccagcctgggcaacagagtgagactccgtctcaaaaaaaaaaaaaaaaattacactagatctctagtttaatttggcttctatagtattttgcattctaagagaatgacctgactcaacccttaaggcactcttttcttagtatggcccacagatcatctctgttacaacagcctgatgtgcttgttaaaactt

SEQ ID NO: 78081 - DNA, 1219 bp, Homo sapiens
tgggctctcagaggatgttgccctctggccacgatgtcttaggatggatggttttaggagaagagcacatgtgttgatcttctgtgttttgttttgtttgaggcagcatctcacctgtcacccaggctggagtgcagtggcaggatcctagctcactgcagcctcaatctcccgggctcaaacaatcctcccacctcagtctcttgagtagctgggactacagatacatgccaccatgcctggctaatttttttctttttaagtagagatgaagtcctgccatgttgcccaggctggtcttaaactcctggactcaagtaatccacctgcctcagcctcccaaagtgctgggattacaggcaagaaccactgtgtctggccagtcttacgtgttttataactataaagtgccttctctttcatggggctctaattaataatttctatcattgttatagaagaaaaaacttgatttattttttaactctcaaagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacggtgagtcccgccaggtggggacgcaggagactcctcacccagcagtgtgatttggtgactttctttcaagcctaaaaggccttgctgtgactgagctttctagtattgaagactcttttcctttttgtagttaaaaaagcagatggagatagcaaatgtgaaaatatgaagcccagcttagacctctttttactcagaatggcattcagtagctggttttaaggattaaagtttttctgttcttagatcattctcttacgtagatatgcgcagaaattagagtttaatttcctgtagacaaaggccaagctttccactgctgctgctagttaatttaattttggttggatggtctctgtttttgccagtgctgccagtggattgtggggaggcaggttctgttgtcttcgtcattgtagccatttaaaccttccaccacccagaaactgccacatccacttttcttcatgcattgaagtatttatt

SEQ ID NO: 78082 - DNA, 4067 bp, Homo sapiens
tctggtgatttctcattcctctcttggctgggtaactgatgtaacaactgtgttctctggggaagttgtggctggcaggccccggaggtttgtcctcttctatcactggggatgtgcacttgaggccgagtctgtgctgcctcttctcccgccttccagggtactgaataagacaatggctaaatcaagagatgctccaccattctattttatttatgtaaaatgttcatgtaaaaattaaattcgctactgtacacacatccaaagtggacatcttgttgaatgtttccttatgaagatgtgtgcaaagaatccgaaacgtccagaagccctgcaggctctgtgcaccattttaaagcctaaatgctcatctctcctgagacattgtgctccaattctctgtgctctgactgctttcagggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtatgaaccactggggagtgggtggagaatcccgctccccacccggactctgccattgactttgttcatcctcagggccctgccagattctggggtgatttctatttccaaagtcaactgctttactattctcaatcgcaggtggccttagaagaattacaggacctcaaaggcgtttggtcagaactttctaaggtttgggagcaaatcgatcagatgaaggagcaaccctgggtttcagtacagcctcgaaaggtatatcatgaaatcggtgtttgtgtacgtctattttaacagttacagactttatttaggaacgtgacaagccaagtttgtgtatttgtattgtgagttcataagatgtcatttaatgtcctgcatgtcatttacattattcgtccaaaatactgtaaaacttattttgaaaccttttttttttttttttttgagacggagtttcgctcttgttgcccaggctggagtgcaatggcatgatctcggctcactgcaacctccgcctcccgggttcaagcgattctcctgcctcagcctccctagtagctgggattacaggcatgtgccaccacgcccggctaattttgtatttttagtagagacagggtttctccatattggtcaggctggtctcgaactcccgacctcaagtgatctgctcgcccggcctcccaaagtgctgggattacaggcatgagccaccgcgcctggcctgaaaccattttttaaagaaatatttcaccatttaaagaaatgttggcaagctaaatagcatcttatgtttctctcgacagcttcgacaaaatttggatgccctcctgaaccagctgaaaagcttccctgcccggttgcgacagtatgcgtcctatgagtttgttcagaggcttctgaaaggttacatgaaggtaggtggccagtatcgcacggtgatgagtgtccattagaaacgcacctgcacagatcactttgtttactttctccacagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcaggcgagtaataggactgaacggctgctttacgttgtgtttcgggctgttacatagatctgagctatgtaaaaatggagccttgtcatctgtggtccttttggttcttataatgctgggtcccttgtgcaggtagtgaatgcccacatattgataacatgcatctttctggtttgaattcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtgctgttgctggggaagctttccctccccaccagtggtctcccacgctttcactgtaatgccttttcactgacagttactaggtacctgttttttattgtattttttgagacagggtctcactctgtctcccacgctggagtgcagtggcaccatcacagctcactgctgcagccttgacttcctgggctcaagtgatcttcccacctcagcctccaggtagctgggaccacaggcacatgccaccatgctgggctagctttttattttttgtagagacagcatctcactatattgcccaggctggtctcgaactcctgggcttaagcagtccttctgcactggcctcctaaagtgccgggattacaggcgtgagtcaccacagccagtcaatacttgtttttttgtttgtttgcttgcttttttgttttttttttttctttttttgagatggagtctcgctctgtcacccaggctggagtgcaatggcacgatctcggctcactgcaacctctgcctcccgggttgaagtgattctcccgcctcagcctcccaagtagctgggattacagctacctgccaccatgcctggctaatttttgtatttttggttgagacagggtttcaccatgtttgccaggctggtctcaaacttctgacttcaagtgatccacccgcctcggcctcccaaaatgctgggattacaggcgtgagccaccacacccgtctacttgttgtttaaaatgtgaatcagattacttcatgagatcctgatctgcgctttttcagtgagttttggcatatctgtgagtagaagggtcagcagtttacctctccctcctgtctgcccaccaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagaggtatggcctccagccagagagccaaatttgccagcggctagtgactactctacacaaaggctgacgcatgttttaatttcatttgtagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggtaagatccttgctttgacttggcctggagtcaagttgaatttcagttgtgcatttttccagtgatcttctttcccttctgggcctgtgtttgttagttttgacatcaaggattttgttagccaataatacatataatgattaccattcccttccctgtcatgcagtgattactgattgtacctaccttggattttttaaattgtcctaccttggatttcttaaatccttaatttaactatcatctaccctccaaggcagcttgcattacatctcttcagtgtttatctctggcagttttcttttttttttttttgagatggagtcttgctctgtcgcccaggctggagcacgtggtgccatctcggctcactgcaacctcctcctcccaggttcaagtgattctctttcctcagcctcctgagtaactgggattacaggtgcccaccaccacacccggctaatttttatatttttagtagagatgggttttcgccatgttggtcagacttgtctagaacttctgaccttaggtgagccgctcacctaagtcacctaagtgctaggattacaggcatgagccactgcacccagcctctgacagttttctaagtggcatcttttcctttctgaatagtttgcttaggctgaattggacagattcttttaaa

SEQ ID NO: 78083 - DNA, 2524 bp, Homo sapiens
gtcaggagatcgagaccatcctggctaacatggtgaaaccccgtctctactaaaaatacaaaaaaaaattagccgggcgtggtggtgggcgcctgtagtcccagctacttaggaggctcaggcaggagaatggcgtgaacccgggaggcggagcttgcagtgagccgagatcgtgccactgcactccagcctgggcgacagagcaagactccgtctcaaaaataaataaataaataaataaataaagtaacttactaaggcaaatgacatgaaattctttgcattcattgaattcctcttcaagatcttgttaggtaagtgtgtatcttttgccaagggctagaagaaattctgatgtgatctgaatttgggctggagattgccaccaccagacacatgttctttcccttcctgcagtttgaaatcttaccttgattcaccttatatgtgtatataatatttttgcaacttgagtgttattttaattttaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggtaaatttatgttcgtaacttttaaaacttctctcacatttttgcatacctcatttcttaaaattgtatttatttcaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggtaatctatagtagaagtgagtgggctcgtggtgaaaacgcagaccaatctttaaaatgatcctttgggatcttgtttctgtgtctttcaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttggttagtctcacacctgactccttccttaccagttagactcttacaccctcaaccacacagttaaatggaaatcatgcttgaaaaaggtttcaggtagtatcaaggagaacagtggatggtgtatggatatcctctgagggtgggcatttggctccctgtccctgttgaaaggtaatctcaggggcatgcaggggttacgcgacatcacggtagagaggaagggatcaaccttggtcaggatctcttgctctttcctgtcatctccccagagaggtggccacagcagtgctaagctgcacggcacgggcagtgcttgctgcgagccccatggcggcacgtggcagactcctaggatagacgtcagaaagctagtcttccatgatgttttagaatggttgcagaattttaaaatatttaaagccaggtgtttctgtttctttgtttttgctgcagctctgggttctgtgtaataccatctcatgagtaacatttctctcatctctgaaagtgaatttgccttttggaacatttactgaaagccattgtaactggacctagaacctcaatttcagtttaacagtccacaaacccggagaatgcactgtattgctttagtgtagatgaacttttaaagtgactctctttcttcagattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggtaagttcttccacagatctggacagatggaatcatatattaaaatgtttaaagataaagctaatgatttgaatgtacttctttttgagatggagtgtctgtcgcccaggctggagcacagtggtgcgatcttggctcactgcaagctccacctcccgggttcaagccattctcctgcctcagcctcctgagtagctgggattacaggcacacgccatcacaccaggctaatttttgtatttttcatagagacagggtttcaccatgttggccaggctggtctcgaactcctgacctggtgaccccctcaccttggcctcccaaagtgctgggattacaggcatgagtcaccacgcccggcctgaatgtacttcttaatt

SEQ ID NO: 78084 - DNA, 1119 bp, Homo sapiens
gacttgcccaaggccaagcagattgtcagagtcagggtttgagccccgtgaagccagcactgaggcaggtggtatggtagtctgctcaggccaccatatccaagcagcacaggctgtgtggcttaacaatagaaatgtatttcctcacagttctggaggctggggagtccaagatcaaggtgccagcggggttcagttcccagtgagggccctcttcctggcttgcacgtggctattttgtcgccacaaggcctttcctcgggatacatgcagggagagcgctctggttcctcctcctcttcttagaagggcaccagtcctgtggatcagcggccccaacccttatggcctcatttaaccttagttatgtccttacacgctctttcgctaaagacaaacccactagggttagggcatcaacatactgatttgtggcaagggagaggggagacaattgagggcacagcaggtggttttagcgcctttcttcctctcctttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagagtaagacacctcttcttcaaaaattacttagagaatgtagagggaaattccctagtgaactaattttctacctcttggattagaaataagcaagaatttagctcacaggagctcactgttacaggcagtgtagtgagctgtggttaaagacggaaggtaagaaacccaggccaggcgtagtggctcacgtgtgtaatcccagcactttgggaggctgaggcggacagatcacttgaggtcaggagttcaagaccagtctggccaacgtggtgaaacccatctctactgaaaatataaaaattagcctgacatggtggtgcacgcctataatcccagctattcggaaggctgaggcagggagagtcccttgaacccaggaggcagaggttgtagtgaactgagatcatgccactgcactccagcctaggcaacagagcaaaactgttcccccaaaaa

SEQ ID NO: 78085 - DNA, 3589 bp, Homo sapiens
gtgatcagtattctcttaaggcgagaatacactttgttccaaagtggctcagaggtgcttggaggtttgggttttttttattttgatgatgctaggagcaggtaattcccatgatgtaagccagtcagtgtcgcggcatttattccttttttttttttttgcacaatttgttggactgcatctctatctcgagttctccatgacactcaggtgtggtgttgcccaaataaaatagtggtctctgcctctggtggcttgacctgggacacgtgcacatgaggtacatgggaatgggtccacctgggctgggagaatgtggctggtggtccccgaagaaaggccaaagagcagcccccgaggaagcgtctacttcagctccctgggagaacgagagctttgtctgttgttttagagacattttagaatgcattttgttttttttttttaacatttctagtcttaacgctatcatctcattctcagcctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaagtaagtagcctagaattcttcataatcatgtttcttgcatatgttaaatgtgtccatttaaccttaaaatttttatatgtaatgatggtacgtctttcaaaatatccatctctggtttcttgacacttgaccctattattgcttaaagtatactgttattaaagatagcctttttttcttcttttctagactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagaggttcgttacaaacgttttgatcactcaaaccttatacgttatttaaatttacctttttaacatttaagccatgacttgtgagttcttcttgcagttcacatgtcttgggatggctgaaatagactgtaatgttgacccagtgagtcgagtgcacgaatgtgggcgagtggtgctcgcaccctttgttcaccaacagttactgatcacgcacctcctggggatgcagcgggcagtacttgagccatgctgcgctgctcacagcccagccctctccccgtagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggtaacttggattgtttcactggccactgccctcacagaccctgctggctttagtgtctggtaatgacaaccgtgggcccttcgatgaaactgtccacaaaggctgtggaggtgcataatatgctttatgaagatttgcccaaggcctatttgaatttttgttgttgttgtttaaatgaagaggaaacaatacttaacctgaaaattttacatgatacagttcaatttctgaaaatgctaagtgcatgactatattggaaagttgtttatactgataaaaattctgcttaccagactttccagtgccagagatgaacaacctgaatcgctgatcaatacgtagtttacattctgtattggcttctttccttcctctatgtgattcatttaagaaaaagtttattgtttacacaagctgtgtgtgtttggcctgagagatgctgtacgggattgaacacatagctcatccattgggtctcttgttgtcctcggcgggatctgatgtgtccttgttgaggctgctcattggtgtctcctgtcccactggctccagccttcctgacttactaaagaactcgccacagtttggaaatgtttgttttacatgtgacctgtgtaacatctctccagctggggagtttcagtacttgcctttaataatccatagataggcgcttgtaaagccagctacttgggagagtgaggaaggagaatcacttgaacctgggaggtggagcttgcggtgagctgagatcgtgccactgcattccagtctgggtgacagagagagactccgtttcaggaaaaaaaaaaaaatccacacataatgtttcttgctcactttcacaagaggtggctgggcgaggagctgtccccattcctcctctgggatggtcactgtgctggtctgttgggccctgcaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagtacgtcttctttgatctgtgtttgtgttctcctggatatgggcgctaagtactttgctctcacaagagcagagtatacgttatttttcaaccaaagtctgagcaaattaaaggtcatttcagaaaccatcatcggtaaacatgcctaatgttaaaatcttgatttaatcagcagctattttaaaatccttcccaaccaggatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaatgtaagtagccttttgtatgtcgtcaactgaataattccttttggccaactaaacttcgtgtgctagctaagtgcagctctggagtcatggacccagattccatggagtagtgatcattgtgtaagtaattttcaaagatagcatctcaactgctagattttttttccatttccatggctagtgagaaacattttaataggttttattgatggctttctatcatttattgagtaataagcacactctatgattatcagttaaccctgtatggtggggttgtcgttaaggtttcttaagctgttatacatctagagagctgggaaaatgagaaatttggaatggggctttctaggctgtcccttggaaaatgagtgcatgatgcaggtgcctgacaacacctactgatcagtaaacacagtcaggcccggtatggatttgcactgagtcagaccctgttctagatgctgaaaatacagca

SEQ ID NO: 78086 - DNA, 3027 bp, Homo sapiens
ttaaacaaggtggtttgccctattcttctccctgccacacacacttgtcctgcccagattcctgtagagagaatggtgaatactgtagtgatgtgagctgtaggtgttttttgttttttttacataagtgcagaaaaaatttttttgagacaggttttcactgtaacccaggctagagtgcagtggcatgatctcagctcactgcagcctccacctcccaggctcaagtgattcttctccctcagcctcccaagtagctgcaattacaggcacacgccaccatgcctggctactttctgtataggaaaattaagtttaaagtcaccctttcagtgtatatataggtaaaagaatcttaatgtccaggtttcttccaaacctatgtcattaaatctgcttaatgttttctttcaaggtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcaggtacgcccaggtgggaccccacatatcatgacctgagggtgctaggatattcagatgtggtctcgctgtgttgcccacgctggtcttgaactcctgggcccaagcaatccacctgccttggcctctcaaagtgctgggattacaggcatgagtcactgtacccagccaacttttgtgtaatcaatgttgtcttctgccagcttaaacaaggaagcccagctgtagcagctacaaatgttaaaagtcacgtatgggaaaatttaaagaattcttttcattatcttacttttctctacaaattgatgaaagactgcccttttccatgttcagtgggaaaaccaaagttcctgggaagcagggtttttgagaaccaccagggtgaaggaatgaggactggtcattgaagcttcatccaaaatgagttttccaaggtcgtatgaccttctcctgggaccaggttagaatcgatgaaactcgcctgccttttgaaagatagttaagtatcactccttccactttctagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcaggtcagggggcatcaggggcttcacagagctcaccactgcgccagaccacaggtctgaggacctctgaaatgctgcacctgtggggatgtgcgctctctcctaggcgaggcagagccttcgttgaggggctaggaaaggtgcagtgggtgtctgtgatgcaagaagactgggaaccactgtctttaggttaactttgctgtaagtgtctttcttttgttgttgaaattttataaaaatcaaagtttaattccctttttaatagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgagcatgcagctaccacccgtgtttctgattctcgccttgttgatttaactcatcctggaacaagctgaccatggaccttggcttcgtcttttcattttattccatttcatagaaggactttatccttttagttccatgtgttagcaaagagtgcagattaacctgaccaattacttccttgttctgaaagttcaagtttgtgttcaggtaaacaaacctcgtgaggaggcaccttggttgcagccggactcacacttccatctccgtgtgtaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtaaagaggccaggaggtgggcagcagaccttttggtgctgagcatggggttggtcttacagtgtggttttgtgtcttccctccaaaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacaggtttgtttctatccacaaggcccttcctgccccacaatgtttcttgttcaagttttgctcttaatgtggtacctgtcccttccttcagatggtggagcacggaggcttttaccgtacctcagatcaaacatgggtgaagctggagagaatccagtttgttggggcttgtaatccccccacagaccctggaagaaagcccctctcacacaggtaaaacagctcggtagactgctctgcttcacacacgcacagctccaggattgctgtaaacacagcgccacaaaaacctggttttgataataaagacaacaatactgcttattgtggattcctcttgggttacttctctgtgctgtaatgccaggaaaacatgttaaaaataaaagcattggccgggcgcagtggcttacgcctataatccc

SEQ ID NO: 78087 - DNA, 1021 bp, Homo sapiens
accactgcactccagcctgggcaacagagcaagactccatctcaaaataaataaataaataaaataaaatgaaataaaagcattgatctcttggtagtgatgaactgctccagactcatctgtagagccaagatgagcctgaaataagccttggttattttttcatctttgctggtttttcaagtgttttccatcgactgttgtgtgtcagaccccaagcctgagcagcgtgtgtgtgatctcagctaacactgatgtcaagtctgcatagctgggttaggaagcgacctccagacagggccctggacagggcgactccactggcacactgccccttcctgggaggcgctgtcagggaggggcgctgagcggggctatctgtgcacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggtacgcagagtttctttgctcttccagaaattgttttcctctcataattaaggcactcgattggtcaggtgtggtggttcacacctgtaatcccagcattttgggaggccaaggtgggtggatcctttgagcccaggagtttgagaccagtctggacaacatggcaaaaccctgtctctacaaaaaataggtgggcgtggtggtgcatgcttgtaatgtcagcttcccaggaggctgaggtgggagagttgcttgaacctggaggcagagcttacgatgagccatgattgtgccactgcaccagcctgggtgacagagtgagactctacctcaaaataaaatgagaagtttattgaaataaagattggactttattcagagatgttattgagccgagagactttctccaaggtctgtcatcaaagtcacttttctatgcaggtgctaagactgctgacatttccatg

SEQ ID NO: 78088 - DNA, 1239 bp, Homo sapiens
gggatgagtgggagccgccaactgccctgctgtgtctccctcgctcttcatgctttgggacagctttcttgtcataggtggcagatgctttttcccagtatttaatttgcttttaagtattttcagaaggattttttgtagtttcattgtttaaatatttaaatcgttaaatataatgtatttcagcataaagtgagcagcttgaatctaactttgttctggacagttatttatccaattgttccaacattgtttactcatttggagacggagtctcactctgtcgccaaggctggaatgcagtggcgcagtctcggctcactgcaacctccgcctcctgggttcaagcgattcttctgcctcagcctccctagtagctgggactacaggcacccaccaccatgtccagctatcttcttaaatatttcagggtctaggttctttaatgtaaacatgttttgccacattttaccttttgaccacttctctgtgtcttaagatatttacgtgtaccttccatttttctcattgccataggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagataggtaagggaagccgaggatccagttggtcccattctcccctgctctgagttcttacagctgtcgaagctggggtctttgcaggggtggtctgcctaagttagagccaggtggtgccagtggtggaaggagcagagtcagccagggcagcctcccgtctggacactggtcacagttgccccagggtaacaaagtcacagtgcgctgaatgcaccggctggcccaccactgtctgcttacacaaggcactttcataaaccttgtggctgtgaacagggtacttttttttttaaagatacatcatagaagtcaaaaaacggggcactttaataaaccttttaaactgtcaggtgggaccacaaaaggtagcagctgcctgtgataaccttaccagagcacgggttcactgctgagttaaaaggtctcccaacaactgcccagtgtgcgtgttccgtaaccaccacccctcttcctgtttctcagtctgtgttctcatcaaaggctttgcagctgcagctctggggcactggttttctctttt

SEQ ID NO: 78089 - DNA, 1053 bp, Homo sapiens
cactttgggaggccgaggcgggcggatcacgaggtcaggagatcgagaccatcctggctaacacgatgaaaccccatctctactaaaaatacaattaaaaaaaaaaaattagccagccttggtggcgggcgcctgtagtcccagctactcaggaggctgaggcaggagaatggtatgaacccgggaggcggagcttgcagtgagccaagatagtgccagtgcactccagccttggcgacagagagagactccgtctcaaaaaaaaaaaaaaaagtgagactctgtaagtaagtaagtaaataaataaataaataaaatttcaggttgcctaagctgtcatgagttcagcttttaggttcatccatgcatagtaaaggaagatgtgtgataaagactgactgcatcctttggaagagcccacagcacccacaaacatggtgaacatggtgcttcttcaccgtgccctctagttacctaaatgcacatgctgctctccccacagactcgtagaggatgaggagaggcgttggactgatgagaacatcgacacggttgctctgaagcacttccctaacatcgacagagagaaggcaatgagccgacccatcttgtacagcaactggctgtcaaaggtagcaaactcgcatcatttcagacatacttctttttctgccatccctttctaacactaacgaattctaacgaattatcttctactcaaaaatatctttaggctgggtatggtgtctcacacctgtaatcccagcactttgggaggctgaggcaggaggatcacttgatcccaggagtttgagaccagcctgggcaacatagtaagactccacctctacaaaaaaatttgaaaatttagccaggcaaggtaactcacgcctatggtcccagcaacttgggaggcttgagcccaggaagtcacagtgagctgtggtcacaccaccatactgcagcctgggtaaaagagcaaaaccctgtttcaaaaaatacttcagaaaacaaaatatcagccgggcgcggtggctcatgcctgtaatccca

SEQ ID NO: 78090 - DNA, 1051 bp, Homo sapiens
gctgaaactccatctctactaaaaagacaaaaattagccaggcatggtggcatgtgcctgtaatcccagctactcaggagtctgagaatcgcttgaacccgggagacagaggttgcagtgagccaaggtcacgccactgcactccagcctgggcaacagagtgagattccgtctcaaaaaaagaataaaaacttaaaaagagtccagcttgggtaacaaagtgagaccttacctcaaaaaaacacttaaaaaacaagaaaaatctctttgtcctaaaatgcactataaaataggctgcggttacagcagtgatgtgctacgggtttgcagtcactgatactttagggcaggaattcccaggagtatggctggctggctgctgttggggttctgacttctgtgtgagggtcgagccattggatttccagccggtggaaggtgttgcttcagcgggtttgcagtgaaagaaatctttgcttcacaaatttgttttcacattcctcacactgaaaataggacaattgtgaataacttgtgtgaaaatgtttcatatgctaaaatgctagatggagttcacctctccagaatagctgtgagttgtcctttttctctgcaaaggatgaggacgtttaccgagttacagtcttgacatgcatttcattgaggagccccaggtgatagacgtgagtaagagcttcctttaggcagctcccactccagtggaggaaagagcaggacagagggagataactcaggctgggaagagatttctgggagaatgacccttgcactggtcttcgtgtgtttaggtcttctgaatggctttcagtgaagttcagctttctccagaaaggttcaccacgtcagggagggcatacaaggcagagcgcctgataggagctgggagtagtaaggtgggtgtgttcaatattggtagaattttctatatattttaagactctaggtacccattctttttcatttacaggaaacttctccctgtggcttatcttttttttttaactctttttttttttttttttttggagat

SEQ ID NO: 78091 - DNA, 2433 bp, Homo sapiens
aaaaaaaaaaaatagggcaggccctcacacctggttcttttctggagggatctttcctgttccaaatgaaatacagaaatggcttgtcaggttgcaccaggacaataagcacctcccaccactgagattttgactgggattacattgaacttatggatgagtttgatggaactggcatttttatagtagagtgtttttttcctccatgatcatggtatgtctcttcatgtattgaggtcctcttcattgccttttggtgaagttcagttttctctataaaagtttttcatgtttttagatccattcctagtgaatttatatttttttgctatgttataaatgataccttttttgttgcatttttaacagtttcttcatggtatgtggacatacagttgactttggtctaataactaacatttttttctaagtaatttgggtattacctttttttctataggattacatcccagtagaccaagaagagttaagagattatgtcaaagctaggctgaaggtcttttatgaagaagaacttgatgttccgctggtgctgtttaatgaagtcctagaccacgtgctgaggattgacaggtgggcttttttgttgttacagccccacctctcgcctaagctgctcttgagtaagtgtgtgtgccgggtcacaccaggcctcatgctgtcctaccacctccacctcagccttctccaccaagcagcttcccccttctcttctttctaagtccagcttaaccatcctcagtttatcctaagcagaacttcattcttcctcccccagcactgcatacctgccataattatggccctttgaccttctgctggaattgcattagtctctcatgtcagtctagaggacaggaccgtgtcttactggtctttgcattcctcctggacttcacaaataacagttgctcagcaaatgtttaatatacaagttcaagttaaaacatgtccaaaatactgtagacactagatatgagtcaaaaggggaatgaggcattataagccttaacattgatcagttctcgtaatgtttcagaatattccgtcaacctcaaggccacttgcttctgattggtgttagtggagcaggaaaaactaccctgtctcgtttcgtcgcctggatgaacggtttgagtgtgtaccagattaaggtgcgtctggtcggtggcctcttaatcccagcaacagatgtgtgtgcagagctcagtgagtaggaatggacctaacttgcctctgcttctgtaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtaattaggtgacgtgttgcgttgcattacgtgttaccgggggaccagtaagtcagcactgtgctgtttcccaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtacgtgggcctttacttggctctgggtcaggaaagtcggtgtccttccaagggacaaagcctgcccctcatagctgtcctgaaacatgggcctctttctcaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggtgggttcagttttgagatcaacagataaaccacaaaactaaccatcatgctaatataaaactaaattgctataaaaatagaccttaaggccaggtgcagtgactcatgcctgtaatcccagcactttgggaggccaaggcgggaggatcacttgaacccaggagttcaagaccagcctgggcaacatggcgagaccccatctctacaaaaaatacaaagaaaattagccgggcatggtggtgggcacctatagtcccagctactcaggaagctgaggtgggaggatcacttaagcccaggaggcagaggttatattgagctgagatcacggcactgcaatccagcctgggcaacagagcaagacccagactcaaaacaacataaatagaccttagggcacttca

SEQ ID NO: 78092 - DNA, 1852 bp, Homo sapiens
aatgcaaggcttggcctgctaaccatgttttgctaatccttgctgtagattctgtgtgatagaagaattcagtctactcctccctcccagaagagctttgtgaaatccactctgagcttgtaggtgtcctgctgcccagcccctgcaggccatctccattgcccttggaatgtcgtccagccctggcttcccctggtagtctgatcatcttgctgtgcttcagaaatcaagggaccagagcagtttctcacatcaggcctgccttgcccctttcttgtcatttcttactaataaaaggtggaagcaggctagctaacctttctatagtaactgacatttgtgatgccttttcacataagtacacctctaaagttggtgtaatcaccatcctcagtttagagaagttaaagggcttagagaggtttggaagtgtaaggggtatctcgaaagctctaagtggctaagctgaggcccgactcgagtgttctggccccgagggccaggctccttctatcatgtcacacccatctgccaaggccaaaattgttttctgaggttaagtcacagagtttcctgaagagtgagaagatgtaactattttctgaaaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtgcgtcacaggcacaaattcctcacgggagtgagctgcagtgaggacccctttccatataatttctgcatgtttctcgtctctgagtgtgggctttgctctttaggtagaagaactgcgtcgtgacttgaggataaagagccaagagctggaggtgaagaatgcagcagccaatgacaagctgaaaaagatggtgaaagaccagcaggaggctgaaaagaagaaggtatggtgtcagggaattctggcctgtaaggactgagcattttcagtctccaatgagagagtaggaaatgtagttccaaatgggtcttagggttagagagagggagggagggagagagagtgtgtgtgtgtgtgtgtgttggcagagtgaagaatgttgtttagaatttagtcagcaaattaaccaatgcttaacccatacctaagccatccctcctttctaggttatgagccaagaaatccaggaacagctgcataagcagcaggaggtaattgcagacaaacagatgagtgtcaaagaagatcttgataaggtggaacctgccgtcattgaggcccagaatggtatgtaaagactgtcagagctttgatgtctaggaagggtggtctccgtcaacattactgtggagttcaggtcactgaacattgcacatatgcttccctcaaaggttctggtttccaaaaatatcattagtaaccatctgaagctttttctgaatgcttgagattgtcttcatctctcaaagcaaagttcctacaaagctagattgtatttaccatagtgaaacccctctcataaaagaaacttcacaatataagctttgtgtcaatatacgtttttagagatctgttgataattacgtaagtatgctatttatcaatccctgacttgaatttcacccagaaatataaaatattcagtgtaactgtcttgtaattgtttctgagtgttctagctatgacccaattgctaatttaagtattgatagcagtcacttctctttttccattccttacatgcctataagatgctatagaaatagggcaacaacctgccatcctgt

SEQ ID NO: 78093 - DNA, 2710 bp, Homo sapiens
ctgcactccagcctaggcgacagagctagactcagtctcaaataaatagtaaatatattcttaatctttatggggataaagaaattaggacttgtgagacattttaaaggtaatatcctgctttttaaggaatgctagcattttgtaagatcttcataatcatttaagagatcagctacttaccctattccagagggtttaatacagaaaagtctctcatttcttagctcttctaagcagctagctgtcctttctctcattggagttggagctcctggctgttttggttcattctcaccatgctttgctctatcttctcccacccatcgaccctcatccactcctgctgccactcagctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcaggtgagaaagtggaagtgccaaggtattgccagaaattgaaatcagttgttcaggccaggcacggtggctcacgcctccaatcccagaactttcggctgttcaggccaggcacagtggctcacggctccaatcccagaactttgggaggctgaggcaggtgaagtgcttgagcctaggagttagagaccaacctgggctacatggcgacaccctgtctctacaaaaaaatacaaaaatgagctgggcggggtggcatgcgcctgtagtcctagctacttgggaggctgaggtgggaggattgcctgaacccaggggatcaaggcttcagtgaaccgagatcacaccaccgcactccagcctgggtgacagagaaaaaccctgtctcattaaaaaagaagaaagaaaaaaattgttcaagtgttgagcacattttcagctttcacctgagaaccaagggtcagtctagctcatccccagtggtcagtcactggggcaatgagatgggagctggctctggtctcttccattttaattttatgaaaactcttccttgcttttgtcctgcatgtgtttagaaatatcattcgtcttttacagtgacgccataagggagaagatgaagaaaaattacatgtccaatccaagttacaattatgaaattgtgaatcgggcttccctggcttgcggccctatggtgaaatgggcaattgcacaggtgattaacacagccaggagctcccgtgtgaaaggtgacctcttttcctgtcacttaaataacagttatcaattggttcttcccagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaagattatcatcattgatcctcagcctttcctgctgtggaagcagagattaacacacttcaacatgcgctgcatgcaccatgctggcctcggtgaattcgctctttaacatctgtaaggccccggaggacttttttcctggaaaataatacacactgagtagtcactaagtgttgttaattaggatagattgatacaaactggacacttttcagccgttgaatcccccaccagcagctccagacctgtttgctctgctgcctgagggcctcgctccgtacccagcttctgccccgctgagattctgagtcgtgtgtggtcattagttatatatgatctgggtctcatctcctctgggactgtgaacaacttgggcacgtttctaacccacccaaaaccctgcacataatgtggatgaaccgatttgcaggattcggtataaatcctgaaaggcctcatccctgagcatcttgttcggttttccttttaggtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccaggtgagaatcacggggagttcaaaaaggatgtgcgagcagtgtgaggcaagctggtgtttagtgcacagttagagtcttgagaacagtcccatctgtggctgtgaagaggaggaaaggtaacggccttgcctttcagttccgtacagatattgccaggacggaatacctttccaatgctgatgagcgtcttcgctggcaggccagctccttgcctgctgatgacctttgcacagaaaatgccatcatgctgaaacgattcaataggtatgagctcgggtgccaaggagaggcatgggaggaatgtgggtggtgatcttgaatttttttcaaaatacacccttgtttgaagagaggaatagaaaatggggcgtgggcatacagtgctggcagcttggtgctcctctgatggtggggcgtgtgctgttctcgttattgt

SEQ ID NO: 78094 - DNA, 1167 bp, Homo sapiens
attagcttatttgtgtcctttcctcatttgtagaatggttcgataacagtgtcagcctcatagggctgttatgaggattacgtgacgtagtgtctgtaatttgacacggtccttggcaattaaaattctgtataatgttaatcccttgctgctgcgacatcattgatgttgatacgtgctgtctagaaggatcgtaaacatgaaaaagctattctaacagtgcaggatgctgagaggatgattgtcccagaaggaaaaagatttttaactatggccctcttggtgtatgactcaagctacctcctcatgccaatagttgttcaaaaggatgaggtgatgttagcattaagcatgtaagctttattggtaaacctgaaaacgtctccggaaaccactctcgggtggtggtaacagcctatcaatcagggtctctcatcagggactcggctaaccgtgatcctgtgctttccccattcggtgtttcaaccttctcttctgtggcctcatcctcaggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggttggtgttggcctttgaattcttgaaacactgcattcaagagtgaattcctttttgggggctgcctttagttttcaactttgtaagacttcattttgtatcagaaggataaagctttgcggtggttctgtaatagataaattcaacagaatcattatttgcatttaaaattctattcagtggtcgggcgaggtggctcacacctgtaatctcagcactttgggaggccgaggcgggtggatcatctaaggtcaggaattcaagaaaagcctggctaaaccccatctctacaaaaaatacaaaaattagctggttgaggtggctggcacctgtagtcccagctactcgggaggctgaggcaggagaatcacttgaacccgggaggcggaggttgcagtgagccgagatcatgccactgcactccagcctgggagacagaaagagactgtatcttaaaaaaaaaaaaaattatattcagtacagccataaaaagcaagaaa

SEQ ID NO: 78095 - DNA, 2894 bp, Homo sapiens
tggctagtgtgactaggaactgagttttaattttttattttatgtttttttgagacagagtgttgctctgtcccccagtctgaacctcccaggttcaagcaattctgtctcagcctcccaggtagctgggactacaggcatgtgccatacacccccagctaactttcgtatttttagtagagatggagtttcaccatgttggccagtctggtctcgaactcctgacctcaagtgatctgcctgcctcagcctcccaaagtgctggaattacaggcgtgagccaccgcatctggctgagtttttaattttagttcatttaaatgtaagtagccacacatagctagtggccaccacacgcaagtggcgggtggcttttgggaaggtatgcttatccagagtaggacagcaacatagcatttgggtgaagataaagttacaaagccctgaccatcaagttccacccgtgtggaatgcaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtaaggaatgggacccttccccagggaaatctggcaggatgtggttttgaaactggattaagacagactgttctgttacctattttggcaggtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggtaggatctggacctgtggcttttagatggttggtgcaggggaaggggctgaacttttaagtgactaggatgttccacgtttgtggcaaacacttctgagagcataccttttgaaggattattgcaaactctggatgttttattcatttaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcaggtgggtgccttggccatgcagagactggcgggccccgcacagtagctccttggccgcacagaggctggcgggccctgcacagtagctccttggccacgcagaagttcagcggggtgccgagggagctgcctcaccgctgcccactgcttcctttcagatacacttcttgtaccagtactccctccagtttttcctggacatttatcacaacgtcctatacgagaacccgaacctgaagggtgtcaccgaccacacacagcgcctgtccattataacaaaggacctcttccaggtagagtgaggtcctcagccgctccctggcgggggggaagcagggtgctgcttctcttatggaacaacatcgtctcctgctcttgtcccaggtggcgtttaaccgagtggctcgaggcatgctgcatcaggaccacattacctttgccatgctgctggcaagaatcaaactgaagggcaccgtggggtaagagcactcacgcccacaggaggatgccatattgctggtggcccccaagggtttcatgatcagatacatgcttttattatttcttttattttctcttttattttctttattttattttttgagacggagtctccctttgttgcctaggctggagtgccgtggtgtaatctcacctcactgcaacctccacctcccaggttcaagcaattctcctgcttcagtctccgaagtagctaggactataggcgcaggccaccacatctggctaattttttttgtatttttagtagagacgggttttcttcatgttggcagcccagcctggtctcaaactcctgacctcaagtgatccgcccacctcggcctcccagagtgctgagattataggcctgagccactgtgcccggcctgttttctcttttcttaaatcacagctgttatcttagtgacagtgggagtgaacgtgagagaccctagctaacctgttgcacccttcgcagggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgaggtgattgttctcttgaatgttcccagtaggtaaatgttggccttttcccaggaaatgtaaggaattgcatgtggtataaaacccagaatgttgtgtctgcgctctcgcgtcagactctcgctcagtcgtgggttctgccccagaggccagccctgctccatgggtgcttccactattgtctccacagcaatttggcatctggctggacagcagctccccggagcagactgtgccctacctctggagtgaagaaacacctgcaagtaagccccactgtggttttctttctggacctgaatgtaaagttgggttttgctgcttaaagggatgctttcaaaaaacacaaagttactagcctgggcaacatagtaaggccccatctctacaaaaaataaaaccttagccaggcgtggcggtgcacacctgtagtcccatctactcgggaggctaaagcaggaaggtcactt

SEQ ID NO: 78096 - DNA, 1057 bp, Homo sapiens
gcacccacccctctgtacctgtttcagcacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtaatgtcctggtacagcccgggcttcccacgagactccatgcccacctccccagccacaggtggcagcagccctggcatctgctctcactccgggctacagtctcctcctaagaccaggaactcgctgcagattctcaactcctggctgcatggtgcccacacctctgggcccagaaagaacatcttctcaggcccctcactcggggctctcctttcccttgacaggtacacactatttgctggcactgtaataacttctgccttctttgtttgcaggtgaagcccaacactcctgtcttaatgtgctctgtgcctggttatgatgccagtggacatgtcgaggaccttgcagccgagcagaacacgcagatcacttcaattgcaatcggtaaggatgcttgaggggcttcatgggctggagccctgcaggatttgtggtgggcattgatgtccgaggctgccgctgctaacactaagtttccctgcaccaggctctgcagaaggctttaaccaagcagataaggcaataaacaccgctgtaaagtcgggcaggtaggcctgttctctttggctgaagaaagccttagtccccaggcattcaggcaggcagcctggcatgctgtgtgactctcactttgtgtgtgcaggtgggtgatgctgaagaatgtgcatctggccccagggtggctgatgcagctggagaagaagttgcattccctgcagccgcatgcctgcttccgactcttcctcaccatggagatcaaccccaaggtgggtggttgaaggagtggagacgttgcaggctggcctggcactgtgctgtcggcacgtgtgtggtggaattgaacaggcgccctcatccacacc

SEQ ID NO: 78097 - DNA, 1799 bp, Homo sapiens
tgaggtcccagaggagcagagatgcccacggagaagctgggactcagagttgtgtccccaggtggcaggcaatctcctctcccccagcacaggcccccaagaccaaacagagccctcccaggcgccaagtgaagaccgaaactcttgggcgagaggagggggattgtggcaggggtttcgttctgtcaattctgttctattttgtgccacattcacgttttctgacattcttagaaactctgtcttctctagatttcttactggctgaataaattctgatggtctcattggatgacacgtctattaatagaaaagttggcatacttttctcctagcagcagtactcatgtgaatctgctgccatcgtcaggatgtggagagctctttgtaaagctttgactgacctggcatctgcactgttcttggcgaagtgctgttttctaatgactctgtgcttggtcactttcctcaccagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaaggcaagtgtgggccatgccaggacagacagtggacgtgtatctgggaaggatgctgcagggcgtggtgctgagaggccagactctgcgtggaagagcgagctgacccctcgtgaccgccaaagcctagctggccatggggagtgaggaggaaagctgtgcccctcgaaaggaagccccgggcctgcccgcctctgaccacacacacgaaccctgcttttcctcccccagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggtatgctgctgcctgctggaatggagacagttgtgatgtcagggcgtctggtgtcactcagaggtgacccctgacatcatttccaaatgcactggttttctaggcgagaggagtttgtgcagtgggtggagttgctccccgacacccagacgccctcctggctgggcctgcccaacaacgccgagagagtcctccttaccacacagggtaggcaacaaggatcctccccacacgcagggtgggtggcgagggtcccctcacgcggggtgggtggcgagggtccccacacgcagggtgagtgtgcactgctgtcccagggccctccctggttatgctgggtgtggctctgtcagcctcggccttcctgccagtctccagctgctcctagctccactccgaggggaggcagaggaaagaactggctcttctctgcagcatcaactcagttctagagaaaaggcttgatatttatgtaaatgagcctagaaataacatttagatgttcatctcatattgaaaagcagttactggctgggcacactggctcacacctataatcccagcactttgggaggccaaggcgggcagatcactcgaggttaggatttccagaccagcctggtcaacatggcaaaacctcgtctctactaaaaatacaaaaattaggtgagcatggtggcaggcacctgtaatcccagctactcagg

SEQ ID NO: 78098 - DNA, 1114 bp, Homo sapiens
tgaggtcaggagttcaagaccagcctggccagcatggtgaaaccctgtctctactaaaaatacaagaaaaaattagccaggcgcggtgccacatgcctgtaatcccagctacttgggagcctgagtcaggagaatcacttgaacccaggaggcagaggttgcagtgagccaaggtcacgccactgcactccagtctgggtgacagagcgagactccatctcaaaaatatatatatacacacacacacacatatatatatacatacacatacgtatatatatatacacatatatgtatatatacacgtgtgtgtgtgtgtgtgtgtgtatatatatatatatatatatatgtacacacggctgagcaccttccagattttgctgcagttcccagtgtggactcactcaccatgtggcctttacgttcaagtcccttttccctctgtgatttcttgcccgtcccctccctccttcctgctgcgactgtgggactgtggcccaggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggtagctgggagggtggcgggccggccaggtctcaaggtcccaggtgctgggtatggtcatggaccattgttccatggaccattggttccactgtgccggacggaacgtactcacaccggtgtcacctcagagcaggtgtccagctgagcccaggcattgggcaagatgagttggcccttttgaaatggactgaaaacaccctagaagattgtgagataggcagacagcgccacagcgagcagccgcagcccttcctccctagagagccccgagagctgcgactcgggcaggggcctcagcgggtttctgagcagcctcagcttcacacaagctcggttccaagtcacgctctgccaaagctgtccgtgaccctggacagttcggaagctctggggctctcc

SEQ ID NO: 78099 - DNA, 2450 bp, Homo sapiens
ggaggggaggagcttagaaatgctgaagaatttgtttttcttctgtgctggttcactgaatgttgaccaaaatctttacacaacttctagttttttaggggtcttccaagacgacagtgaatggggaatgtggtggtccaggatggtgacagacggtagtaggttacggcctgtgaagaatgggtgtcccccaggacagtggaaaagcaggggcaggcgggcatggggggctcatccaaagttgtggggagcccccagcatcctcctgtttgccccaaaagccctaattgccaggaacactgagccacttgtgtgacatgaggttttagccgcggttttgcttggatgtgattatggtcctccagaaagacacacctggactaatttgaccctagaaactgcacggttctgagacatgctctggaccagcctgagctagagcagatgtggtgagggcggcgccaggggcataaagtgcagcctgggaaaggcagtaggtggagccgccagccgcctgtgtgggcagccaggatgcctagcacttgcacatttgttccatctgtgctgggggagttgtgagagctgacaccctgggctctgtgtgccttggctgcagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaaggtgaaggcgctcctgacgagtctcgggtggtcagcagctgtcctgggctggggtgggagtggctctggggaaaaacacagggcccaggtctgacctgagctccttcccctgggggctgctgctttccacagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtgagtggagtctcacagaaaatactggctctttgcaggtgacctcggtggcctgagaccattgttcccagatacatgcacttagggtgaccggctggcagttgggtggagcctctgggcgccctgtgactggggtttgtgtagctgttgtgttcacctcagcctgggttttggcttccgcctcacaggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaggaggcactgcctttcccaggcattctgcagggacccctgcggtaacaagggcagaggcggctcctcttctatgcctgggttccacttggaacgggaaatgaggttcacagaggaaatccatttcgcacctgtccaaacctctccttgccgggccccatcagctgtcccgggcagtcttccagttttcttacttttcccttaagccaccagtaaacccctctgcttctgcaggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatgagccggctccgcctcttctgtctccgctttcatcccagggcacagagccttgccttccatgctgcccagggagggcagcccacggcagccatgcccctccccacctcgctttcatcatgagctcgctcccgagcggccacagcactcatgaatgaagaccttggggcccttcacagacacagatgcagccagctgtggctctgaaggccctggggcccgggcaccatggttcacacctttaatcgcagcactttgggagtctgggagttaaagaccagcctcggcaacatagtgagaccccgtctctacaggaaattaaatcaggtgtggtggtgcatgcctgtagtcccagctacttgagggctgaggtgggaggatcacccaagcccaagaggtcgaggctgcagtgagctgtgatctcaccactgcactccagcctgggtgacagagcaagaccctgtctcaaaaaaaaaaaaagctgg

SEQ ID NO: 78100 - DNA, 6142 bp, Homo sapiens
gaggctgtgggggccggaccagatccctgaagcagccagggccgcgctcccgggcggccgcgctttctattccggaggcctcgggaccgctgcggtttccgcaccccgcttcaggaatgggccgggcggccgcgggctccccgaggctctgcagcagcgccagagctggcgccgcacgcgaacagagcggccccgccgcgggggtcccccgcccggccccgctgggggcgcaggcggaggaggccgccgtggcggagccgcagcccgcgcgggagggcacccggggtgttcgttggggaccgcggcgggggactgggcccgggcctgcggcggcctcccggaagcgcgcacacgctcgtggtagttgccgcgctccgaaatgaggtcatcctttgtcagccgcccttctattttcggtttacttaaacttcgcaaatctccaattcggctttaaaaatatttggagaacgcgatggaatttcgtgttgcctctgtagacgtcctgcaaggttttaaaccggcgcggtgtcgttccagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgtaagtcacttattaacccagaatcggattttggtttcagtgtgaacttcttgggggtgctgtatgcttaaattaatattttttgttaacaggcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtaggcacctgaacattcactggttaagtgagcggtggaagggtggggtgctgcaacccttggacccctggggatgcggtgaagcttacagaatttgtgtttgcccaacgatcaggaacaagctagagcacttaattagtgtaatggcatgacttggtgggcggttcttttgggcgaggcaccttgcccaaaaggttctgctgtggtggcctttgcatctgtagtaacggcaaaccttgctttatagacacgttataagggtgttaggcatggcgttgagcactaaattgaatgtattaagtcaatttttctttcttctcttgcaggtgaacctatgggtcgtggaacaaaagttatcctacacctgaaagaagaccaaactgagtacttggaggaacgaagaataaaggagattgtgaagaaacattctcagtttattggatatcccattactctttttgtaagtttttatgtaattgcagagtgaatttctgtctgtaggtgattggggtgactgtactacatccttagtccctagatctgttcaactagtctgaagcctggggaacctaagctctactacctaactctgtaaaagttcctcgggctattaagtggatgtatcaaatattgatgaaaagctgggtgcttctcaagttggctaatttagacttgggccttaggttgaaaatagtggtgcagcgctgtcgcttagttctggagtgcagcagtgatgtgatttcgtgttttcttttgaaggtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaaggtgagtgactgatgggtgcttcaagcttgtccttagattatcatctttctccaccaccccaaatatcttctataatgcattgttcattggtacttagtgtatctgttttattacagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgagtaagtatagataggaaaaataatcactgtcactgattaaagaagtactttctgggtgggcatggtggctcacacctataatcctagcactttgggaggccggggtgggcagatcacttgaggtcaggagttcaagaccagcctgggcaacatggtgaaaccccatctctactaaattacaaaaattagccccatgtagtggcaggctgaggcatgaaaacagcttgaacccccccgggaggcagaggttgcagtgagtggagattgcgccactgccctccagcctgggcaacagagtgagactgtctcaaaaatacgtcccatcatcttcaggttatctttgattttgggagtttacatagtaccagttttgtccttggaatgactcagtgcatttggtttatatttttttcagacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaaggttggtgtaaataaccattagttttccaattggcctctttagttttttttttttttttttaattcagaaagtctttgtaaagaacatactttgtttcagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtaagagaacactatgttacagtcatacacgtcgttcttacaatcttgtaggctctgtgggtgtgttttctactcaggtagcactgttacaactggtattgatctaggcaagataattaacatgaactaggtcattttctgtcttaggttctgcctaggtatctggctagcaagaaaagtcagagctagatgaaaccattcttaactgttaaaaggtctaaaagtaactttgtaatacctcaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtatgtgaatacagcatttcctgatcattgatacttctaaggtgctttcaagcttagtcatacatagcccattttcgcatgttttcaacttaaaacagaaaactatgttgtgtgtggctgggcgcggtggctcacgcctgcaatcccagcactttgggaggctgaggcagcggatcacaaggtcaggagatcgagaccatcctggctaacacggtgaaactcagtctctactaaaaatagaaaaaaataaaccaggcgtggtggcacggcctgtaatcctagccacttgggaggctgaggcaggagaatcgcctgaacccaggaggcggaggttgcagtgagccaagatcgcaccactgcactccagcctgggtgatggagcgagactctatctcaaaaaaaaaattgtgcatgtaaaacatgaaattataacctgtgctctttggatacctaatgcgacatttaagttgtatttgacagtagatagtattttggatctattgaaatttgggttctacagatttcatttcacaatgaaagtttaggaattaatctttctaggttcctagtcatcactttttgattacaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtaagccttatactatgtaatgttaaaaagaaaataaacacacgtgacattgaagaaaatggtgaactttcagttatccaaacttggagcaccttgtcctgcttgctgcttggaggtattaaagtatgttttttttagggataagtaaggtcttacaagagcaaagaaatgaaattgagactcatatgtcctgtaatactgtcttgaaagcagatagaaaccaagagtattaccctaatagctggctttaagaaatctttgtaatatgaggattttattttggaaacaggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacacgtaggcacagaaaacaggaatgcagacaacatgcatcccctgcgtccatgagttacatgtgttctcttagtgtccacgttgttttgatgttattcatggaatacctt

SEQ ID NO: 78101 - DNA, 1050 bp, Homo sapiens
ttccgctggccctggcggctgcggaacggtcaactagaccccactagctgaagccggcatcacctgggaagcagccatgccgcccggaggccacacccgggggaggagcctgcggacgcccagtcgggtggagcacgccaggtgagcacgcctgcgcagtcgggccgtaaacaagcccaccccttccctttggcccgccctcgcagggctggcccgcgggtgggaggggcgagaaggaagaggcagggggtgggggaagagggagcaccaggaacagcgcctgcgcggtgggcgtgatccgggcacttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaaggtaccgacccgggcgtcaccggagccagccagcggcgtaggcagaggccgggagcagggcggtgacagtggggccagggtgaccgagaggggtggccgtcgctcttacttttgagtgggccggtaactccactggggtactcctgaggagaggggattcaggagtaaggagggtggtggcggtggcgtttcgaaggggtgggggcagtggaaagggaccgtggggcgcgggggttctggctgggaggctcccgggggagccggctgcgtcccctccagcctggtccatcaggctctgacatggccagggagcgggcctgcgagtccccggaagaggtgaggtggccgtcttgtctgcttcgattgcctcgcctccctggagggttggaagtctcgccctgggttagagaacagggacgcaagacggcttaacaagatctctgtaaggcggaaccggggccgggaag

SEQ ID NO: 78102 - DNA, 1019 bp, Homo sapiens
taagctggttcagaggggttgtgtgagagtgcccagattaatcttgtccaacaagtcagactgtgtcccaaacagggagtgatatgctttaaaagctgctttaaagggaccatccttcttggcgggcgagttaccggtaattctgtgaaacatgtaagcatcctttaaaagtatctctttaaaagcagccatttattagagtttttctttcattggctatgtaactatgttttcactgagaattgcttatttttgagattgtagtctttgacttgatgtcatggaagagtgaggaaattaatgcatcccacagcacctccaaataggacaaggtgataaaagattaagtcgtaaatgcatgttagcatgaaaataaattgttcatattgaagagtgaacattcttcaggatttaatatagccagatccagtacaggattttcgcttgttacaagagctagggaaatgacagtggtatctaaatgtagcaaagttgtttctttgattcagggtgaatctttttttcttagtctttatgataataagtgtaccactgtatttagggtatgctgttggaagttattaagggtaaatcgcttgaccttttttttttcctcgtttggaattgcaaaagctcgaagtagtcttcagtctaggggctgaagttttactcctactcccaactttgtcactgacttgtttgggtgaccttggataagttatttaacttctatttgcacctctttaaaaagggaatgttacagtgcacgttgtaattaataatataataatcataatgaactttaaggccctgaaacactcagtagatgtaaaatatagttaaatactgactgtcaaataagaagctgctgtcttgacattgataatcagagtgaaaggaccaattttgtctcaggaaattaagtttagaattttaagttataaaaatttatatttatataaaaatacgatgtgcttaaaaactaaattcactaactagcaattattaatgtaggaatt

SEQ ID NO: 78103 - DNA, 1022 bp, Homo sapiens
tagaagagctttatgttcatgatgctgagatgaagttggggccagaagaagagtcagttgataaaagctaaagtatttttagatcctgattaaagaagaaggtaatgggttgacttgagagagaatgagcgttctgttatgggaatgctcatatgggaaatgttctgtctctttgtcaaaaactgcaggaccacctgttggtgacattggaggaattcctgctttgtgtgggagggtgaactagatgcctttaaaaaaaatttcccccccacagacttgttttagatattttactgcttcagagagggtcatgttcacaccattctccccttttgtaatttttcacacctccctggctccccttttataatttagaaagaggtttagaagtctgtaactttttgtattagatttactttgagaaatcttgtacttaatttagtaggtcacagagggttgctgaatgactggaaacttgtgtttcttttccattaagggctatttgctgacttctgaaatattgatgatttatttgactttagaattttgcatactgaggggaaagcatcttaatgtatcatttaaagcaggagatactttcatactatacctgggttctcttggctttgaagaggagggtggtcatgagatattgaaagattgcatgggtggcttgtaatcccagcactttgggaggctgaggcgggtggatcatctggggttaggagttcaagaccagcctggccaacacggggaaaccacatctctactaaaaatacaaaaattagccaagtatggtggcgcatgcctgtaatcccagctactcaggaggcaggagaatcacttgaacccaggaggtggaggttgcagtgagccaagatcgtgccagtgcactccagcctgggcaacaaagcgagaccttcccaaaaaaggaggacttcatgggtagatatgagcaatggtgagaagcacctggaatatgtcatggaagtccgtgagatagtcatgaatgccattctttc

SEQ ID NO: 78104 - DNA, 1044 bp, Homo sapiens
tagcactacagtcgttctcttctgattttcaaaatggcttatggcaacctttgatgttactcagactgctccagctagttttgattaattcattcaggctgtcagtgactcagcagcctcctggcttctttcttgtttttaaaaggagctggactttcacaatatatggaacatagttaacatattgcagctaataagtgtggcacataatgataggcatcggtgaaggggtctggaagaatgtcacacataggctgggggggggctcaggaggacatgacatctctgcttttgtgaatatgaggataggggactttttttgggtgaaagaaggaatggcaggaaaggcaaggtgtcagaagcacaggcagcagccaagggtctttggggtaatgtatgtggaggggcgggggtgataaggccacattgggcagcctgtgagtgctaagctgtaggccctgcagagccgtggcagtggtggagtgggagagtgacctaaggcttcccgaagatgtgtctggcagagtgtagggcgaattgcatgtgattggaaatgggtggaaggagactggcacagagctagagaggctgagctaagctggggaaacccaggctggatgagggccctgaagctgtcctttgggcaggggtgccaggcaggggacccaacagagcgccaagtataaagctggttggggtggggcttaaggatgggaggagtggacttaggaggtagagagtgctttgggtgtaggccaggtaagtttctggtctgcctgcattaggcacttggtagctgttagctatgccagtaaaaggatcttttacttttctggcaagactctgcaagaccggttctctcttaggtgattctcaggtggggatggggagggaagatgtgaaatttagggaaaataaaactacctttattacctacactatttccacctgattcatttaaaattatgtctaagattataatttgacacacatttttcaaaagagctctgagatatttttcataccacatcagatgcttctggg

SEQ ID NO: 78105 - DNA, 1044 bp, Homo sapiens
ttttatatttgtaggttttttttttgtttttttttttgtggctgtcttcctcgttctgagatgaatggcatgtggtgttctctcaggccaggattctctttccctgccatccgagccgctcagaagctgccttcctcagacagcctgtccgtggccatcgtcccaggccccgctgctcactcgcagcactcggctgagctgccttcagcctgccttgctgtacagcggccgctcccctccactggccgcttttctcctcgctccagtcaggactcccttttgttttgtatcatgctttgtattacacttttcaaggctctttcatgtatatattctcttatttcatcctccagacaatcccatgaggttggtagaacagagattctcatctccgttttaactgaggtgaggctgggagagtgtccgcatggcatgcaccctcattcctttgccctggggctcccagaactacttgttaccgctcaggtccagacttctacatgtgcaaggttttgagtttgctcaaagacgcctgtaattttgaggtcctcttttctactcattacttatatttgttattggaaagtccaacattagaatacttggttcgatgtcacaggcctctttggaagaaagaaatcttcagaacctgagggggcggtcagtagagaactagagccgggagccccagagggccacacagcgtgaactgggtgtcttgagggacaagttctgcttcagggttagttgtctccactggagattttcagacaagagtgggagggggtgggtttcccttatttcaccaataaaagcccagcatattgggatgccacaggacatttctcatgaagaaaagaatccttcttgaaagtggggagggcacattgaaaaatcacttttcacccaagtgagaaatcatttgcttttgactctctctccccatccccttaatggtcaaacagacctgggttccaaatccagccctgccacttacttaggtaggtatggtgacgttggtcaagttatttaacttccctaaac

SEQ ID NO: 78106 - DNA, 1968 bp, Homo sapiens
gtctgtttcagtatgacttttctaccaagtggaaaagataaggtaggcttgctgagttagaagccctgggttccaatctctacttgggaccttgcccctgaggcgcaagggtcaggctatgtgggaccccctcccttttgcattgttgcatggttttaacatcattaacttggaacaaaaacacattatagagtatggtttttaagaaataattttgtttggggaagaaaattcaaattgacaaatggcagttaaaatttggattcttttgcagttatggtacttgctattcatgcaaatcagtatccacccagggtgctcctgtttgacattgccagtggatttgataagatcttatgaaccatgccatctcttctagtttcctctgagttgactggaaacaaaacttgccatctggactgacagattgtagaggaaaagtatttaatcccattttccattaaaaaaaagttaagcagaaaatattttatttacctagatgtttttttagtatcatctgcagaagtgatttctaagtagctggatgattatttttttggtgctgagtttggggagcagcgcacaaaattggcctcctctgcactgttagcagaaattgtgaatttggaatcattgtgggtttttattgtttaggtaggggagagtgtgattggagggggcagggattggagccatgtaagggctgttagtaaacaagacccggaggcagccctggccgaggatggtacagaatgccgcttagagaacaagaaagttttgtgtgtcgtggcagggggagggcagggagttggagaccacacgtccccagaatctcagggctctgggagcactcaggctgcattggccagaactatccctgccctggtgactgggagttgcaggctggaaggcagctcctcattcttcatgatttaagcatgagttatctcatactcactttacattttatttgagaaattgctatttagaatgctaagactgtgtgtggtttaatgccagctttgcatttacagcttgaggctgaaatcgattgcccttcatagtaaggagatcctctggccatgtggatacatttttatcagattttggtcagaatgtctaagagcaagggtcaccggaggtttgttccttagagagtgccaggaatggtggtgaagtagtcatcgtgtcgtgctttgctgtggtgtgacatttacaggtttcaaggcacttttacctatggcctctacagggagggtggggagttgttcccattttacagatgaggaaatagtcaaagagcacataagtgaattgtccagatcaggtagcaagttgatgatagagttggaaccagaaattaattccagaaactcattggttacaggacccaccatgcatggttgccagatgagctcttgcccttccgggagctcacagtttagtaagaatggacagagagtactgggcacgtgtcagcacagcgatatgaacaaaataccaagggctagctgccgcaggaattctttagtatgcattttaaagttttttaaaatgttaagttcactgggggagttccaagaaatgcttttagaaagtgatgtttgatgtgggtcttaaagggtacatagtcattagaggagggtaaggaaggccttcaaagctggaggaacaactaggcatgtgaaagaacatccagtaacagcttggccacatcacagtgtgggacttggagtgtcagagttcgaagctggaaagataaattggaaccagcttgtcttataaaagccttttcatgtcacgtgaagcaatttggaactgacactggaagatgtgggggaacctttggccttttaatgaagggagtgacaggatcaaatgtgtttttttagaactcttgtcagcacttgtggaaggtggattggaatgaagaaagacagaatgaaggtagcaagaccagtgaggagg

SEQ ID NO: 78107 - DNA, 1474 bp, Homo sapiens
actgccaaattgtaacccctagttttgtgctccagatccatacatcccactatctacaggtctctcgaacttagcaagtacagaccagaacctctgatcttcccctccattccctgacaactgctcctttcccagtctcacccaacacagcaagagacacccagaaacctgatttattaatacacctttccaattcagtctccaaaaagcagccagggtacctttcaaaaacaccaatctgcctgccttgtgcacctgctcccttctaaggaatcccgtacttcaggctaagaaacaaatctggatcaggccgtaggtgatgtggccctccaatctcatgcccttacttcatgccaccttccccaggtaaaccgtccttctttcagtttccttgggctcaagggccctcatgtgctattccttttgcaggaaagctccatctccagttccttacctggttggccttcttctcacatgaggcacagcttaaaacatagcacttcgtccgagagatgtcctctgcctcccagtttaaagtagacctctgtgttggccaggcgtggtggctcacgcctgtaattccagcactttgggaagctgaggtgggtggatcacttgaagccaggagttccagactagcctggccaacatggtgaaatcccgtctctactaaaaatacaaaaattagtcaggtggcctataatcccaggtacttgggtgggtgaggcacaagaatagcttgaacctgggaggtgaaggttgcagtgagccaagattgcgccactgcactccagcctgggtgacagagtaagactctgtctcataaataaataaataaataaataaataaataaataaataaataaataaagtagacctctgtgattctctccctttcttgggcctgctctcttgcctcttacatcacaaagtgtcaccatctgtggtcaccagtgtttcgggggtggtgctattatacctctcttccctcctgagaggggtcacaggagggcaggttttgcccactgctgcagacccagtgctgggcatgtggtaggtagtcaaggtcctgaatgaatgaaacaatggccgcaactctagttcaagccctcagctctcacctggacagttactagagcctcctcactggtcttgctaccttcattctgtctttcttcattccaatccaccttccacaagtgctgacaagagttctaaaaaaacacatttgatcctgtcactcccttcattaaaaggccaaaggttcccccacatcttccagtgtcagttccaaattgcttcacgtgacatgaaaaggcttttataagacaagctggttccaatttatctttccagcttcgaactctgacactccaagtcccacactgtgatgtggccaagctgttactggatgttctttcacatgcctagttgttcctccagctttgaaggccttccttaccctcctctaatg

SEQ ID NO: 78108 - DNA, 1981 bp, Homo sapiens
atgaggctcagatgagtgagttcaggcagggtgtttgtgaagggcctgaagagcgagccttggtggatgctcagcaacgtggaggttgagagaaactcaggcttcctttcctgggaggggtggtgttggacggaaagggttccgtgggaggtgagataccaaccgttttgaaatacaaataattaattttttaggacaagcaggtaggagcatggcaacccaggcagagagtcaacatgtgtgaggctgagggttggcccgctggtcacaattacagcaatgtggcctttcagtgttcctcaccagaacacctctcagacccacctgttaccacacgtgcacacaccttcacacaccgaatccccagcatcagttactctggcctttgcctcctttctggtgcctggtacatgaaaatgtaataaatgttgggatggaaagatgagtgaaatggaattataaatttcagaaatccacctgagataaacatagatgaaaaattcccatctgggaacaagtatattttaaaagatgattttccccctgtcaattaaaaattgtgtgcatttaaaatgcttgttgatagaaaaattggaaaatagagaggtacaaagaaggtaggaaagcatcacctctaaaccgtgacgctcactgttgactttcacagtctgtgattgttttcaatgaggggacaccatagggctcacaccttccattgggggtgaaggcaaacttcaccaaacttcatctccaagtctggccctgatcaggtcagcccagtgagcatgggcaggccctgccctcttcccgctccctgggactgtcctcagtcacactggaggtccttgctggtgcatctgttcaagacccaaagaaagtcgaatgcccagtcctttctagcccctctcaggaaatcatccccagctccctggagtctctgctttccccaatcttccagagtagattttgggtttctgtttgtagcgttctgtacatatgatgcccttgaaaatgtctaatgggccattattgaaagtatcttggcgcacggttcatctgacaagctcccagatcgtggagcgtgtcctcatcatcagagctgcccacagaggagagtcacccggtcacattcagctcactgtggtgaagcaccccacaggggcgaggagtttactttttaaatttttttttttgtgtgtgtgtgtgtgtgtgtgtgtgtgtgtgtgtgtgtgtttcactctgccctgttctgaagtttgctttttataactaatggttatatatttggggaggaagagttacaaagggacagttcctatatggtaatgaatgcaaccttgttgtctgtgtaaaaatcctgattttggagtatattcacagaatagtaactttgaaggattttcaagtatgtgttaattgttggctgaaatataaaatgttaaagaacttggcatttggcttctttcgttactgacacgataccctctgctgttgcccttctcctctcgcaggctgtgaggctgaggcagacacactgggtaggtcccacgtctccttgtggcatttagatccagtcttactgaagggcatgctgaagaggagatggccctgactcctggggtatggagggacactgctgccagcccaggctgcgtggcacatcctgccagctgcaggtgcctcccaggcatggggtaaagcttagcagtgttctgtctattctgatacaaaggaatggtctgcacattttgttagttttgtttctgttgattttctaatcgaaggaaggaaatgagcccgtaatgatctactccttaaagcttgaacacagataaaacgacatccgatcccatcttaatgtggctttgaaataccctttcctaatacttcctgagccctcttcagatgcctttacatcatcagagcctttagttgccatttttgcttgtggttgcattatggcttttcaagcagctgctgt

SEQ ID NO: 78109 - DNA, 1016 bp, Homo sapiens
aagtgccatgaggagagcaggcagaagaggaaggagctgccacaggaggccagagcctcagaggacaggcctctgagacttgaggaagctgagccctagagggatggagtgcacagggagggggtggtccttaggagagagcacagggaagcagggtgggggcagagaaggtgctgagagcaaagggacaccgtaggggaggagggtgcagggcaggtgcctggtggaggaaggtgagctccaggagagagggacagggaagagacctgctccctgggccagaagggaggtgctggggaacagagacaggcagaggcaggaaggctctggtgggaagcagtggaggagagccccagtcccagtcgcagcccctccagggcaggggtacactgagagatgggcagggcaggtgctcagcgaggaggcggagggaaggcaggggaagtaacagaggtgctggcagagcagctggcctggccacagggctctccatcagtgtccaactccaaaatgctccaaggcccattcttaacaaacacgttcataaaaacacaaaaaacccaaaacgcaaataaaccttaaaagcaaaacgaaatacagacacatttctatgtacgtcaagacacctgctctgggccagtgctctgtggggatgcaggctccatgtctccactcaacgctcagcgcggccctccccatagttccagctctgcaggccaaacagaccgtgccacttaagatatgaatacaaagaaaaatcccacgaacagcgaaaacactaccatcccaaatgccatcaacagacaagattttcaaaatacactagttaaaatgaaacaagaataaaaataagtctataaccacatcaaagtgtcattttgtgaaagcaattcacactgacgctttctaaggcacttcattttctttttcttttttttcattactatcaatatgataagcaaaaatcaaaaattagtttgggggtgagtggatctgcatttcaaaatgcagatatt

SEQ ID NO: 78110 - DNA, 1023 bp, Homo sapiens
gccttggcctcccaaagtactgggattacaggtgtgagccactgcgccgggcctgtacggaggtttttttcagagtttcacacactcttcctccgctgcacctgcttccttggagatatttatttatttatttcagagacagggtctcactgtgtcacccaggctggagtacagtggtgtaatcataactcactgcagccttgacctgggctcaagtgatcctccttggagatcttaggatgttactattcgcagccaatttctgtgacattcgtggttatatttattagctgcagacctttctagctgcatactgggcaaaacccaggggtctttacacacccccgctttccatcttgccctccacccagccacattctgccacgctgcccatggtcaagtttaagacctatttgtccatggcatggacagttgtcatagcctcctaactggttcctcatcacccccaccccaccttgcattctgcacctactgctgggggatttcatgttattctgccacttccctttctagaaactgtctgtgcctccactgtctgcagcagcatccccagtagaaatacagtgccagccacgtgtgcaagtttaaattttctaattaccacattaaaatagtaaaaaccaggtgaaattaattttaagaaaatactgtattttatatatatatctccaaaatattatttcagcatataaccagtgtaaaaactataaatgagatcattgacattttttttcataccacatttttagaaccctgtgtgtgtttacactgacagcacattccacttgagaccagtgctgcgggactggggagtgcaagcgtcagggtcccagccgaagccctttagcttgggacttcacagccacagcctgagtcccagctcacaactccagaccaaattcccctcccagctcatgtgctgcgatcaagacagatgccacacatggcctggatccccacccccctggcctgctgtgttggctgggcttttccttggagcat

SEQ ID NO: 78111 - DNA, 1028 bp, Homo sapiens
gggagtggccctgcaggctggtcgtcggagccaggtgatgtgtgtctgtggaacgggagacagcatgctcgctttggggtctgatgggcccgtctgttcccctggcactggttcggctgtgtctctccgcctcggagtccttgaagttgttctctgtgggggtacacttccccaaacatcctcttagcctgatatttgctgtctttctgtccttctgtcttgctcagctgtccagcaccagcagaggaagaggcctttcttggccatcctattcaacattgaaatcactagagtccccttctccccagcacgttctcttctctccctggtttatttttctccacagcacttatcatcatcagatcacataaatttcactgtcttctcatcccacttgaacctaaatttcatgagggaaagatgcctgttttaatttatattgtatcagtgcctggcatatggtacgcactcaatactggatggatggatgggacttcaggcaagtttcttgacctctctaagcttcttttctcactgataatatggcgacaatccctgccttcctgtagggagacaggcatgactgcattttccattttccatgcgaggcaatttggtaacatctgtaaaaatcataaatgtatatatcttttggctcagttactccactgggagtttatcctgtaggtacattactcacacatgtgaaaagtgcgtgtgtgcaagggcattcattgctacatagatgtccatcagtggggcacttccacaataaaccacagtttatccaaacagttgaatactctgcagctttagaaaagaatgaggatgctgtctttgtgcccatacagactgatgtacaaatacacttggaggctgggcatggtggctcacgcctttaatcccagcacttcgagaggccaaggcaggaggattgctttgctcctgaagccaggagtttgagaccagcctggacaacatagcgacaccctgtatttacaaaaaatataaatttttaatcagctggg

SEQ ID NO: 78112 - DNA, 1046 bp, Homo sapiens
tttgatggtggagggaggtgcaaggatgatgggatggtgaacggtggattaagaggcctccactcccccatcacagctctgccagaccttgctgtgcccactgggcccagactaccccagcactcttgatcccacaaacacaactgtacctgatcgcccagggcctaagggtgtctgcagctcgctccatcactggccttgtcaggcaggcctacaccagctaactcaggcctgggaagccagactgctgtcctgattttggtacagtggctcccaattcctgcaccttacatttcaccagaaccaaatcaaatcccagtttttctaggatcacttcattgttactctatttaccatgtgtggagaaatttcaggacataaaaacttctagcagcacggttaggagtaaattttattttgggccttaaaaaacacaacaaaaaactgcatgagaactcaaaaactagtatgatcaagtaaaaacagtattgctttgcaatagtgaggtatgaacagcatttatagcaccattaaaaataaatgttactgcaatgacaaaacacattaaaaaccttcactcccgtattaagaagctgcactgtggccaggcgcggcggctcacgcctgtaatcccagcactttgggaggccgaggagggtggatcactttaggtcaggagttcgagaccagcctggccaacatggtgaaaccctgtctctactaaaaatacaaaaattagctgggcatggtagtgcgaacctgtaatcccagctgctctggaggctgaggcaggagaatcacttgaacccaggaggcggtggctgtgtgcagtgagccaagatcacgtcattgcattccagcctgggcgacaaagtcagactccatctcaaaagaaacaacaacaaaaaaaaacagtgcactgagacgaccctaagtagacacatggatgtaacttacagataacatcctgtgccaatctacttcaatccccctgtgggggcctaattaaatgttactgtgacacactggcaatggtggactgagca

SEQ ID NO: 78113 - DNA, 1028 bp, Homo sapiens
tgttgttgtttcttttgagatggagtctgactttgtcgcccaggctggaatgcaatgacgtgatcttggctcactgcacacagccaccgcctcctgggttcaagtgattctcctgcctcagcctccagagcagctgggattacaggttcgcactaccatgcccagctaatttttgtatttttagtagagacagggtttcaccatgttggccaggctggtctcgaactcctgacctaaagtgatccaccctcctcggcctcccaaagtgctgggattacaggcgtgagccgccgcgcctggccacagtgcagcttcttaatacgggagtgaaggtttttaatgtgttttgtcattgcagtaacatttatttttaatggtgctataaatgctgttcatacctcactattgcaaagcaatactgtttttacttgatcatactagtttttgagttctcatgcagttttttgttgtgttttttaaggcccaaaataaaatttactcctaaccgtgctgctagaagtttttatgtcctgaaatttctccacacatggtaaatagagtaacaatgaagtgatcctagaaaaactgggatttgatttggttctggtgaaatgtaaggtgcaggaattgggagccactgtaccaaaatcaggacagcagtctggcttcccaggcctgagttagctggtgtaggcctgcctgacaaggccagtgatggagcgagctgcagacacccttaggccctgggcgatcaggtacagttgtgtttgtgggatcaagagtgctggggtagtctgggcccagtgggcacagcaaggtctggcagagctgtgatgggggagtggaggcctcttaatccaccgttcaccatcccatcatccttgcacctccctccaccatcaaaaaaaagccctgctctggccatgtaaattatctctgtaaccccttgctgagaaaattgcacgaaggtctaatggaaatcctgccagagcagcgctgggttttaggttgttggcattagtgcaggt

SEQ ID NO: 78114 - DNA, 2072 bp, Homo sapiens
gggatgaaaatactggctgtgtccccaaggctggcttgccacgtgcctattaatttaagaggaccagccatgccgttttacggcagtaagcagtgacacctgctgctgagtaactgcccaatgcatggtccccagccctgggcccgcatgctgtgtggcgttcaggcctccgttcttcctgcctggggtcctttgttagcagcctactttctagggtctaatgttcatgcagtgagcttgcatggctcattaatttctttcccagccgttcttttaaaaatcaagtcgtcttatttctgtaattctctgtaaagatgtagcacacatggcgggcacatggcctcaaagccaccctggcagaagtcggcatgtttcttggcagattctgcccctgtgtgcccagtacccctctgagacttgagtcagggactccccacctgttaggtgaagcggtggtgttcaacttacctggggctgctgggctcctaaagggacactgttactggggcgatggtgcagtggagagcacttggcagtaggagcttctaggtagaacttgggagtcttgggacttctggatgtgttctggtgatgcgattttgcgctcagacggtccagaaagggaccgcccctgtggaaggtgttgcgctggcatccccatcacaggattgattggcaagcagggaaagagacttgtgcctttggtggggcaggtatttttgcccttcgttatttgggttttaaaggcaagactactgacatacgcctgttaaagaaacatctcggtcaggggtccaaagttagcatatggagcagagtgatggtaatgagacacacactcccgaatgaatcgtcagtgtatctctctcaacaccagcagagagggtttcgaggagatgcttatggagatgcacgtggggcggtgcatgggagtgaggcggcctcagtgggcccaggctctgttttggagttgtgtgtgctgccagccatggactgtggatttcactccccaccttcgagccgccagagcagaggggcagatggaaccagcccattacctacagtgacagtaaaggcagaggaacccgtgagggtgaggcagagccctcctggctgtgaggactcacaggcttcacctgcaggtcctcgtagaggggataccacatgcagatgcagtgacccccagattcagatgcacctactgtcaaggaagaaagatcccagcagggctgttccctccgcagtgaaccctgtgcctggcatcgtgtctggcacttagtggcccctctgcaaatatctgttggctgcctgactccctccgtgaaagccagcagcctaacaccgattttagaaagtaattctaaattaccccaaaagggccaaaacgctccttgctggcttggctgactgcaggataaaatgtggagggcctggatagacttgccccttcccatcgagaagcacacaagttttcttgctggaaaagtagacctttgagacttctccgttgtgctaacttgttctcctttgtcttcacagagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaagg

SEQ ID NO: 78115 - DNA, 1067 bp, Homo sapiens
tttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcag

SEQ ID NO: 78116 - DNA, 1141 bp, Homo sapiens
ggttcccaggtggcagcacgcggccatgccatcacactcaacagaaaccactgcgttaaggcccacgatgggcacagggtggatggcgccaccgtgacatgtttgcagatgggaagcaggcctgggaacctggcccggctttcctgggagggctgcgttaagagcacagggagctgctgcttcagctaccagggtctttacactgcagagaaagaaaagccaccaggtcttcactttgctgaatcatattcactacgcaaactggtctaagtgatcgttgtctctatatttaattacaaaggtgtacaacctaaatgcccaaaatgagttaacaagtaagataaccaccatcttgacatggaatacatagttcaaggggccatctcacccactgggaaaaccagaatttgaaaagcagctcctggtgcagcagtagagagtgagggtgaaagactgcggtctccgggggagcagcagagcctcccactgccgaggaagccacaggccaccaggtcctgggctgaggcgctagggtgggagccactgaggacgaagcctacgcacatggccagcgtcagcatcccaagagtaatcccggaaccacagctgccatccaagaacaaggagaggggaaacctgcacttccgcttcctctgcgggggacgaagcccaaacgagggccatgtcagggagaagtcggaagactcggggagtctcaggctttacgaaacaaagcgcggaggagtcacgtgcctttctgacccaatccccctcccccaccgcacctccccgcccccggcaaaaaaccaaaaaactccttttcccttgttgggaaaacacacaagcaaagtgcatctgaagaaaaggtcttcgcttatgtggcaagaggcacttctgcaatgctgttggcgtcctcggcccgcagttcccacgaactgtcaggctctgagtgaggtacgggtatcttagtacacagaacctcaatcaaagtgctacaaactgcttctttgaaaaaagatgtttattaaacaactttaattgtcataaaatgactaaaatgggttttaaaaattaaggctcttctctttctgtggattgccagaacaatgtaaaaataatatcaatcaaccctgctaaacgt

SEQ ID NO: 78117 - DNA, 1054 bp, Homo sapiens
tctggttttcccagtgggtgagatggccccttgaactatgtattccatgtcaagatggtggttatcttacttgttaactcattttgggcatttaggttgtacacctttgtaattaaatatagagacaacgatcacttagaccagtttgcgtagtgaatatgattcagcaaagtgaagacctggtggcttttctttctctgcagtgtaaagaccctggtagctgaagcagcagctccctgtgctcttaacgcagccctcccaggaaagccgggccaggttcccaggcctgcttcccatctgcaaacatgtcacggtggcgccatccaccctgtgcccatcgtgggccttaacgcagtggtttctgttgagtgtgatggcatggccgcgtgctgccacctgggaaccacagcagccttcaggtgcatctctcctggctgtgcctttcacatccctgagcactgctcctaggagtattcgtgtcctctctacctgtggaatacgggcctttgttcctaaaggtgaactgatctaaggtagccatgacagccatccttgtggacagtttccgctttggaggccaaattgggtcatgtggagagattagtgatgaacgctccatgtgcaacttttgcacctacatagttgtaaacgttcagtttcaaatgcttctgaggcattgagtatgcagtttcaaaattcaggacttagtatttggcctaaatagagagtggccgatcccaagtaagtagcatttatggtgacatttctggcgaccttgcagttctgaaggtgttgccctggacagggaagccgtgggggtgtgtgcccgagtaaccaacgtgaccgactggggactctctgatttctcccccttctttaaaattctcagtcgcagtggctgggatgaaagagggattgcaggggtacactgacaggtgacttaggagtcatttgctgataggaaccaggggtgggagaggcaagaggaggaggttatgtttcctttgaaaacaactccgaagtgtgctgtctagtatggaggcctgtgtgtgtc

SEQ ID NO: 78118 - DNA, 1017 bp, Homo sapiens
ggtgtgcccttggctgaggtttcgttccttagcagtgagaacctccacatgcgtgggtaggggtcgggtgacctggagacgcctcctccggtctggtctgggtgacaaaggtgaaggtttatagtctaccaccctggcagcagcctgcagggcccccccttgtctggagcacacccttcgccacgggctgattgggactgtcgggtgttgctttaagttaacaaggtgcacatcacagcgaccccaagtgatgtcccaaagggaggagacattagtctggccgaagtgaagtctgtggctttatatgtaaaagcactcgtatgcaactgttacctttgaaactcagatcctagttacgaactataagaacgtgcccctccagtagagggagactgtctcactgatgttgatttctttattcatttccgcatctgttacacgaacttcgtgtcataaattgctatcctttcatttgaaagtgtaaaaaatttcctgcatttttatcatttctgtatacttgagtttattagagattgttatgttaggcgacactgtataaaattgtatggatattttgagtgaaaatcaaaagtaaaattcacatgtatttccttttttatattttcatccaatttcttgacaacttgaataaatttcataaagagccttcctaacatgaaatattggtaaattaaattctttactgttgcaataattaatgaaactttagtatcagtattgttttataattttaaggaaatcatgtttgtttcactgctttgtttttttttttagctgttgccttgtcactgtcacagctaacaagacttactacatacttgatattctgaagtactgtggggctgtcctctgtatactgacattaaataaacgtgtgtgagtgaactgtaaatgtagataattttcagtagtcattttcacatctaagctttaaaaatcccagtgaaccaaaaccagaaaagtttttaaatgctgtaaaattaaggaccttgttaa

SEQ ID NO: 78119 - DNA, 1056 bp, Homo sapiens
actccagcctgggcgacagagcgagactctgtcttaaagaaaaaaaatagccatttctccatgtgtggctgcctgtcagaattaatggattctgaacccaggggtctctggagacgaatggaccatctagaggctctcagctccctaccaccccttccagggtcagtggcctccaaaaccagcctccccttttaggtggggggcagcataagcaaaatcctctttgaagttactcaagctagaaaggctttatggagactaagtggggtcccttcttcctgccccacacagtagagaggattgcagggccaagtgggtcccaggagcgggagggcctccagtgacagcccgggccggtgctggtctccatcagtgaacgggatcacgatgaaggcccactgacttgcacacgttctctctgatgcttttcttccaccttcagatcgcagcggagcccttagatggtcgtgcccttcatctgcgtggtctttccccggaagtctgaagagtacaatccttttctctgggtggcttttctcattagatgccaggttgagtggcatctgggcaagtgtggcccctcactgtcacctgtcagtggacaggttaaagctggcagaggtacgtggtccactgcccagctataactgaggtcccaagccaaactgcacggcaagtctggggcagagatgggtcccgacgtccctgggctgggcccagggttcccggctctgtggctcacgtgccgcttgtgtgatgtagagactggcttcgggtgccgtgaataaaccatggctgctttctccaggtttgctttggttcctttctgttgtggtctgtgtagtgagaatggtgggagtcttgcacgtgagcagttaaggagtgtgttcagagctggaagtcttggttctgagagcaggctagcctggtcatagttctcatcgtttccgcaccgtctctaaaaaggtgtcgctttgcaaataacatttaactcgtgttctccccagggtgagattctgccaggagcacctgccacagaggccagcattggagcct

SEQ ID NO: 78120 - DNA, 1127 bp, Homo sapiens
tgagaaggtagcaatgtcagcttgagttaaaggcttgtcatttgtaaacagtactcatcagctgaagccttcttccatgacagctaagttgtattcccagagctgaaaatgtgcacctttggggctgcactgtcgccatcttaatgttcttcataaatgaacgccacactttgatgtaatgtaattgctgctcaatagtaaatgcaaagaaatggaagtactctttgctgtgtaggaggttaaaccctcttaggtttacccaaggtcacaccagtattgtaaaatctgggtgagattccccgcccccgcccccgacagtgagcctctcagcaggagccgccctaaagagccagatgccccccaccattcttcctgctggccctggtgggttggcccccacatcccttctccacacccagctgcagcctcacggcaagactactttgttctggggctcccccgacctcggcctgggccctgctgtctctacctgtggggcctacacatgtggacagctacagccagggggtgccacggtcacaccacccaacaaagcaagaaccccccagcagagaatgccctttcaaaggtgccactgaactctatccttggagacaacccctggctccgagggactgggtgtgcggtccagaactgcggtgccctgggctcaaccctggctgaaggcgctgaacacctcccacgaggcacctgcacctttgggtcagcaaagctccaaagaacctgttctcaggtgctgagaaaccactgtctcccccaagggcaaggccagccctgcccgcccttctcttggacggtattgaggccacagtattgcacccagcagggttccaattctctaggaatggaacgcagtgatctggataggaattaaatagatgaagtggagggtttgctcccacactggcttccacatcaacagcaccagttttgaccacgtggagctgctggcggagggcgcgcatggtggctgttgcccgtccggtgttttgctggattaatgtagactgctttgtttgcagggctcattgtcatccccaagccaggccagttctccaggtggaactgtagtgtagcgacctcactgctgcgcgcacagtctcccg

SEQ ID NO: 78121 - DNA, 2187 bp, Homo sapiens
cgaggtcaggagatcgagaccatcctggctaacatggtgaaaccccatctctactaaaaatacaaaaattagccgggcgtggtggcgggcgcctgtagtcccagctactcgggaggctgaggcgggagaatggcgtgaacccgggaggcggagcttgcagtgagccgagattgcgccactgcactccagcctggacaacagagggagactccatctcaaaaaaaaaaaaaaaaaaaaaatctcaggtaaacagtgtgattagctagttcatgtcccatgttcatactcactgtagaaactgtgttatgtgtggtcacaggctttcaatgacgaaaggaggactcggagttgtatggaaacgtgatcctgaagccctgtgcagacgtgcagctgcccacagtggccacagacagctgaggctgtgaggcgaccacagagcccacgccctcctgagccatattcttgaacagcccatctcaagtgtgactggtgagggggcttcaagtaacatggggtgaaaaagacaaaacaattccataccaaccagttcaacccaaatgtacaggacaaactaagccaatttaacagaagataaacaagcggtatattcaagatagttttaatattaacttttgtgaattagaaatatcactcttaaatgatgaaaattactagtgaagtaactattttccccaattgcagaattacaatatttatacatataatacagagttgattgcattggaaacaacagtttattttacgtaaaataaacgtcaacgggtaaaaagggcatcttcacgccgcacctcagagggccatgagtccttacacccatctgcaaagtaactttccaccagcattcaactatttttaagtgcaaacaattttttaaaatctgtgattgcagcgtctgtcttcctgaattacattacgtcagaaagtaacagttttctctatgagtgcattcaaggttgtcttctgaccacctaaggtatagaaaaatcagtgcaaaaacagtgaagcactataacagctgaatttcaggggatttcttgtccaagaaacattttattttacactatgtatatatgtatatattatatatatatgaaatttaattacattgaattttagagtaaaaagcaagaaaactccatttcttattttttactgcagccccaaaagaccggtttaaaatggaaacaacttctttgggtgagcagcgggagcacggcgccgcagagtgagccggtcaccgtccacacggctatcgccgacgtccaccgcctgaggtccgccggctggcacggctcaggcgcagctcggagctcctcctcgtcactccctcgagtccaagtcccgggagactgtgcgcgcagcagtgaggtcgctacactacagttccacctggagaactggcctggcttggggatgacaatgagccctgcaaacaaagcagtctacattaatccagcaaaacaccggacgggcaacagccaccatgcgcgccctccgccagcagctccacgtggtcaaaactggtgctgttgatgtggaagccagtgtgggagcaaaccctccacttcatctatttaattcctatccagatcactgcgttccattcctagagaattggaaccctgctgggtgcaatactgtggcctcaataccgtccaagagaagggcgggcagggctggccttgcccttgggggagacagtggtttctcagcacctgagaacaggttctttggagctttgctgacccaaaggtgcaggtgcctcgtgggaggtgttcagcgccttcagccagggttgagcccagggcaccgcagttctggaccgcacacccagtccctcggagccaggggttgtctccaaggatagagttcagtggcacctttgaaagggcattctctgctggggggttcttgctttgttgggtggtgtgaccgtggcaccccctggctgtagctgtccacatgtgtaggccccacaggtagagacagcagggcccaggccgaggtcgggggagccccagaacaaagtagtcttgccgtgaggctgcagctgggtgtggagaagggatgtgggggccaacccaccagggccagcaggaagaatggtggggggcatctggctctttagggcggctcctgctgagaggctcactgtcgggggcgggg

SEQ ID NO: 78122 - DNA, 1050 bp, Homo sapiens
gagcaacaaacaccgtgtctcaaaacaaacaaacaaacaaaaaaccccaaatgtaaaaccatccttagctcacaagccacccaaaaccaggcgacaggcagatcagggtgtgagaccttggagctagagcaggaggcaggaggcgtgggcaccacagcccgcgagccctttgccgcccgcactgctcagcttgcagtcggcattcttcaggttccccctgaaggtttggcctcccccgtgggactctagtgggcagccactcccttggggtgtctgggacctggtggatgtgtcccagtcacatcttatggtcaagaaattgtattaggcaaaagcagtacaaaagagcctctttcgtttttcctaatttccataaagcagaaagcgttttatgtccaactggcctctgttctgtttcaagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaaggtagcgcggaaccagcttctctgacggcgctgctcttcgacccagcccaggccgccactgaattttgtgtctgtaatttttctttgacagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcagga

SEQ ID NO: 78123 - DNA, 1063 bp, Homo sapiens
tgaagagtggtcagggcctcttggggcccacaccgtgctgccttctggtgtatcctccccaaaatgaggatgttagcagctccacggcaggagaaagaggggctggctgtccactttgcggttgatgccaaggctacaggtagtaatccttctagaagagcctggtgtgcggcccttgtaaatggtgtgaacaggatgcattctgagatggtagagcactgtggatgtcacctggcgctggaagtacctgctgaatgtgaatctaagacctgtctgccctgaggtcacctaattccggacctctggacactcctgtttgcctaactgtggaggtgacagtttgatctgaaactgcgagtccctgggtaggcagcgcttctgattcatggagccagctctgttcctggcccagagactgtcaggctgagacagaaaagaaaaaaaaaggctcctgattacagctcaggcagaaaagaagagctagtgacaactcacacagtagacaaattggagacaaagaagccagtaggccgtgtgctctgcgggctctcagtggagctgctccattctcttctccttccccgtaggaaaacagagaagcgggctctgggcagccacagaaaagctggctttccggagcaccctgtggcaccggaaccactcagtaacagctgccagatttccaaggagggcagaaagcaggtactaagcgaaatcggagccggagactgcctagctcagccgggactggatgccctcgggtggcctgtgtctctctcaggaggacgccacctgtggaggctgtggcagaccacattgtcagtcgaggcctgaacagcatgcgagttgatggctccatgtgttgggacatcagggaccccagttctatttgctcaagccctttctgccccagtagctaagaattgatgacgaatatcccatgtgagcaggcccagagaggggatgtttgcatgaacttttgtgtctgtcctgatgaccatatgcaggtgccaggttctatgccaaagcaccgtgcagacatcgcccctcagaacggccctgg

SEQ ID NO: 78124 - DNA, 1007 bp, Homo sapiens
agcgagtcctggccagagtctatcccccttcccgggtttcggcaccagaatgttaggtcatccgagagaaaggaaaaattgacctaaagtcaggcaagcaagtttttattaacctgccaccggccgcttaacagtcagaggaagcagccccaagcttacagattgaggggtttatattggggaagggagtttgagggagttcttcggtatggtcacatcccggggttgtttgctggttaattttgccacatatcaccttgtgatgtttacggtagcagctagatgaacagcaggaacttacagaagggtgtaggtaaagtttgtttatgcttcccacgatctccccttgtgcggtccagatggtttgtaattggtgaggtctgttggctctgccctaacactgaccacagtgccccttctgcccttccagtctgcagcccctctttcctggagtaaatgaactggaccaaatctcaaaaatccacgatgtcatcggcacacccgctcagaagatcctcaccaagttcaaacagtaagtattgtgttctgagagtggatgtggacccactcccctgctaggacctgcagcagggcaagcccctccctgtgcctccctcaaacccctctcaggagctcctttggctgactacaggggttcaagttcacttgagggccagtgagtggctgctcagacagagcccatcactttaagtggtctcaaaggtgagctcttccttgagcatcacagaaagatttgtcacaggctttctgagggctggggagtcaggctgtgttccctgagtaatttaaacaggacttagaagcctttgggtggaaacgttccccaagcacagagcataggtggtgagggctttctgcagccctccacagccctgctggcgggaccgacgcctggaagaggtgttcccggactcttagggtcattctggtgaagctgaggctgggagttgggacttcccagggagggcctgtgggctgaggggcaa

SEQ ID NO: 78125 - DNA, 1096 bp, Homo sapiens
aaggtcttacttttgattcttttgattttaattctggaaaattgatgataaatcatgtgaaacaataaaaagatgatagtatgacacaaaaaagttaattgcggccaggcgcagtggctcaagcctgtaatcccagcacttcgggaggccgaggcgggcggatctcgaggtcaggagttcaagaccagcctggtcaacatagtgaaaccccgtctctactgaaaatacaaaaaaattatcagggtgtagtggtggcgggtgcctgtaattccaactactcgagaggctgaggcaggagaattgcttgaacctgggaggtggaggttgcagtgggcggagatcgtaccaatgcattccagcctgggcgacagtgctacacttcgtcccaaaaaaaaaaagaaaaagctaattgcacctagacattttacaatttaaattactttctattatttatatattcttgttaagtagagaaaaagaataattttaatttttcaaaagaaattgtaaacttaggaccaaaagtgtcaaatggtatatgtgctcatggagggaggaagtggatttccaaactgttaggtgaacatggtcattgtgcagatttaaaacttaataacttaaaacacacactttgaaaattaaaatcaagtaaaattgacatcttctggaacaggggtaaactgtgatgctgggcatgtggtatgacgtcttcaagcacggtagaaagctgcgggcaccaaggcacagccagcccaggtgctgagtacagggcagctgcaggggactgtgccagccacgctaaacggcctctcctgtgaaagaagacatgtggactgtgactgaaagcagttgaactgcttcttgaactgtgatctgtccccctttaaagtggacatctccacataaacaggaaagcctagtggaacactgggttgacgagtgactcctaacattttcataatcagtgtaggctgaaggacagcgtcctggaaggcctccgaggccggctgaggctgtcagaccatgctacttgtgtgacgattgctcagtgctgttcccactgaaaccatagcacatgcgctctgaatgttcacag

SEQ ID NO: 78126 - DNA, 1143 bp, Homo sapiens
ggaggctgaggtgggaggatggcttgagcccaggaggtcgaggctgcaatgagctgattgtaccactgcactccagcctgggcaacagagtgagaccctgtctcaaaaaaaaaaaataataataactcatttgccttaatgaatggctagttcgtagttctctccaccctcgctggaggggcgtgtgctggggatgccgtcattctgcaggctacagtggcagctgtattccttcagttagtgctgagtcacagtgaatgccttggtttatcactgtgttcacttaagtttttaaaattattagtatcatatatgacattccttcttaatgagaatatttggtaaaaattaacttgtaaaaattaccttggtcaggatagctagagcagatgagggaaatgcttttggggcctgctggaattcactaaggggcatataagaaacttctgagtaactcgttaattgtactctattttacttgtttcaaactgtttgaaaacaagaatctgatgggaaccagatagtcttgggcccggaaagtttgttctggagaagcttatggagagtggctaggcagtgctttcctttgcaagggtgtggtctccagcacttcagactactgggcccacactgttgctctgatacctcatgccagcagtaacacccccaactactggcccgggaccaggacggctccctacccctagggctgtgaatagggagtttccaggaggagacccagggaggcaaggaagggtgggcacctgaagaggactcttacctgggactgaaggcatctgagaagcacagattcctggcccgcatgcccgtttgtggctccattaggtctaggttcaggccttgaaatctgctttttttttaaattttattttattgttttttgagacagagtctcactgtgtcacccaggctggagtacagtggcacgatctcagctcactgcaagctccgcctcccaggttcacaccattctcctgcctcagcctcccaagtagctgggattgaaggcgcctgccgccacgcctggctaattttttgtatttttatagagacggggcttcaccgtgttagccaggatggtctcgatctccggacctcgtgatccgcctgcctcagcctccc

SEQ ID NO: 78127 - DNA, 1568 bp, Homo sapiens
cgccaccacacccagcttttgtatttttagtagagatggggtttcaccatgttggccaggctggtctcaaactcctaacctgaagtgatcgaccacctcgggctcccaaagtgttgggattacaggcgtgagccaccacgcctggcctcttttattgttttgcttacccaactccccaacctttttcttctttctgctgataattaattatgtattttcaagacatatctgttttcaacttctagaattttgttcaaagttgggttttgctagtatttttagttaattttatctgaaatactgatttaaaatcaaaacctttactgtttcagcaattacactgtagtatttgatgtgggagtacctaatgtttactagaaatgtttacaaatgaattaaatattggattatattttctgattaaggccagaaaatttattttaaaaacttgctttcttcttcagtgacagaaaatctggttctcttgcactaatatgtgaacttatggacatgaatatttatgagctaatacgaggtacgtagaataatttgaaagctaacctaagatcctcttttaaggcttgtaattcatatatgcttagttattctcaacatcattagtcaccatagtgctgtagttatatataatacacagtacagggtcacttcattcaccaggaggcatttttctgactgctcatctactcagaacatggctgcaaacaagaaaggaagccccaggccctctgggtgcccatgtgatctgggggagagtggcgggaggcagcaggggcagctctgctgcagagcgcctgcagccagccccgccgtgggcatgtgtgtgcaggcccgctggctcaggggcctctctgctccccagatctgctgttgctcgacattctgttccatgcctcttaaggcagagctttccctccaaaatactgccctgcatgtgagggaagctcctaccattttccaggatgctcgttcatttccttttttctgaacaataaagcactgtttaagagagcatgtttgcctgaggtgacctcagtcagggctggtttgagatacttatagaggttgcctgaggggaacaggagaaaaggagaggctggcccacactgagccaattgttcctgggggtctgactaatggttgtgttagatgtcagaacaaatgaaccttgtatatctcactaagaaagcaacatagcaagtgttacattttacaaatcacattatacctagaggacagataaaaaacaactgtcctactgtcacatgagtgactacttatgacttggaaaagaattttagtgacagcatcatagatgatttagatggtgtattatcttacaatttgagccaaactgaagatgatgtgctatggaaaatttttagattgataaactatttttgtgatggaagaagacactgatgttgaagatatatatgaagagttcaaataaaattgtttttatgaagttggatagtggaaaaagcattatatcaatatttattttatatgtgacttaaaatatgtgtgtgatagtaaattactaacaa

SEQ ID NO: 78128 - DNA, 1367 bp, Homo sapiens
taatcataagttttaatgtctacttttatgtttgttaatatgtaaaataaactaccaagtattctttcaggatcttagatgggaaaaattttaacgtatgttctagctataagaaccttgattttttaatgcagcaatgaggtatgcttaacttcagtttctaatgggagaaataaaacctgattaacttgcttgaaatatttgtgagttttaaaattgtgatcctggataataagtaactctaattttgaagttgacctaaactgtgaatgagctatccatttttacctacacgatagtattgagcaagtcaacaacctacgagagatccaagcactgaggcgcctgaatccgcacccaaacattcttatgttgcatgaagtggttttgtaagtatatttggagcttgaaaagttatctaaatttgatgaaaataatctctttttaagaaagaaaaccatggtagacattttgaatatttactttgtagctcagagagtaaccatttttacttcatcttacatcacatttttatttggaaaaatgtgcatctgattcttttttttattattattttttgagaaggagtctctctctctgtcatgcaggctggagtgcagcggcgtgatcttggctcacaacaaactccgcctccctggttcaagccatctcctgcctcagcctcccgagtagctgggatcacaggcacccacaaccacgcccagctaatttttgtatttttagtagagatggggtttcaccatgttggccaggttggtttcaaactcctgacctcaggttatccacccaccttggtctcccaaaatgctgggattacaggcatgagccactgtgcccggccagcatctgattcttaattaatgtggaaatgccttcatttaggtgactccacatcataaaagcatccgtcatgcaaacagttcatctcctggagctcagttaggctgctaaggtcttgagtgtgaattttgacctactgggaaagcactgtttgtgttatttcagggattgtacattctcattctgtccctgccagttgccatttctgaacagtctcctgtagtctttcttactgtaattgataacatttctggggatttttcatttctgttctaattatagaatagtttccataaggcttatctatcattcaaaaaggcagagcacagcttgtccctcggtgcctgcctgagcctgggaagccttcttcctgacagctctgtgctgtgcttacagacctcactgaaccagggagtcaggctacagggttttgggaccttctttgctgtgggctagaatggcactgacactctgagagggtgcacctcagtgtagaagcttcgctg

SEQ ID NO: 78129 - DNA, 1040 bp, Homo sapiens
aggagcttgaggggcctgtggggccgggcgtcgtcgccttctgccgtggctcgacaggcccgggaggctccgcatgtgggccccgaatccccctcggctgtgagaagccggtgcccctgggggaagcttgaggggttggggctaggttgggaactttggggtctcggagagccgactcgagttcccgctcaggcatattttggtgcaggtgcgtggttcttacattggagtttagggagttgactgtgattcattttattttattttaaatgctggcttgaacctgacactcttttcctgaacattcggcagaaaacgggggagcgcttacagcgtggctccctgccttttcatgatactggtttagtgaccaattgagaggaaagctgggctgtgtgctttattttattttttgggtcaagcagtagtgttttataggaaccactttttaatagtagttttgaagcaaccttttagttaaaagctgttacttcaaagttgggaaatgaggtagtcattctagaaaatgtaacgggtaaaaaattttctttagtgggatttgtggattattgacaatccaagtgcaaccagctagaatgatgtttttaaaattattattactgtacagatataattgtttatggttgtgaaccagaggtgcagtaaaaattcagacctttgctgtgaaaatattatgttaggagtagttataatgttaaatttgcattgtatcctaattgtcaatggtgtacattgcataacatttaaaataattaatctcattcaccctttacaaggcatttttatttttattttattttgttggatattgtttaatgtttacctttttcattaatgcactacaaagctgtagttagaatccaaggtctacaaaagactttacacttttacttacagtgcagactatgatactgcacatattttgtactatattcatttttttcttcccatctgtttgttttgaaaattttcagatgtacaggaaagttgcaagagcagtacattgaatatttataaac

SEQ ID NO: 78130 - DNA, 1677 bp, Homo sapiens
ccataccctgctgaatatggccacagctttttgggtttggaatccaaaaatgacatatttttcgtaaagcaaaagcaaacttattcgagcttaggcagcatgatgggattgtattttgtagctaatctaatggagacgatataaattctacctgcaataatatacctttgcagcacattcttttaatactctttcagccccagctgtgtcatggaggccacaaaggcaaaccggatgcgtactttgcccctcagtagtttatgaactaacaggagatgaaacaagacccagataacttctagtcaaggccagaaagctaaagatagtgaaaaagaactgaatgtatttagagaaagggagattgttcctggctgaggacatcagaagcagctttgttgaagaagtggtatctgaactagatttgaaagggtgcgtctgagttgaaaatgcagaaggggagaggcaggttctggggcggttgggggtgcatttcaacaaccacagcagaaggcccagtgttcgctgtgggggtggtgtggatcagcagcacagaccaatggacacacttgggtcagatcgaggcccctgtctctccccatcctccctcttccccaccccacagaaatttccagttccatccaacatgctgtgccccttttcatgcatccgtgcatttacacatggatgtgtgccctttttcacctggcaaaaattcccagccttcaaaatgcccctcagagatcacagcttctgggcagcccaccacctctgggctgttcctgcctcttgattgcacctgttgtaccatgatgacatttttcctgtctgcctcacctgtctgcattccttagggaagcttgtctgccttcagaatcatcagtggagcttttgaaagggcagatcttggggcctcaccccaggagatccgattcagcaggtctgcggggactgaggtatggcaggggaaaccgcccccatctcaagggtgaggttaggacttggctcctgtgtatgtattccacccagaaatactgagttaacattagctgaattaactaaacaaagtatcaagcataatacccacagggtaagccagtgaggatagaggataaatacattattagtctggctttgccgctgtggttatcctcaaacagtagggtttagtgtatgtatgtatatgtattatgtttttgttttggggttttgttgagacagggtctttctttctcacccaggctggactgatctcggctcactacagcctcgaactcccaggctcaaatgatcctcacacctcagcctcccgagtagctggggctacatgtatgcaccatcatgcctggctaatttaaaaatgttttgtagagacagggtcccgctatgttacccaggctggccctgaactcctggcctcaagcagtcctcccgcctcagcatcccaaagcactgcgattacaggtgtgactggcagtaaaatgaaagagatggggttcttgaaggatatgcgcagtcaatctcgttgtcatttgtttcacaagtagcccaggagtcggggactcccagggctatggtgccacctctctacaattcttcatacaaagtgttggctgacctctgctatttgtactagtataacagacagacgagagacacactccagcttgatctcagtga

SEQ ID NO: 78131 - DNA, 1131 bp, Homo sapiens
agggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcaggtaatgtttctgtctgggtatgtgtctttttatttggccgttctcggattgctataaagaaatacctgagaccaggtattttataaagaaaagagggttggctcacggttccatagactgtacaggaagcatggtgctggcatctgtttagcttctggggaggcctcgggaaacagagtcacggtgaaggcagagtgggagcaggcgcctcatatggccacagcaggaacaaggggcagggggaggtaccacacactcatttattttttttgagatggatcctcgctctgtcatccaggctggagcacagtggcctgatcttggctcactgcaacctccgcctccccagttcaagtgattctcctgcctcagcctcgcaagtagctgggatta

SEQ ID NO: 78132 - DNA, 1011 bp, Homo sapiens
cccagtgttctgtcattccagattcattccctgcgagtcttgaggtcttcagggttttctagagtgccttgttaaaatggagagccacaggccaggtgcagtggctcacgcctataatcccagcactttgggaggccgaggtgggcggatcacctgacgtcgggaattcgagaccagcctggccaacatggcaaaaccccgtctctactaaaaatacaaaaaaaactagctgggtgtggtggcgtgtgcctgtaatcccagctacttcggaggctgaggcaggagaattgcttgaacctgggaggcaggaggttgcagtgagccgagattgcaccactgcactccagcctgggtaacagagtgagactccatctcaaaaaaaaaaggagagccaccaaatggtagtaaacaggctataccaggagggtcccaagaggttaggctgagacgggtcccaggacacatccatctatggcttggctttcatgagacttcgctgtacatgccagctgagatttaacatttgaaaacaagacaggtcctggcttttattctggctctagccagaacctatcaactaggcacttaaaaaattatatatataaattttttttttgagacgggagtcgcactttgtcacccaggctggagtgcagtggcacaatctcggctcactgcaacctctgcctcctgggttcaagcaattctactgactcagcctccccagtagctgggattacaggcacccgccatcatgcccggctaatttttttttgtatttttgtagagatggggttttaccattttggtcaggctggtctgaaactcctgactgcaggtgatctgcccacctcggcctcccaaagtgctgggattacaggcatgagccactacgccagcctttttttttttttttgagatggagtcttgctctgtcacccaggctggagtgcaatggcatgatctctgctcactgcaacctctgcctcccaggctcaagcaattctcctg

SEQ ID NO: 78133 - DNA, 1102 bp, Homo sapiens
aaaaaagcacactgtcgattggctcttagagcatatttttaatacaaaatctgtctttgtgaatagagaatagggacgtattttttaaaattgctaccaatcccaaggagcaaggagcatcgatgctttgacttttctgcagggcaggtgacttggcctagctggttttgggtggtgagtgcagtgagtgggccatgacacagtacacgccatgttcacctgtttcccaaaatgtttaggtttttcccctccagtaaatgtgactgtctctccccgttctgaagaaagccatacaacgacggtttctggtggcaatgggagcgtgttccaggcgggcccgcagcttcaggcactggctaacttagaagccaggagggggtctataggtgctgctctctcatcccgggatgtcagtgggctgcctgtttatgctcagtcaggagagcctaggaggctgacccaggcacaggtggcagcgtttcctggagagaatgctttggaacactcttcagaccaggacacctgggacagcctgaggagcccgggtttctgcagccctttgtcatctggtggtggagcagagtccctgccgcctggggggcctggacatgcagaggcaggacacctcggcaaggtttgtgacttccacctgaaccaccagcagcccagccccaccagcgtcctgcctacagaggtggcagcccctccgcttgagaaaattttgtctgtggatagcgtggcagtggactgtgcctacaggactgtgcccaagccagggcctcagcctggcccacatggatcactattgactgaagggtgtctcagaagcctttcgggggacttgaaccggttcccctgtgggatggaggtgcactctggccagagagaactggagagcgtggttgctgtcggcgaagccatggcttttgaaatttccaatgggagccatgagttactgtctcagggacagaagcagatttttattcagacttccgatgggcttatcttgtcccctccaggtacaatagtgtctcaggaggaggacattgtcacagtgactgatgcagaggggcgtgcctgcggatgggcccgctagaaggag

SEQ ID NO: 78134 - DNA, 1048 bp, Homo sapiens
gttttttaattaaaacaaaaaacaaaagaaaaacctcaacaaaccaaaaaaactcctttcttcctttccccccctcaaaatgagagatatctgcttccacagaggaggtggaattcactctgcccattggttttagaggcctaataacagcagcttgcttcacgggtctctatgtttcatatactctgctgataaccaggtaattaaagccaagaagaaatgtttaagatgcctctgtctcctttcctcccgatacttttgcattgaatttgaaagccttgtcagcttcttaaagtaccagatgtaaacgatactaaatgcccttaataacctttaccctcctgaaaatcaactgagaaggaactacttacagaaatgggttgtaggccacgtgtggaacagagggggtcgtttactctcctccccataatggtagttttctagttcacaaattcccttggtagttgaagacagcttttccattttcacctgtattttggtctgaaagatatccatttggaatatgataatattatttgaaatctccagtctcagatttaataactctaagatttcaaagctaagaagtgtaagtctattatgataaaaattccaataactaaacactgttaactctacgtacagcaaattcccagggagatgaaggtggacagttgctatgatttcattaatttgaatgactttggtaataaaccccagatttccagtcctagagcaagaaaggtttccgagtgccatttcactaggatttccaaacagcattaatgtcttagacccaaagacctggaggaatcccaaggcaggctcttgctgcctttttttttttttctttttttttttgcgacagggtctcattctgtgtggcatgatcatgccttatgcagcctcaaccgctggcacctcagcctcccaagtagctgggatcacaggtgtgcaccaccacacccagctaattttttttaatttgtggagacagggtctcgttatgttgcccaggctggtctctaactcctgggctccagcaatc

SEQ ID NO: 78135 - DNA, 1053 bp, Homo sapiens
atcagcttttcttagaatcaggtggcaccagggagctgctgcaggactcacaggaaagagcagaggattgggtgttaaaacttggtgtcggctgggcgcggtggctcacgcctggaatcccaacactttgggaggctgaggtgggcggatcacaaggtcaggagatcgagaccatcctggctaacacagtgaaaccccagctctgctaaaagtaccaaaaaaattagccaggcacagtggcgggcgcctgtagtcccagctacttgggaggctgaggcaggagaatggcatgaacccgggaggcggaggttgcagtgagcggagatcgcgccactgcactccagcctgggtgacaaagcgagactctgtctcaaaaaaaacaaaaacaaaaacaaaaacaaaaaaacttggtgtcagaaggcatggtatcgagttctggcctcatccttcctcagctcaaccttaagcaatttcccagctgtgaaacggaaatgacaagtcctgcctcttggggttgggccaaataaaatatcaaaccttaaaagatttgggaaactacttaagtaaagtcctttaaaaattaacgttagctgaatttagtgcttgccacttccaatgtaattggagggtggttggaaggaccaagtaaaggaattaagatatttgacaatttatatatcttttcttatttcccctttttcatatttatgtatgtaaagtcaactatacttaggagttcaaaatttggtctttatagacctatgctacttaaatctgaaatcctagttacttcacccattaattttctttatccaacccttatatatctccaagtaggtgcttcacaaatactaactcacttaatcctcttcaccaagctgtgaaagtaagcccgccattgcccctattctgtgctgcctggtgtgtgcagtggggttggtttagtgtctcccacaagtagccatacacatcatgcagttacagggcttaggacagagcctggtccacactgagggaccgtcaatggcagcttgccacgtttccttcctttct

SEQ ID NO: 78136 - DNA, 1055 bp, Homo sapiens
ggctgcaggactttgtgttttctcacacccagctataatgtaccttgataaacctctgaccttatttttgttgttgttgttgttaacctgacttacgtcccatattggtggttatttggccatcgtgtgccagcactgtgccaggctggctctagggatgctgtggtgaaccagacagacccttcctgaggtcactgcctcagaaagatcatggtctggcccatgaactttaaaagggagaactaagtgcaggtgtaggggacacacaaattgaattttcaggactgccttggaaaaccagtggtggggaagatggaatgaggataaccctcttctgaaggagtgactaggaagtagcttttgttaggcatcagctatattatacccacgtgtctttttcaatagaagactggcatctactggatttttttttccaattttttcttaaagaagttacacttaagtttggggagaatttcatttcatattagccgctgtaggagttgaaaaaaatggctactggaacttagtgggaagaaaaggaaggaaacaggcatcaggcagaggcagttgattgaacttgggaagatgaggaatagatcaggaaagggttataatgaaaagctttggtgtcaagcacgaagagatttctagattcagtaatgcacagagagatcagtaaaattagaagggagtagttgatggctttgcgaattgctaaggtagaagggagctgttactcaagatgcatgttcaatttaaaatgaatgtattctttggacctggacataagagttctattgactttttgccactattttatatttagggctgtcatacttgggtgaatctagcacagtgctttgagagagagattcattcaacaaacgtgtattgagcattgattgtaccatactctttattggtcttttaaagcaccacaaagtatacagactagaagaacataggtgaagatgagaaagagtccattgaaggggagagaaaacagataatgatggtgctgtgcgataactgccatcatggagttctgtgaa

SEQ ID NO: 78137 - DNA, 1162 bp, Homo sapiens
tcaccatctcattaacacagccagcatatctgcatctgagattggcccactattctcctaatagagtgtctttcctgtttctcttttccatatcctgtccaacctggtgggcttcatagttcaggatgtgttcagtgaagccatgtctacactcactctaatccccactgatctctctctcctcatgaaaacccacaaattatcacctcattacttgtggatttgtgtcttttcactatttcatctgcctccctgtctagatcataagctacttgggagtaagaactgttttgttttttgtattctttccactcctccatggcattcactacaacataaatcatagaggtcagaacatactgaagtgcattttgagttaaaatgctcaaaagtgatcttagtgacacgtgtttactttccctgtttatttaagctccagctataatgtttacctgcctaaaagttccatgttgccagtattaaacatacttctttttgccatgactaggcattgaaaggattgtaatgctttgttctgtagcccccaggtttccctagatgacaaataaacattccttttcctgcgtgaagatagtctgtggaaaccttggccatggcatcgatatcagagcctgttacattcagagagttctgcccgttgtactatctcctcaatgccattccgacaaagatccagaagggtttccgctctatcgtggtctatctcacggccctcgacaccaacggggactacatcgcggtgggcagcagcatcggcatgctctatctgtactgccggcacctcaaccagatgaggaagtacaactttgaggtgagccttgctttgcttttcacctgagggggcacgagccatagctgacgcttaacatgcttgtgttctaggatgagataatttacttctgatttgccagaatatggccttaatacctcacccaaacaatactttaaaaccatctttagctgaagtggaatataactaaaaacattggtgtttttaactttttcctgcctccaaaaatctaacatcactttatttatttatttgagacagcgtctcgctctgttgtccagcctagagtgcagtgggacaatcatagctcattgtagcctcaaactcctggggtcaagtgatccttttgct

SEQ ID NO: 78138 - DNA, 1015 bp, Homo sapiens
gctttgcttggaaagagaataaattcaaactctgatgctgaatggggcaggcttatgatgacacattcttcggaaagattcttttttattcgttccaatcaatgcttgagataagacagatttccttgccagctccatttgccagcaaatcaatttttccctagcttactccttcacttagggttaggtccttgggattctggcttggcagagaatatcagctccagctccccatcatctactccgctctgaaaaccaaggctccagaggtgtgccagatagttacagggtagcctgtagcttcagggctagcttctgttttagtttgggggcattcttcttggttttggggtcctgtggattttccatactttcttgaaaattcagctgtgcatttgaaaggctttgttatatattgcactcagcattgccaggtgtttggagaggggtgttttgggatagctaggctattgtattgtgcaaaattaaagcctcatattctatttctatatgaactgtagttaagtgttaataatctgatgtctgggatgttttgattcttacatcaataactatgacatttattaataatcatattaaataacattaactcaagctcattggttacattacaaaggacactgatacattacaaagcacacatacaagcactgcacaccagtattgaggcttccagccccctctacatgatcatttatttatttatttatttttgagacggagtctcactctgttgcccagactggagtgcagtggcatgatcttggctcactgcaacctccgcctcccaggctcaagcgattctcctgcctcagcctcccaagtagctgagattacaggtgcgcaccactaccacctggctaatttttgtacttttagtagagatggggtttctccatgtgggccaggctggtatcgaactcctgacttcaaatgatccacccgcctcggcctcccaaagtgctgggattataggcatgagccaccgcgcctg

SEQ ID NO: 78139 - DNA, 1049 bp, Homo sapiens
ggatcactggagtccaggagtttgagaccagcctaggcaacatagcaagatcctgtctctacaaaaaataaaaaattagctgggtgtggtggcacacacttgtattcccagctacttgtaggggctgaggtgggaggatcacttgagcctgagaggtcaaggctgcagtgagccatgatcgggccactgcactcagcctgggtgacagagcgagaccctgtctcaaaacaaaccaaaaaacaaattagttaacctgtctggagctcagtcccatatttgtaaaatgtggctaactacagcaccttcccttatagaaagctgtttgaggatccagttatgcatttaaagggcttaacacattacctggcacaggaaaacaaagacaagctgctgtcctgttttctttgttgctgccatccttctcacaaggtctcgacggagtctgtcttcatcacgatttcactgccctcatgcctgttctgtttaccccttttctagactgggcccttacttaccttagcctgagctattgtgaaacactcccagcggcttcctgacttgccccactccctccttccgccgtcctgtcctgctcctaatcgtgtttgtcagaaatgcctctgactgatacactggcaaaatcagaaatcttcaagggatccccctttttcttgctgtagcttaagatctaaatctcttaacctagatcacgatctgacactagatatatttatagtccatgaaaataccctgaaagctttcaagtaccagatgaaagtgagctccttcattaccacctcaactcactgtaggcggcttttcatgtgcaacagctaagctttaagagggctgggactgtgacctactttattttgtattgttatagcagctcacttggtacccagagcaaggaggtatatttgtttcttgcatatttggcaggttgattactatataaattactctattgaagattaaaatggtttactgaagatgtcgccatatatcttagcaaggtcaaaacagttgtgtaatttttctgaatgaat

SEQ ID NO: 78140 - DNA, 1022 bp, Homo sapiens
aaaaaaaatgctcagagaagcttaacactgtgctgtttataattggagaacatttttgtgctgggttggacacttggcataaagtacatgtgggtcatttcatttttgcttaatattctcaaggtatgctctctgtgggttttgaaggtgactagacagatggaactttgtgcagggttctgcttggaaaacgagattgggaaaaccagctcttccctaactaggagtgattgtataccttttccatgtagccccagctcacagcatttatcctttttttttcttgtgtatatttttatcccttgttcatagcttcggagatttgatgtcactggtattcacaaaaatagcattacagctctggcttggagccccaatggaatgaaattgttctctggagatgacaaaggcaaaattgtttattcttctctggatctagaccaggtaaaattattttcagaaatactgttggctcttaccttcttacatttggaaaaactatatttataacttgtatttttagtcaacttgtattcttgatcatcatccctttataatctcaattgttatttgtaacatttacttttatagacttatgttttataagcttccacttctatgactaaggagttggcctactggaacattcacttttttcattccactgttgtgtattacttttacttgaaaaagaagctattatcattcctacttccttgaaaggttagtaggagtgatgccaagcacttctgaatcctaactgtggacaagtcagtgatttcaatggatggaggactctgccagccacctggcctgtgtgagatgacctcatgtgacaggaagtggcagaggaggttaggtggcagtatggtgaagatgaagaaactggagtgccaagagatccaggaactagtccaggggtgcaggcttgcacctcacagagcttgctttcaaactgtgcttctgcttcgacgcccgtgccttttccactgcacgtatggcttgatgatctgctgggtttt

SEQ ID NO: 78141 - DNA, 1046 bp, Homo sapiens
atggtttgttgttgttgtttttgaagcagagtcttgctctgtcacccaggttggagtacagtagtggcactatctcagctcactgcaaactctgcctcccaggttcaagcgattctcctgcctcagcctcccgagtagctgggactacaggcatgcgccaccatgcctggctaatttttgtatttttagtagaggcatggtttcaccatgttggccaggctagtctcaaactcttgacctcagatgatctgccgtcttggcctcccaaagtgctgagattgcaggcatgatgcatccagcctgaatacaatgttatgtgatgcgtgactgtatctgccactcatggttgttgtaaggattagacacgagagtgggatcaagtgccaggcacagtgcaggctgtgtgagtactcagtgaatggttccctgtgtgctaatggggcacacacctgtgagggtgtggtcgggcctctgttggtacagggatgacagtgtggtttgacaaaaaacaaacagtagaaagggtgaaaaatcaattattgtcttagccaaaaaattcttgttgtacttaatattaagggttgacaactgcattactttaaatcagtccatgtctgttttttgttctttctttctttcttctaattttagtactgggaaatttggtgcttgttttataccaggactctgtaagcaaagtgatctaaccttgtatgcgtcacggcccgggctccggctatggaaggctgatgtccacgggactgttcaagccacgtttatcttaaaagatgcttttgccgggggagtcaagccttttgaactgcacccgcgtctggaatcccccaacagtggaagttgcagcttacctgagaggcacctggggcttgtttcatgtttctttcaagaaggctgggtgctgagttggaatgaatatagtatctatctcctagacacagtcaaccaggtaagtgaagggacgccaccatatcttctgtgtctataggcaagagaatgtatctctataaactgttctactcagggacctc

SEQ ID NO: 78142 - DNA, 1040 bp, Homo sapiens
tgcaccactgcactccagcctggatgacagagtgagacctcatctcaaaaacaaaaccaaaaacttaccattattttgctaaactattgcaactttatttgaacttggaggatttggagggtttcctctgattctttttttttttttttgagatggagtttcgctcttgttgcccaggctagagtgcaatgaggcgatctcagctcaccgcaacctctgcctcccaggttcaagctattctcctgcctcagcctcctgagtagctgggattacaggcatgcgccattatgccaggctaattttgtatttttagtagagacagggtttctccatgttggtcaggcaggtctcaaactcccgacctcaggcgatccgcctgcctccgcctcccaaagtgctgggattaaaggcgtgagccactgtgcccggccgctcctctgattgttaaaatagcatttacagtacatttcttgaaagtcacctactttaaggcttacatcagatagtctcacatttagtggagttgctttcatggttgtggaagatggggagattgagaaaggaggaaggaaaaatcagaaaccactttactgatccctgctctccgtctgagacagtatgtgggattaatgctccaaaagacatagatttgcatagagttttagaatatttaaatctgtcatctgggacataccgtttacccttaactcagttcttccttgtaggatttatttttctctgtgcttttgacattttttggtaattcatacaagcccaaattttaatgagcaaagaatcctaatatgtgtcctcttgcggacatccacatgctttatatatttgggttcctcggggaacttgttcctcatggtggcaacaacagccatgtggaccccatcaccctcctcctcactaccattacctctgatgtcagagagggcaaattggggtgaatattccaaaacataatttgtataagaagtgaataagctctgactcttgagtttatgagctgggggcccctcagacagtgtcatcaa

SEQ ID NO: 78143 - DNA, 1025 bp, Homo sapiens
acccaggctggtctcgaactcctgagctcaggcagtcctcccaccttagcctcccaaagtgatgggattacaggcatgagccaccgcgcccagcctaaattttgttcaattttgatcaatttgaatttcaatacttacaagtagctggtggctgcctattggacagggagctctaggcaagatctgccattaagttatgtaatcttcagcaagtcgcttcacagcagagtcctcccctccagtctccagtgtacacttcattgcctgcagtctgcccctaacacatgccctcaatagaatgtgggtgcttcaagggcaggaattcctgtgtcttatggactgccatgtcccagcagctagccctgtgtctggcacacggaggatccccgataaagagaggatggcgaatggatcaaagtgggctgtggtcttgtgttgagggtactgtagctggaactgctctggccttgtgccctgtggtgtcgtgttgcagaaaagatgagtccactgcagtgggaagctcactggcccttgggcttggggacaggagacaggtactcacatgcctgttctcactctgcggtctactggccttgatgctgtgtggtaatggacttctctgtcttgagtttgttctaatggaaaattacctttccctcttccaggaaacttaattacaggtacacatgtatttttcaaatgccctttgagtaatcttaaagtatattcaaggcagagtcttagtatgaagtataactaagctgttttgttatacacaggcatctctcatttgtaaataatttgtaaattgaagcgagaaatgctgtattcttagtatttttttacttttttttttttttttttgagacaggtttcactctgtcgtgcaggctggagtgcagtggcatgatctcagctcactgcaacctccacctcccaggctcaaatgattctcccacctcagcctcccaagtagctgggactatgggcgtgcaccaccacaccctgctaaattttgagactcc

SEQ ID NO: 78144 - DNA, 2631 bp, Homo sapiens
ttacaggtgcccactaccacgcccagctaagtttttgtatttttagtagaggcaggggtttaccatgttggacaggctggtcttgaactcctgacctaaggtggcccacccgcctcggcctcccaaagtgctaggatggcttatgagcgtgaaccaccgtgcacagcccagatttcattctttgttatggctgtgtaacactgaatttttcaaaccttttactccttggttcctgttaatcctctctagctaagatgactgcaacactgaaggaaatgttattagatttctaagcattttaataattataaggaattggtttgtgacccaggtgaacatctcagtttgtcccctggtttttcttagctgccctcaaacccatggatttgttcagtacttgcatgcatagaaagcatctctttgttgggattatttgtacttaagaggtttattcttcattcaccaaatatcctttatttaaaattttttttcttgagccaaaaatatgtgtgcaagttagtctcttactaatcatatagaaccgtgccttattttgaatgttcttattctgaattagaaggtggaagcaggagcacctgtcacagctccctggaatcgacaccctgctccgaatttcctggggacagtccccagtccttgaacacagacttgctgtcgatgacctcaagtgtcctgggcagtagcgtggatcagttaagtgcagagtctccagaccaggaaagcagcttcaatggtgaagtgaacggtgtcccacaggaaaatactgaccccgaaacgtttaatgtcctggaggtgtcaggatcaatgcctgattctctggctgaggaagatgacattagaactgaaatgccacactgtcaccatgcacatgggcgggagctgctcaatggagcgagggaagatgtgggaggcagtgatgtcacgggactcggagatgagccgtgtcctgcagatgatggaccaaatagcacacagttacccttccaagaacaggacagctctcctggggcgcatgatggggaagacatccaacccattggcccccaaagcactttttgtgaagtccccctcctgaactcactcactgtgccttccagcctcagctgggccccaagtgctgaacagtggctgcctgggaccagagctgatgaaggcagccccgtggagcccagccaagagcaggacatcctaaccagcatggaggcctctggccacctcagcacaaatctctggcatgctgtcactgatgatgacacaggtcagaaagaaatacccatttctgaacgtgtcttggggagtgtgggaggacagctgactccggtctctgccttggcagccagcactcacaagccctggcttgagcagcctccacgggatcagacattgacgtccagcgatgaggaggacatctatgcccacgggcttccttcttcatcctcagagacgagtgtgacagagctcggacctagttgctcccagcaggacctgagccggctgggtgcagaggacgccgggctgctcaagccagatcaggtatgtgggttcgggtggtgggaaaagtagctgaggcttctttcttaagggtaataattgtcaagactgattattttccttctcatggaaagaaattctattcctactgcaaaatccgtaggccaactctgttttcaagtctgggtttcaggggatttccagcacagggactatgaatggcttgaactacttctgacctgttctaccctgctcagtaacctgcctccccaaccaaggtagcgtcttgctgtttcctctgaccccacaagtgcaggctggtgtaggcacttactgttagccatcgtagggcagggctgaattggcctggggccatctcagaaaaccagtgggcagaggactgtccacctgtggagtagagaaagctctgagcagtttggaggcagggagtctcctgtccttctcctcacacccctccaaggaaccatctgcaagagcacgaggccatttccagaactgctgtctcctcaacctccgaacagtggctccaaggctcccctgcgagctgtacaggaaccagtttggagtaaccagtctttgtaggtccacccagcacatgtaactaggagatgacttttaactgtccttgagcattttatattaaaagtgatttttttaaaagtgcctacttcccttagcaagtaattattactagatatatttgtttcaaaactgtgtcttgccctgtctcctactaactgtcgatgtgaggtatgaattatggctgcgcacttacagccacgtgtgctttccacagtctacgctggcttctgtcagtgctagcagtgtgacgctttgtcagtgctcaccatgtgcaggtatcccacaaagcactttagaggtttaactcttttacttctctaaacacgaactataaaataggcactcttcttgtccccattttacagaggagaaaatggaagcacagaacagctagacagcttgcacaaggtcacatagcaaatgaagggcgggccccaggaccccctcactcaccctctgtgctgtcatgcctcagaagtgaaacatgctgcttacttgttttgagacaaaacgcca

SEQ ID NO: 78145 - DNA, 1063 bp, Homo sapiens
cagacatcttagtacagggctcccctgcagcagctctgggctcacgctgccgtgcgttcaccaggtttgcctcttcaggaacgtttgaggggttgtctccaaagaacgtgaattgcttcattggatgtcaattcgtagtgtaaatgggtgttcagtttgagtttttgttttctttattaattgcaatggtaagctctgatcgtatttttgtaagctagacaaaaagtttgaaaattgagggacttttttagggatattaatatactaactcttcataaaaataatacgtgtttctctttctcattgttgctttaaagcaaccgaactaacgaagacgggcctatggatatgttagatatattccaattatttggcttcctctttaggaattctgttttaatgagctctctgctgtgggtgaacagtctactccctgactctaaaaggaaagtccattcattctttcatgctgctgttaggccattgttagtgaactggagctggtgtttcctgaacgatgttctcctgagctggaagacctcccatatctgcatggaatcatttgcttgctttttctttctttctttcttttttttttttttttgagacagagtcttgctgtgttgcccaggctggagtgcagtggtacaatctcagctcactgcgagctccacctcccaggttcgcactattctcctgcctcagcctccccagtagctgggactacaggcacccgccaccacgcccagctaatttttttgtatttttttagtggacacggggtttcactgtggtagccaggatggtcttgatctcctgacctcatgatccgcccgcctcagcctcccaaaatgctgggattacaggtgagagccactacgcccggctttgcttgttttttcttaaggttgtgttggccacgtcggcacctacgccagtggggacacttttgccttgaagcagcctggtttactgtcaggacattggaatagaagtcagacgaagccgaagctgagtctgtggcttgggacctgtctgttctctgtaacttcactgtgtttcg

SEQ ID NO: 78146 - DNA, 2545 bp, Homo sapiens
gagtagagagatggaggcactcaggggccttggattggcgggggaaggagtagagagatggaggcactcaggggccttggattggtaggggaaggagtagagagatggaggcgctcaggggccttggattccttttgtgcctactcgcttttttcttaggttattttctctcttaagagtgttcccagccattctgggtcatcagtgtgtctttcaaaagctgccacccacttgaaccatatctcttgcacagtaatttaactcagacccaaacttccttccctggcacctgctgatccgctccagggccacgtctcttctcccagccacgcctgccgggagaccctggatgtccgcagtccagacacactgggcactctgcctatgggtgctgacccccctgttctcctccttattttcagcgaaaggcaagctttagaacccgtctgcataacgctcggggatcagcagactctctgggccctggacatccatgggaacctgtggttcagaactggcattatttccaagaagccccaaggagatgacgaccattggtggcaagtaggtgttcagctctgcgccacgtgccgaggtctcccgaccttttctgcttccccttttcttacttctctcttttccttaacgatactagattaaatttaaaatactcacttttttattatttgtttgtttgttttgaaacaagatctccttccgtcatccaggcggaagggcagtggtgcagtcacggctcactgcagtcttgacttcctgggctcaggtgattctcccacctcagcctcccaggtagctgggactacaggcgtgtgccaccatgcctggctagttttttgtatttgtttgtagagacagggttttggcatgttgtgcaggctggtctcaaactcctgagctcaagagatccacccagactgggcagagtggctcacacctgtaatcccagcaatttgagaggccaaggcaggcagatcactcgagtccaggagttcaaagccagcctgggcaacatggtgaaaccctgtctctaccaaaaatacaaaaattagttggacatggtggcacacgccgttggtcccaactactcggaaggctgaggtgggagaatagtttgagcccaggagacaaaggtttcagccaagatcacaccaccacactccaacctgggcaacagagctagaccctgtctcaaaataaataaaaataaaaaagagagagagagagaaatccaccctctccgcctcccaaagtgctgggattacaagtggagccaccactcccagccaatagtattccttttttctatttgatggattagactttgctgtgtttgagtgcattagaaacataaaggacttttcatcataggaaataatttgcaaactctttgtgtaaataatgcacttaatttatttattttgatattgtttatatatttattattataggctaaataaacccagtgacatccatttgaagacctaggtaataatgatgtttaattatgaacaaatgtgctgagaaaagagcccagataataggtttgaaagcccaacccagaattaaaattgagctgtctctgcttattcagaaggcctctaagtagatggtatttcagcaaagacaggagaattttcccacgtgcttccagaaaaggaaacactataagaaacaggatgagggtataatcaagctcactgtgtgtgatttggtcccagcaagagcgcctagaatgaatttctcttttctttttcttttctttttttctggggcagagtctcactcttttgcccacactggagtgtggtggcaggatcacgacccacctcagcctcccaagtagctgggaccacaggcacatgccaccatgcctggctaattattttggtagagacaaggtcttgctgttacccaggctggtctcgaactccttggctcaagcaatcctcccaccttgacctcccaaagcgctgggattacaggtgtgaaccaccaccctcggccctagaatggattttcaaaggagtgtctactttccccttctttggtatagtttagtgttagtgttgctcccacagtctcccactgtggtaggtaagatttcactgatagtcgatggtcgtgaaatatttgatgtttcttttttttgagacggagtcttgctctgtcacccagtctggagtacaatggcgcaatctcggctcactgcaacctccgcctcctgggttcaagcgattctcctgcctcagcctcctgggtagctgggactacaggcacgcaccaccaggcccagctaatttgtgtatttttggtagagacagggtttcaccatgttggccaggttggtctcaatgtcttgaccttgtgatctgcctgcctcagcctcccaaagtgctgggattataggcgtgaaccaccgcgcccggccagtatttgatgtttctgaagtatcttgccccattggtttatgttttattgtcacctcagacttgctttgttgaaggcttgtcttgcattgactgct

SEQ ID NO: 78147 - DNA, 1265 bp, Homo sapiens
ctacaccgctcctgcccgtgtgggaatgggcaggtgagtgagctggcatctgtggccaggtggctagcgtctgctgaaaggcaaaggctgccttgtgcatttagggcaggcggcttggtgcagacaacacctcgatgacaaacatgacccctttctgcaggaagcttcctgtggctgtgccagagcagcaaggacctgtgcagcgtcagcgcccagagcgcacagtcgcggccctccacggtgcagctgcctcccgaagccgagatgcgcgcctatgccgcctgccaggatgcgctgtgggcgctggacagcctcggccaggtgttcatcaggacgctctccaagagctgccccacgggcatgcactggaccaggctggacctctcccagctaggtacggccacctcgtgagtacacctgccggtgccctgactgccctaaaccggcatcacaacgtgatgtcggacaaaactgcccggcctgtgtccaacctgtgagagttctgagggggtgtttataagctgctgaatttcaggagctcagttggccactctttcagactagacaggctctgggttttgtcccttcccctgccccttagagtttgcagggctgtcagaacccgaggagggtgtgcgtcctcaggtcaaggggccactcgctgcgagcggcttgaaggatactggtgatgcagctgccccgtcagtctttctgaatatggaacatagctttatgacctgaaaagctgaaaagatgggtgttccctatgacaggatcagtgccacgtttgtctatctcctcaggacagtacctggcggaggagagtggctcagcacacaggtgctagctctccttcagctcagccagatataggaggacctgcatccactagctcctgcttttctctgaatcttctatcaaaagccgtggagtaggctaagaaatgtagtgctatttgtaggccgggcgcagtggctcacacttgtcatcccagcactttaggaggctgaggtgggtggatcacctgagatcaagagttcgagaccagcctggccaacatggtgacaccctgtctctactaaaaatacaaaaaaaaattaggtgggcgtggcagtgcacgcctgtagtctcagctactcaggaggctgaggcaggagaattgcttgaacccgggaggcgggggttgcagtgagccgagatcatgccattgcactccagcccaggcaacagagcgagattctgtttcaaaaaaaaaaaaagaagaa

SEQ ID NO: 78148 - DNA, 1091 bp, Homo sapiens
ctgggtgacagagcaagactctgtctcaaaaaaaaaaaattaaattttaatttcaaggatgaggatgactttagcgaagtatcaaataatgaacatgatttctacctttaatttttttttttttttgagacggagtctcgctctgtcgcccaggctggagtgcagtggcacgatctccgctcactgcaagctccacctcccagcttcacgccatcctcctgcctcagcctcctgagtagctgggactacaggcacccactgccatgcccagctaatttttttgtatttttagtagagatggggcttcaccgtgttagccaggatggtctcgatctcctgatcttgtgatccacccgcctcagcctcccaaagtgctgggattacaggtgtgagccactgcgcccagcctcaattttttttttttaaatacagcttccctcttctttctacccctatacaaattaccagagcaattactgctataggattaaattaaaggaattcttaaattaaatggttggctgctgaaccaagttgtagcagttgaatatggaattttgtagtgatttattataatcctagtttttggaagaaaatttgcatcacttagcagatatttaagatgcttgtaacatttcatttcccagtacacataaatatgcattatgtcaggcattggaatgtttagcaaactaatgaaatttgtaatttaatttatcaggtcacagcatttaatgaagaactattcagtgtcagtttatgccgttaggtaacaaacaggattgtgttacgcagtaatttatacagaaaagtattttataaataaaatgtcaaataaatgccactttttgttttaaaatgatatgtttaagaaataatcctaaagggaaaatgtctgctttgtcgaataaagtaattaaagcatttttttaaaacaagagaaaaaaataaggacaaagcagggacagacaggaaaatgtcagtgtgtttgcatcagccaggctgggctgtgcttcggtagcaagccccagatatcagcgacttcacacagtgaaccgtggcccccgctccacgaagctggccctgcatct

SEQ ID NO: 78149 - DNA, 1599 bp, Homo sapiens
gtttaattctaattaagatcaagattatctgtaaatacgagttccctctctccaaatctagaatttgctggcattagtcacatgtctgaggaagctgacgatgggacccacattgagatactaatcccagggctcggtggttcagggcactgtactgacagcatcttgactgctttgcctgttgcctggaaggggtgccgtgtggcgcctggcaggtggcagagtggccagaggccattattactctcttgagttacggtgttctcaagcccagctgagtccacacagccgatgtggatggactaggacagatccgatgacttagtgtccaagttcaattgcaaatgcagcctcatttctttctttgaagtagaaaatcaaagttcatagattagatgaaagaatagtcattgtacaaaagtaattatagtgtgtgtacttttctttatctacaggagctgtaaaattgacaagcttggcatgtggaaatcagcacatctgggcctgtgattccaggggtggagtttacttccgtgtagggactcagcctctcaatcccagtctcatgcttccagcctggataatgattgagccacctgtccaggtaagcagaagttagctggtggaactcactcttcagtaagacagaaactgtgaggatgctggtactgggaaaaaggatctgcacagcctctagaggcctcccagcaaatgcggggagccatgcccccagggtctacacactctcgttcatcaacatcacaactggaattcgggatttgtgaagtttagagctgaacagactgttacagattatgagtcaacacgtatattttctctttcaaaataataatatttcgtttttgactttttactaagtgaatattattttttaaatctgcctatatattggaacctctattttataataataatgataataaatcagtacccagaagtataaagaaggtaaaagttactttgaatcttgtcatggagaaaatgctgagtgcctctcctggtttgttgaagaaattccgtttcctgtccagcccactgctggccagctcctgccatgtttcagctgaccgtgcatcccaacacagagtctgtgttctcctgacctccagcactcagctcacaaggagaagtctgatttgaatgtactatctagttacccttaaagatcccacaggcttggttcctgtgctgaatagatttctgttgaagtttataactgggggctgtggttttttgagacttatttgcccagactcctgccagcccccatttggtgactctgttgggaaacaggtgaagttgccaattgtggaggcagcagtggggcaggggggatggttcgttgttgggcagagaaaccttcagtggagtcaggaaagaggtaaagagtagggtaaatgcctttgtgcataactgtctacattttggtcatggtgaggcctcagggatgaggacaccagtggtgtccaccagccctggggagtgtggtggtgggagaacctttactgaaatcagcattcggctccagagctctgtggaggccaccactagcggtcatggccacagggaggcttctcg

SEQ ID NO: 78150 - DNA, 1384 bp, Homo sapiens
catcctgcgcaccttgcgcgacttcccggccgaggagcgggcgcgcgtgctggaccggcgtggctgcagccgcgtggagggcggtggcacgtcgctgcacgtggcctgtgagctggcgcgccccgagtgcctcttcctgctgctgggccacggcgcctcgcccggtctgcgggacggcggcggcctcacgcctctcgagctgctgctgcgccagctgggccgcgacgccggggccactccctccgccgccggagcccccgcctcagctcccggggagccgcgccagcgccgcctgctgctgctggacctcctggcgctgtacacccccgtgggtgccgccggctcggcccgccaggagctgctgggcgaccggccgcgctggcagcggctgctgggtgaggacaagttccagtggctggcgggcctggcgccgccctcgctcttcgcgcgcgccatgcaggtgctggtcaccgccatctctccaggccgcttccccgaggccctggacgagctgccgctgcccccattcctgcagccgttggacctcactggcaaaggctaggcccggagcaccctaggcgctggattttgggacaaaactatttttcagagcgttgtaccggcactttatatatattgatctctgtacggcacaatctctgcctcatctgtcgcatgcactgggggctgggcttggatggtcaggtgagttccaagtggcaggttttctgggtgcagctgggctcgggccttcagctcgctgtccagcccctgaagggagtgaggactaacctcccaccttgatctagagcctcggacaggtgtgcgtcccagatgggtgacagctgagtgccgcaggagctcggtaggtgcaggggtggggactggcatgtccaagcagcaggacagcgtataaaaaggcctggaagccaagagaacgagctctgcagcgtagggttctcacgggaggtcctgtgcggtcagccttttgcaccctgtggactccgggccagggagggcacacagggctggcaggcccgcggtggctggtgttgaggcatgaacaaattgtaccgggtatcccccaccccactctgaccaccagttcctccttggatatcactccccctgacaggcagcccacccaggcctggatttgtccctgtctcccccttttgcttttcccccatgactaatgggcaccaggtcttgctgctcctgcttctcacctctgcagtggcagcaggcccctggccccaggtgcatgccggtcagtggggttggatgtgccttcctccaggcctgccctctgtccaagcccggagtgggcttggtgggctccctggtggcccccagtgggtgccaggtggtgcccggggttatt

SEQ ID NO: 78151 - DNA, 1041 bp, Homo sapiens
tttctttttgtgcgttcgccctgccgtccgtggggagaacagcagggcgaggacgaggaggcgcacacgcacacgagtgttctgcaaacgtgcctctgcacccgggggaggccaggtcgcccccagcagggccggcgccgctgcccccttgcgcctccgaggactgcgggtggcgtcggaggtggccacacctggcctgggggcgctgggggtccctgcgtccaggtgagctgcgcctcggccaggggtaagggtggcagtgccggagagttagtgtcctgcgagcgccccggacttaggaggtccccagagacccctttctcggaacccttcccaaaggctgctccccacgcctttgctcctcctctcagcctctgggctcttgctggctcctgactgccctcccatccagaaggcgagtagaagaacgaccccccaaaaccagtcaataaaagaagtgtgttttccagagggcgcctgcctggggaagagagtctcgcgtgtggcagttggattttaggacctatttgtaaatgtgtgtatttccttttttttggaggaagagattgtgaaattgagaagcatcagaagctttagcctaacaaatgcttttcacctacaagaaagccctacaccctagaatggaacacttagttccctggctgctattctgtgtagaagcaaatttaaagtggtacaagaaaaaaaatccgatcagacaaaggaattcgtcagattttaatgcatgagattctagccagtgtctgtatgagactgtctttaaaggttgttggtatggaaaatgtttgaaagaacgtaggatttatttcagaaataaaattcaaaagagcatcttgtaaagctggagttaacaatcctccatggttggagggctttagagctggggttctgtatgtgggttataccactagtttatttgaaaagataaacgcatacatgttttttccttggaaacaagactgcagaaaattgcaatgatctagtccttgaaaaaggcgattgctctcaagctgttattaa

SEQ ID NO: 78152 - DNA, 1052 bp, Homo sapiens
gcctcggcctcccaaagtgttgggattacagtcgtgagccactgtgcctgtctgggatgtttgccatatttgtttcatcagtatatatttctttgcttgggttgagtacagggactgatgcctgtaatcccagcacttagggaggccgaggtgggaggattactggaacccaggaagttgaggctgcagaccaacctaggcaacagagtgagaccatgtcttcagggggaaaaaaaaagcgctgggcatgggcatatacctatagtctcagctactctggaggatgaggtgagaggatcgcttgagcccaggaatttgaggctgccatgagccgtcatcatgcccatgccaatgtactccagcctgggcaagaaagtcgaccctgtctcaaaactaaactaaacaaatttctctggctgaagtttagtaatttgcttttaagtgacgtttgtacattttagaaaataactttgtatattagacatcatttatggtacttaccgttttccatggtcataaaatacctagtctagtgtgataaatgccaggtgatagaggtatgcctggggcataaacctaggggcttggtgggatggggtgagatggttgaaatagtatgtagaaggaaaggctttccagagtttactcttagggtggctcttgaagggcaagtgaaggaaagacatttcaggctgagggaagacacgtttagatggagtcctgtggatggagagtgctggacttgtttgcgaagtcaggagtagtttgatatgatcagatgcttagggaggtgattggtaaagtggtggaaggtgagattgtggaacaggtaggcatggaccctatcacaagcgtcctggcttgtgtatctagctaaaggatctgtctgtctgtctgtctgtctttatattttttgagacggagtttcgctcttgttgcccaggctggagtgcaatgatgcaatcttggttcattgcaacctccgcctcccaggttcaagtgattctcctgccttagccttctaagtagctgggattgcaggcgtgcactac

SEQ ID NO: 78153 - DNA, 1124 bp, Homo sapiens
ataaaaagttgagggaaaaaaacaaaacaaaacaacttattctttgacttgggtgtgagcagcagtagcgatagggtaagcctatattggcctagttttcagctttttaaaaatatatggctagaagaggttgaaacttgtgattaaaatgagtcttttgagtgtgtgaaaagtattttcatcactttaatttttttaagtgctctagaactagctaaaatgggcaaaacgtactagaataaacatagctgaatgagttgaatttacaaactagtggaagccttctattaaacagtaatttaccttgtaatcatattaatgtctaatctgtatctttatacagaaaaacgtttcattgtgttcagttttagtttatcctttctgttgacagtggacatccattatcagttcttgactattacaaatattactgctggggaagcattcttggacctatttcttgatgcccatctagaatatatatgctaagttctgagagatcagtgccaaattattttcaaagtggtcaaactggtttacactgctaccagcaaaatgcagaatttatttgctccacatcctctccaataattgctgttgttggacttatacgtgttagaccagtctagtgtgagtataacactgtttcatataccaaggaattttgctgttttagttaggtctgttaatggcattggtgttatgaaacaaatattcccacattttaaaaagaggtgtatattgatatatgtagggatgaaatgaaataattgggatttactttaaaattcttcagcacatgtaaagcacattttgggatcagttcaccaaattgttctgtggatgcagattaaagtattgtttccgtgtttaatttactgtcctgtggttatgtaggacagtatacctacccttagaaaacacttgctgaatgtttaagagtactgggtcataatatatgaaagctgctctcaagtagttcaggaaaaagttaacacacacacacacacacacacacacacacacgcttatttttattattaaaaatagcctctaacttaccccaccatgtggacataaccactattaaagtttgcttccggatcttttcggtatgcttatat

SEQ ID NO: 78154 - DNA, 1050 bp, Homo sapiens
ttggggttggagactgacttattctgtaaagtgggattttaacaaactcccactaagaaatagctttaaaaaatttatttttttgagatggagtcttgctctgttgcccaggctggagtgcagtggcacaatctcagctcactgcaacctccgcctcctgggttcacgccattctcctgcctcagcctccccagtagctgggactataggcacccgccaccatgcccggctaatttttttgtttttgtttttgtttttgtatttttagtagagatggggtttcaccgtgttagccaggatggtctcaatctcctgacctggtgatccacccgcctcgtcctcccaaagtgctaggattacaggcgtgagccattgcgcccggccaagaaatagcatttttataaagaacgtacattttgttacctacttggaaggacggattgatgaaatcctcaggcagagtctctggcttggcttcctgtgctgttttccaccccagagagggagcgttcagatgtttactgtagtaatgtctgtacccaccaggtggcacaattgctttacttaaatgatttaagctcattttgattctcagcgaggtgtgataactcatttcttattttaataataaaagatgccacaatatttgttactgtatttttaaagagaatttttgcatgttcagttgagtgatgagagagaaattggtgtcatgtttcctctgtggtacctaatcctacagcaagagtttcaaaaatatttttttaaaaaagctctaagaaggctataagccttgtcatcagcccaccatatggtgccagcctattgctttgcatagaatatccaagatcacacagtgttctgaatatctgcagtatctagggggagggaagggtgagttaaggttactgtggcaattttcatctgcatttctcccttcttttgcacttgagacttactgagggtactagggcatttcgttcattgaattaaaatgaatatagaaacaattgaagtttagcgtccatctgtttcttacccctgctttct

SEQ ID NO: 78155 - DNA, 1039 bp, Homo sapiens
atgttgccatacttaacaaataccaccttcccttgttgctgtacctaacaagttatcaccatcctgaattgtatacttatcatttccaagaaaaatatttttattgtatgtgtaatttccaattaaaacatattgcatattgtttgaaaattaaataatttatttaaattgcttcactctttcttgatacttatacctatattaaaagacattatacctataataaaaattacatcacctgaaaaaaaagtatgtgtatattaccacagttacaaagaatagaaaaaggggcctctgacagtgtctgccacttagcgctgtagatgagttagtttgtctaaatatgaagtcgtttttacttttcttttgctggtctcatttccattttcattgttttttgtttgatctaaaattttactgatatcatttttgtaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatggtaagtagatgagaccactgagttctattttttttctcctatctaactctcttttgcagcatacttgagatagggatatcatactcaaacataaatattcccatttttgataaagttcccctttagattcagcttagtacatgctgctctgtggatgggagttttccagttacaggagtaaagcacttctagcacttcccatcctgtcgtctgtgactggaccctccccacccaccccagtccctcttgttgggactcccaaaagattagacccatacgaaggactttttttttttagacggagtctcgctctatcaccaggctggagtgcagtggcatgatcttggctcactgcaacctccgcctcccgggttcaagcgattctcctgcctcagcctcctgagtagcttgggactacaggtgcgtgccaccacggccggct

SEQ ID NO: 78156 - DNA, 1697 bp, Homo sapiens
ctgatgggttataatgatgcctcattgtactttttatttggcagttccctgatgactaatgaggttgctcaccttttcatccatttgttggtcatttggatatcctcttttgtgacatgtctactcaagtctcatctgttttttttctgtcaggttgcgtattttcttattggtttataggtgttctttaggctctgagttgttttctacaacttgtattttaaatgctgtaaatatgttttgcattctgtgactctcaatggtatcttttgatgaacagtaattcttcattttaaggtagtttagtttcttagtcttctgaggttagtgtttttgagttctgttcacctttctcaaggtcatgacgatattctctcatgttagtcttagaagtgttgttttaccttttacattttgatctagaaatgtttttctgtatttgttgttacatgtcggattaatagtcactgttttgttttcatatgagtatcaatttggtcaagtatttattgaagaaactgtcctttatcctttgcaacgcagcaggacctttgttttacatccagtgtctgtatgcatatgggtctggtttgaggttctctgttcctttaatctctttgtccatccttcaccaatacatactgtcctaactttatgtactttattaatttagttatctggtgtaatataagttctccaagattgtcttggttatccctggccttttactttccatataaaatttagaattactttatcaattttcagaaaaataattctattagagttttgattgggattgtattgcatctatagataaaaatggagaattaacatctttattgagttttctgatcagtgaacctgatatacccctctacttctataggtttgtaatttctctcaatgttgtattgttttctgtgtaagaacttaacgcatcttttgttagtcattccatgatatttggtacttttttggtgctcttgtaaaggatattgttttttaaattactttttataattatttttgcctgctatgtagcttattattttaatctgattgcatagtacatttaaactgaaaattcaacctagtagttgggtcctgtcctttcattctctctctggaattcagtttccagaaatccatcagcaagttgttgactgactatttttggtttttgctgcttttgatttatcttgatggttcccttggaaggtcaaacagtagaccaactgtcatctcatagacgcgaagagcagggcgtgctgctgtctttcttgtggtttagggaggcagcccagaccaggacccaagcacactctgtgtgctcagaggagcggcttcttcttgtggctgctggcacagctgcactctaatcttaggagaatcacttaatctttctaggcctcttttcaaatgagattaatcctggcctgcctgatctcacagaatatgtctgggctactgtgtgagagagcatttgaagttctgtttgcactggaagaactgtctcgggctgtgagctcttgttgacattgtcatcttcctttacaaggatgctcctttctccctctgctgagtgagctcctggtggttgctgtttaatatattgagaaaagaaaaagaggccttcctcttgcaccgaggtgttattgactccatagggtgagagagaaaagattctttagttt

SEQ ID NO: 78157 - DNA, 1046 bp, Homo sapiens
tgcacttctgccctgtgtagaagcggtggacagcacagtgatcttggggcgctgtgaggctgcacccgcagttctgttgtaaagactgggcctttttggtccttactgtggctgctctgttacttcagttcaatcctatgtggtagtaagcccagggatttcttctgtcttttatgtaagactccaggtaggtgttttgctgctcaggtatcacctgttaggaagctgtggatccaggactgtgtacgtgagagccctccgtcccctcctccttgggttgtaccttatctgttgctctgaacaagcaaataataaacctagttagatgcttcaaaggataccatagggatctcagaattcagctacaacagatgttagtaacgtctttactcttgggtttttgtttctttaggtttttaagttctgttttcatacctttatatagtttttatttttaaaatgaaaattattttttccttcctagatccagaatattaaacagacaaacagtgctctcaaagaaaaacttgatggtggaatagaaccatatcgacttccagaggtaggattatgttaacatcatcttagaagtcatattcaagttttacatgtttaagaatttaatatcggtgtgatacatccccagtatacatctcttggaagagtatatggacataattttatgaacccagttgatgttaaaattccgataagagaaaatgaaaggttcgttaagctcataaggacatactcatctctaaatgtaatgtgctaaaatgactcatttggatatccaggtcattcagaaatgtaatgcacgttggactacagaagagcagcttctcgccgtacaaggtagggggaagttcttctaaagagtttaggaggccggctgtggtggctcacacctgtaatcccaacattttggaaggttgacgcatttgcttgagcccaggagctcaaggctgcattgatccatgatcacaccactgcattccagcctggacaacagagggagaccctgactttaaaaaaaaaaaattttt

SEQ ID NO: 78158 - DNA, 1012 bp, Homo sapiens
tcctttcccacttctcacaagttgtaaaaacttaaccgggaaccctgagtcttctaaaggtgtatttcattttactagttactcatcgagctctgactagccaggaagtacaaaaccccaaaagaagcagacagagtgttcagctttaaaggttgggggtgctctggacctgcgataccaaaagatgaatgcagaatgtccccaaccctagggcaattgctgggtgacttcagctgttatgtgacatgtaatgggaagacagatatcaaaatgacagggtcggtcatctccagaatgtgtctagaattggctggtactttttcctactctaataatacacgaaattattgcctgctgttaaaagcctgtatgttttcttatctggataaagaggtaagtgtcacttgtggttttaaaaaaatgtttttctcttgtattttaaaaaatgctttcttacatccttagccatcaggaaatatggccgagattttcaggcaatctcagacgtgattgggaacaaatcagtggtacaagtgaaaaacttttttgtaaattatcgacgccgcttcaacatagatgaagttttacaagaatgggaggcagaacatggtaaagaagagaccaatgggcccagtaaccagaagcctgtgaagtccccagataattccattaagatgcccgaagaggaagacgaggtaaatctgaaacaaaacagtcacttctcttgtcaggttcacgcttgatactccagtttctaaagtgatgaattttttcagctatagagatttttaggtatcagctgtattagtaacttcactcttacctgtaaatagccggaatgtgtatgcattgactccagttcttggtgcctgtatattattcacatgttaatttctgggcaaatcctgaattacatcctgatttcctccagctacaaaatactctgcattatcagtttttccttaaatacagtaaaatcttgagtgacaaagacaggggagtgggggcataa

SEQ ID NO: 78159 - DNA, 1153 bp, Homo sapiens
catcacctagccatctgcatcacatctctctggacaagcagctattaccaaaaaaggcatatacttccagtcctgtgctccatctgccttaattctttgctcgttcctccatgttggcgccacttcccagagagctccactgcatctcacactctgcccacgtgctggggaagtctcacggcctgcacatctcttgtgactctgggaaccgcctctcccgccggagcccccgagccccaccaatggcagctcttcccagtcagcagcttcagagcaggcagtctccttggaaggcccgactctgttcctgcatggcctgcagtttctactttgtgcatagagtcattttcagagtcaccgcgaccctgttggccttctagaaagtttcttttgttcttttctgagacaaccacctaagtgataatacgcttttttggaaactaatatatattgccagactgcatcataacctttatcatgccaagcatcctgatgcaactcacatttccctaaacatggggtacagttatgatttataaattgagttggcttaaatctccctcttctcccttcccaagtgttacaaagatcatttactgcaactgtcgttggacactgtagcttaaagggaacgtggacctcaatgctttctgccttcaacttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgagatgaaaaga

SEQ ID NO: 78160 - DNA, 1115 bp, Homo sapiens
acacagtcgggtgctagtgtaacacaaatgccgcgttgtctgggtgtacagtgtttgtggagacgccacttcctcaaaatggtttttgattgtttttaacctataagacgttctgatgctcacaaacctctattcaacacacaaaacaaacatgaaaaggtagttagttgggttgtaacagcttactggggtggactcataaaacagtggctttctgttcatctaaagtttcctcagataccacagaccactgttaagtgtgctcattgtcactttaaatttcaacgataccctatttttgtcattctaaatatcagatgtactattggtataattgcacaccaaaaataagccaaacagtgcattacgctaactggatccctgcttttatgtgagctaaggaaagatggagccaactccaacgagggcctctttttctctcttgtctagcctgtttctaaaccgaatgatccaggattcaagcttctattgtcaagtgaaactttcctcagatggactccaggtagccaggtcacctaaacctagtggtcctgtgcgatgctctttctgccagtccctgaatctctgcagcttctcttacctgtcttacctgtagtaaagcacaattgcagtggcgtcgcattcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattttaaaagatgtataaggttaagtttgcaaatataatggaaatgctgtatatcttttgaagtgatgaaatccacgttggaattttaaagaaaatatgttgtaataatgctgttgtaagtaatattttaatgtctctttgcctgttttctatttcagcacattcattgtggtgaatgttcatagcattataactgcttagccattgaatgataacatttgttagtggaaattggaaaatttatttgtgaaattctgcagaattcatttttctatttccaatatttgctgaggttaaataaaaatttt

SEQ ID NO: 78161 - DNA, 1904 bp, Homo sapiens
gcctcaacttcggcaaactttgtcccggaggccgggctcggggcccgagggggccggggcgcccgcaccttttcaggaaacggggcgcgcaggcctcgctacggccgtgacccccgctggcgttgaggacccggcaccccgcggggccgcgggtttcacgcggggggacgggcggctcaggggctgcgtggccgagcgcgctgcccgggccggccgggggggcccgggcgttattggaaagttggtcctgagtcattccgcctcagaggcgcctccgaccgcttggcgggcggcgcgggggtccgggtatgggcagagggcgcgaatccccctcgcgcggccgccgagggccggcgactcccggggcaccgggcggctcctggccgcgggctctgcgtcttccccgcgggcgccaggcggctctcggcgggctggccggttccacgccgccagccagccccgtgtggggacttcggtctagtatttggacccgaggagataattctgtgtggaaaattctctcccttcggttggaaacagtaacaaactggaaacggatgaggtgttatggacgtgcttggaaatgcaagaaaccttcagattacgagctgttgacgggaccagttgtatttcacgtttttcgaattaagctcagaatcagttttcagaatgacatgtgatgcgtggtgcgtggtgtgtgtgcctgtgtgtgtgtatggatataattcattcatttttgtggcgtcagaaaggttatgtcgagcgttgtagcggcttcttaatttacattcacggcatacaactgaagaggagccattatttattttttttcctagcatttgctgcgactacacactgccggagcgtttggaaatgttgtttgctgttaccctgtatttgtctataaaattcttactgtagggaatggccaagtggaccatcagttcgtcctgagatcttctcatgtctctcacgtctttgaaaatggcctgtgaacagactgcatcatatgtaggatgtctggcaaaatagtgtacagcgttcttttctcaaatgagaggaaatgtgtaccttttcgccgcgttgtgacaatgtaaatgttaagaattagtctaaagatgaaaattctttggccaaaacaagataagccttatcgatatgaaaactggaaaacatcacatgggactggaaatcctgtgagtgggtgctcatgacggaaaccctgacagaccttggattccagcatcgctggtgaaaatcagaccttatcatggataagggttaagatgtaaggtgtctcacccagacgccatctgttccagctgtcaatgcagaagccaggaaaggagagagagctggccagggagaattccagctttttttttttttttttttttttttttttgagacattcatgtgaatttctctgcgaggggaaagaagaccaattattttccttggatgctgtcccttcttttggaattaataagatggcttcactcagtgagaggctgtaaagacatttcactggaaacaggcagtaacagtggccagttgtttctgttaataccatcaaaatatccctactcttgtttgtgccttgaagaaagtccttcatttaactgagacatctgagcctgcgttgcggattctgattctctaaatactcctgcaagaatccctttaatttttcactgtgcaactcaagaaggacctttctagggtattgtcaggatacgtatgctaatgatattgtcaggttaggtgagaatgattgatcactcccttaaaatccttttttatgatgttaaagctgtactttaagaaagataaaactgccactgtggcgttgcaagtctgagctagctcaagcaaacaaaggaaattgcgttaaatttgcccaa

SEQ ID NO: 78162 - DNA, 1444 bp, Homo sapiens
cagaggatttggaaggctaccagagagaagcagccgaggcctgattgtggaaatgatgcttagacttgctttcagcaggagtgatgaagccagaatgagggaggcccagacgcccgggagaggtacaggggataggtgccatgtggtttgcaccaccgcagcaggctttgggtcccaaagacgcgaatggaaatagaagaaaatgcagttttaaatagaaaagaaaaaaaaaaccgagaaaatgttatgtgtgcttgtgtaaaatttattattcataattaaaatacaaaatggctttctcatttgagaaagcctttattgactaagttctgcacaacactattccaggaaagggggtggggagacagaccaccctagggagaaggcagagttttttactattaagcataataccttttttttttttctttcggtgaagcttattgtcggcctgtacagatgacttggagtaggctggcaggtagtgggatgtcataaatgttgatgcctgttggtttctatcaactttaggaatcaggttggaatcgatgctgcattctgtattcctcgagataagtggattgttaattgggacttgggagtctttttctcatttaattaatattcagttaatgtgccctgagttctcataatgttctggttaccgtgctgggaagagtgagacacagcacccatctgctagggtgtgatttgcagggatataggccatcttggcccctgtgcacagtgaagggacatgccagaaaccagcagatacttgactgagacagaccaggacaggagcttgtggcaggaaggataaggaaaaatgcaaatctaccatcctgccctcagggtgctaacccttcgggggagaatactttctcccaccaggaagaaaccagaaagtaaaaatgtaggatgaaatgaattagtggattgtgtagaattctggaagcgtggtgggaatccaccataagggaaagagaaagtcttctgggaagcggcgttgagttgaggcccagtgtcaggaaagctctggtatagtggggccatctggtccctcttacagggccccctcccactttgttttggtaagatgggatctgacggcttgccatcctgtcactccttgccagtagatgcagtgctggccatgctgctggtcattgggtttccagttgggaagttgcatgtgctggcctttggctcttgccaggcagggccttttgtgactgggagctcatgtgggtcatgcatactgtactgtgaagggcatggtctgtggaggggaacagagcagcaggccctaacctgggtggcaccactttgctgtccctaccatttttcattgcaggttgaaagtctccaaagtggcaggggaaggggtgtaaatgttaaacagccccttcctagcctggcatgcgcacctgtggtcccagtt

SEQ ID NO: 78163 - DNA, 1069 bp, Homo sapiens
ttttttttttgaggtggagttttgctcttgcccaggctggagtgcagtggcacgatctcgactcactgcaacctccgccccctgggttcaagctattctcctgccccagcctcctgagtagctgggattacaggcacccgccacctcgcctggctaatttttgtatttttagtagaaacagggtttcaccacgttggccaggctggtcttgaactcctgacttcaggtgatctgcccgcctcggcctcccaaagtgctgggattacaggcgtgaggtactgggcccctctgatgcttggcttctgattccagctagggtcaattgagaattattgaatcacccacactttctttgagaactttctaagtgctaggggctatgctcgttgctaaagctaaaaagtcagataggatgccgtctgatctctgttttcaaggagcttccatgtgatgaatgagccagaagaataatttcattatggcaccatgtagtaggtgccacaacagtggaacagaggctctggtgcattgtggaggcgctgtgcagtttcaacctgggttaggaggaggcgtttcccaaggaggtaactcttagggaagctagcagcaggagtggggaagcctgggctggcagggagtcgcctggcagagggcccgtgagtcggaaggggttctcctgtggctgtccttcaggggagagggtacaggaaaaggcacccggccacttctgggtgctgcctttgtgacagcctaacttctgaggcaggaattctccccattttgcagatgaggaaaaggaagagcaacaggcctgttggaccccagagttcatggtttcaccacagctgaattacagtgcagttttagattttcttcagattctaaacttcttagttttgctttcagagtagacttagttttgctgctgtagagtgctttttaaacaaattgtgtatttttcatgcagcctttcccttccatccaacatctgttttgcctatatggctgatactctaggccgcactccgttccatctctggcgtaagttcctttcttacagcagcctcct

SEQ ID NO: 78164 - DNA, 1061 bp, Homo sapiens
taaaaagggtaaaatgtctagaaactgaaatcacagtatatttgcacaaaaggaacatctatagatatctccctttttaaaaagcaattttaacatatgaatttttatatatttaaattcgtattttagcacttttttttctgttatttagcaataataatattcttcaatttgggctgggcgtggtggctcacgcctgtaatcccaacactttgggtggctgaggtgggcgaatcacttgaggtcaggagttcgagaccagcctggccaacatggtaaaaccccatctctactaaaccaaaaaaaaaaaaaaaaaattagctgggtgtggtggcacatgcctgtagtcccagcaacctgggaggctgaggcaggagaatcgcttgaattcgggaggtggaggttgcagtgagccgagatggcgctactgcactgcagcctgggtgacagtgagactgtctcaaacaacaacaaaaacaacaacaacacttcgatttattcaggcctctgttcacattttacctcttcaaaggggtcttctgaacaccctaattaaacagcccatgctgttgctgtggtcacttgccttgctttttttttttttccatagcagaaaatggttttcctttcctttttcttttttttttttttgagatggagtctcccagtcacccaggctggagtgcagtggtgtgatcttggctcactgcaacctatgcgtcccaggttcaagccattctcatgcctcagcctcccgagtagctgggattacaggtatgcaccaccccacctggctaatttttgtatttttttagtagagacagggtttcaccattgttgaccaggctggtctcgaactcctgtgctcaagggatctgcccgcctcagcctcccaaagtgctgggattacaggtgtgagcccccacacccggcctgcagagaatgtatttctattaccttaacctgtgtactaggagtgtgcctggcatatggtaggttctcaagtatttgcataaatgaaccagtatattatagcccaatgttttattgaggcaaaattc

SEQ ID NO: 78165 - DNA, 2454 bp, Homo sapiens
ttcccctcttctcaacacagacacattcatgttgtagtgccagctgtaagcataggagttgcacttaatggcttacagctggggaaaatcatggctgatagcacaccaccagtgcaggatcagggaagggaactctattcctgatgccaggacaggaaagagatgtgcttccttcatttcatgaaaaagccacagattgttccggataatggttgctgaataagaaaccaccctaaacatcagtgatttaaaacagtaatctactactacatctcatggttctgtgggctgatcaagcagggctcagctgggtgattcttctgctccatgtggccttgatggaggtaatttattggtattcatctgttggctggtccagtcatgagggtccaagagggccgtacacacatgcttggatggttggaaggccaggctcaggggatcctccctctccttgtgctctcaggtcctctgcagatggcctttctcctaaggtggttgtgcttcttacatgacaactcagaactcttagagtgagtgttctaggagaggaagtggaagctgccagtctctctctctctttcttcttttttttcttttgagatagagtctcactcttttgcccaggctgagtacagtggtaccatcatagctcactgcagcctcaaacgcctgggcagaagtgatcctcccagcccagcctcccaagcagctgggactacaggtgcatgccaccttgcatggctaatttcttagtttttaactttttgtagagacaaggtcttaactacgttgcccaggctggtcttgaactcctgggttcaaacgatcctcccaccttggcctcccaaagtgttgggattacaggcgtgagctactgtgcccagtctggagctgccagtatcttaagcctgggcttggatatcagtgtagcattattcctgccatgttctaaaaagacacagagtcctcctatatttgaggagaggggacatggaccctaactcttgatgaaaggagggtcgaagaatttgtgactgtccttgatctggtatacgcatggtggctagattccatagtgctctcagtaatatatgttagatacccatttgaaaactgttgtggattaaaatggaaatgccaactgttgtgtgttactcattttcagtgagtacattctgtgttctgaatcaataatttctaaaaaacttttggagtatacctattcataaaataattacctctataaaatgtatgtcttatcagcagccatccttgatcatgtgtttgtcaagtttttcaagtacagctttgggtccatacgttttttcttcctattactagttcattttaaaaatttgttgaaaccttcccttttattttaaataatattgtggggttttaatatttctctctgttcttaaaaaaagcttcattgagaaaatataagtaagcctatatatcctaaagttcctttcctttactctagatcattctagtaaatcccctagagacagttctggctgtttatatataaaagtgtggtataatttgacagtgtgtgcagaggtgtgtatggatgtgctctcacatagaaaccctgcctccccagcctgtctcagctgattgttgcaacactgagccgagcaaacatgatgaggtcacagagaagtgagggagtggttttaaataatgaaacaggaaatctctgtctttggctccagtggtgccccagtgttttgggattaatgagggaagagctatgtctgcctgtgttccatgagtgccccttgcttgtacctctatggagaaccccaacaaccctggctggaaagccacctaatcctgtgtttcccaagcataacctccctttgttcccaagtaagtctttcctagacacctgaacttctgtgcaacataggcatgaatgaggagagtgagctactgtggtgttatatatatacacacacatatatacatgatatgtatgcatgatatgtatatatgtgtgtgtgtgtgtgtgtgtgcatagttttcatccattgtttctgactcataagtcccatagcccttgttacagtcttttgttgtaatgttgggtgtcttgcctcctttcagctgcccaaggcaggactctaatctgactgtgagtcagaagacccttattccagagagggccctgcctcattccctagaggcaggaatgctgcacagagaggccaagataagtccgaacagacaggccttgctgggtttagatcatggttttttgtccagaaacatttctagatgattgtaagtcatgcctgtgtaatgaagccaccataaaaactcaaggacaggccgggcatggttgctcacgcctgtaatcccagcactttgggaggctgaggcgggcggatcacctgaggtcaggagtttgagaccagcctggtcaacatggtgaaaccccat

SEQ ID NO: 78166 - DNA, 1333 bp, Homo sapiens
ggcctggacttgcgactagtgtctgaagtggggatggggggtggacagccttggcgactgaaccgccaacagctttgttcacgcaattcttctgcattggcgattgttgtcaggttgtgagagcaggggaaaaacacaggttgagagagtttttccccaaacagcccctggtcgatgccccggaatgactggctgctgcatggaattgcagaggcctgagtgcctctgcttctaccgtgattcctgaggccaagacctctggtctgcatggtctgaagtctcttacgaaggtaaaatgttatgtatatattttgaataagggtacctgttcctcattctgtccttttgaattccaaaagtgtgttggcctgtgagatagcataagggacagaatcattgctctcgtgagcctttgggcttgcttccttaggcactacgtactttctcattccccattgccttcaggattctttctgtcagaatgtagtggctgtggcctgggggtgaccagcataggggccaaagaagggtaatgagtcttgaggcctacagagggtagtaggcaaggcgggagggcaagggccagggggcagcatcattcacacagttgaaaacgtgcccttggcctgtctcctctctgtgttctgcatcttagaaaatagatattgtcttgtgttaagatgaatcaatatagttacccctttttatattgtcttaagcttcttaggaactgctttgtattttagtcactcaggcttggagtgaaacatgtaatgtgtagttcaacctgaaaaaattggtctgagaggcgtcttcatagagtccccaattctatatatgatgaggtctcatcaagctttgacattctgctcttttacgtgtaacactactaatgtaaatgtttctggattgtaaagaatggtgggaagcgtagagattatctgttggtaagccagaggcaggaggaagaggaggaggaggaggagatagtggcgtccctcctgcagaaaccccgcagtggaaggacaagattgcaggaggagttagagaccagtggtctagtccccatctgtctttgtgaccttaggcaaatcattgaatctctttgaaagccttgtctccttgcatggcatatggagattatagttgctgtgaaaataaaataatcagtttttaaaaatccataaaaatgaaaaatggtatttaaggttgaaggcacttgtatttctttttctttcttttttttttttttgagatgtagttttgctcttgtcacccaggctggaggtgcagtggcgtgatcttggctcaccgcaacctccgccacccaggt

SEQ ID NO: 78167 - DNA, 1039 bp, Homo sapiens
ttgggctggatatagtggctggcgcctgtaatcccagcactttgagaggctcaggccggagggtcgcttgagcccaggagtttgataccctgtctgagagagaattagctgggcatgttagtgtgcgcctgtggtcccagctactcaggaggcggggcgagagggatccttccaggctgagatgtgagggttctttgagcccaggaggtccatactgcagtgagccatgattgggccactgcattctagcctcagtgacagagtgagactgtttaaaaaaaaaaacaaaaaaaacttcagaggagtcatatgattgacttgtgtgtgtctacgcagactcccttttctctgtagagacttacaatcttcagttctctggagcgttcttcagattcccttgctccatgactgaccttggctaggaaaataattgggccgtttttggtgcacagcagatgaaaattatcagtatgtccctagctttccactgtgaggccgccgtagcaacagaggacagtggatgtgtgacttgtaccctttcagagggccaagaacgcaatatcctaaagcagccttttctttttttattttttgagtcagggtctcactctgttgcccaggctggaatgtaatggcatgatctcagctcacaggagcatcaacctcctgggctcaagtgatcctcccacctcagcctcccaagtagctggaactacaggtgcaagccaccacactggataatttttgtattttttgtagcgacagggttttgctatatcgcccaggctggtcttgaactcctggcctcaagtaatcatcctgccccagcatcccaaagtgctgggactacaggcatgagacatcacacctaaccctgttcttgatacctggtttttgtggtcctttttttctaaaattcatatgaattttgagttctgctgtatgatatgtaatatatatgttctaatattacaaacttctaaaaatctttctgtgcaccaaaattgatcctccaggacagaaaaaatgccagtggttc

SEQ ID NO: 78168 - DNA, 1221 bp, Homo sapiens
gtaccctagggggcattttgcagtgtctggaaaccttcagaagtggggtgggggatgccactggcattggtaagtagaacgagggatgctgtgaacaccctgcagtgctcagcatatccctacagcaaagagttttcgggttcaaaatgttagttgcgccaaggttgagaaaccgtggcttggaaattgttcattcaccatactcttcttgatttctagtgaatgtatgactgttaagattttatgttttcataaggtgaggtactttctacagaaattcagtctctttagtcattaaacagcagagggcacttggaggctagagtgcccagaagtccatcaagccagtctggataaacccttcccaacatgccataatttacatcaaaactttggttagcagaatgggaatttttgagtagataccattagaaaaataaaataattttccagctgtggttcccaagttccccaaacttatgtctttagtccaagctgccccttgagcttcagcttcggacctgcatatttatttaacagctattgagtccttggtatgtgccgggcaccctcctgtgtaccagggcatggcaggaaatgatatgggcagctccctgtagtcatgaggcctgtgttctaaggcagaccttgaagacagggaagtccatgtgctgattccagaagaatagagggggcctggcagggctggggggaggtcaagagtggagtgcttcatacagctggtctcagaggggctcattgtcccggacctgcaggacaaggaggcgttttgtccacaaaccttgagagtgagtgaatggggcatgactggggccactgggtgttattgcttgaatgacacctaacctgtctctagtgaagctcttgattcctccctacccccatccagatgctagaagactggggagcatttcttggtccctcttctctcacaatctgtcgttggtgctcacttctgcaccctgttttcccacgtccctggtccccagcccaggcaagccttctgctgatgccggtggccccaacttgtctatccacttcaccccagttttctccaggcctttctccatgctgctgtcagagagatctaaacataggtggcctcctgcccttccctgaaaaccctttacggcctctgactgcattcagtgcaccctgcattcctcctgataaggtcttgcgtctccctgctgccccagc

SEQ ID NO: 78169 - DNA, 1571 bp, Homo sapiens
ctcacctgtgctgcctttcacttggaggatgggtggatgattcacagggacctgccctccttcccgcagagttggggtttttgtgtaggggatttttctgtcagttattttttcctcacctttcagagtattaaaagaactaagccattagtggtgaggcatgagggcagcgaccacagctccaggggagctctcttatccctacagctggcaaatgttccaccctgtttttatggcacacagaaaggtaggcgcatagtgatgttgttagtaagcttttgaagtagagcatggtgagttagttggcctttttacgaaaaaggaaatggaaaactagcaccatggccttggcataattactccaacatgcaaatcagtactggaaggaagttgaggcagcatacctctatgctccactagtccttaagacacgtctgaaagaaatgaaattttattttgttagaggtgaaggaatgcatggatggaatgcatggtccaggtgtttataactgtgcatttatttggcggttgttttggatggacaggaagtgggaggggagggcacagagagtcactttggccacgtccctggtttgccacaggctgatactggagcattcctaagtttcgcaatggagatggatgtgaaagaagaacacactaggccaggtgcggtggctcacacctgtaatcccagcactttgggaggctgagacaggcgaatcacctgaggtcaggagtttgagactagcctggccaagatggtgaaaccccacctttactacaaatacaaaaattagccgggtgtggtggcacatgcctgtaatcttagctactcaggaggctgaggcaggagaattgcttgaacccaggaggcagaggttgaagtgagccgagattgtgccactgcactccagcctgggcaacagagcgagactccatctcaaaaaaaaaaaaaaagaaaagaagaaccatactagtcaggtgctagagggcttccaaggcagcctccaagggaaggaaatgtctgagaagttatttaagaggatttgttggaacagaaaaacttccaaattggtctagaaggtggaccctagctatagacgcattttacaggacataatgtaaatattaaaggcacattttcagtatttggggaaaatatgtcctctgagtcgaatgaccaatggctgtttctagaaaaattttagttgtagttttaatttgattgtcttgagcatggtgatagattgactttttttttttttaagacagtcttacgctgttgcccaggctgcagtgcagtggcacgatctcagctcactgcagcctccacctcttgggttcaagtgattctcctgcctcagcctcccgagcagctgggattacaggtgcgcgccatcacacccagctaatatttatttatttatttattttgagatggcgtctcgctctgtcacccaggctggagtgcagtggcgcgatccctgcttactgcagcttctgcctcccaggttcgagagattctcctgcctcagcctcccaagtagctgggactacaggtgcgtgcc

SEQ ID NO: 78170 - DNA, 1052 bp, Homo sapiens
tccgcctcctgggctcaggtgatcctctcacctcagccccccaagtagctgggactacgagcacatgccaccaccctcgcctaatttttgtattttttgtagagatggggttttaccatgttggccaggctggtctcgaactcctgagctcaagcagtccaccctcctcagcctcccaaagtgctacgattacatgcattagctaccatacaccgattgtacaggccacaggctagccccacacaccagattttgaagattaagtgtggtttaaaaaaatgcaaaatatcctgttaataatttttgataatattacatgttgaaatgataaagtttaatgttgtgttaaataatacacagtaaattttactgacttctttttactctttaattgtagctgctaggagatttaaaattatttttgtgattctcgtatttctgttggaccagaggtattttttaatagcatgacattctgttacatggttgattatatgatgatcatatgattgtggcagtttcttgattcgattctctgttgttggacacttaggttgtttccagtcttctctgttttccacggtgctgtgatgactgacactgtggatgggtagtcatgcactcctgtgcccgctgccaggaaagagctcataaggaggacctgggaagcatttgctgcacttctgaatctagcgcatgcagactcgaccctgtgggtcgagctttggtgagaagtggttggatttggaacgtatcttgaagacgaagctgactgtctttgctgatggattggatgtatggcatgtgaggaagggggtcctttatgatctaaggaattggatggtgccatttcctgagccaggcattgccagaggcagatcagagaggaacgggtaccaagggctcagtgttggacctgttaggtttgagatgcctttttgatgctcaagtggagatgttgagttggttattggatatacaggtctgggggaattacagggaaaggggtgctggagatatatttgagaattatgaaaagctgtttgagcatc

SEQ ID NO: 78171 - DNA, 1045 bp, Homo sapiens
tggtggaggcaggcagggcctactaggcttctgaagcaacactcgccagggacattttagtgaccttttccccgtgttctcaaaacactttacaaatacaccatttgtctttaattctggcagggtggtttgggtgagctgggggtagtgctgttagccaaccttttacaatatttaacaatcagtagagattaaaagctgtttggcctctttcccattgatcacatagcctttttctttttgtacaattttagtatgattaaccctcccacccccattaaagttcttcagccttcttagtagaaagctctgtgaagtttgattcacccacggaagttacttcatggagtggaagcatttgagaaatcagatcttggctttcttcttgtggacagatcaggtggctgaggcctggagggagcttgatttgagatgagtagtttgtatgcctgactaagtcaagtagccacttacttcccttcacacttaatcaaatcctaactctctaactgaaactttgtaccatttgaccagtacctctcctttccccattcccccgctcccagcctccgtaaccactgttctactctacgcttcttcaccttctactttcttagattccacatataaataagaccatgtggtatccgtcacatatttcacttagcataatgccctccaggctcttctgtggccatggatgataatcatgtattgtatatttcaaaattgctaaagagtagatcttaaatgttttcatcacaagaaaaggaacttggtgaggtgatggatagattaactagtttgatttaatcatttcacaatgtatacatagatcaaaacatcccattgtatcttataaataaatacaattttttttgtcaattaaattttttaaaaattacaagaggctgaggtgaggttacagtgagctgtgatcatgccactgcactccagcctgggtgacggagcaagactctgtctctaaaaaaaaaaaaagtgaagttaaaaattaattaatttaaaaaaatcccaactcttccat

SEQ ID NO: 78172 - DNA, 2940 bp, Homo sapiens
ccttgggtagcttccctgttactcctcaggggcttccctggccaccctctgctcgggcccttcctgagtgttacatcagcacctttcttgcccgcacccaccaccagccacagcttgtgtttgccgtgtgagccggagcacttgtttgtcacctcacggtcttcccctccatgagggcaggcacggcagtcttgctttcattcttgctttcatgcagtctacccagctgtgggcgagatgtgtgcacatcgctcagcatgtttgtagaatgaacacatgtataaactagacttgaatggagattattgttctctcctggccattaaaggtgcttcttcctgctgctcatttacatctcaggtgttaccatctctggccagtgcctgccctgttgttgtcatctaacagtcatgggaccacacctttgtgactctcagggccagaggtgtttgggaatgtggaatttttgagatttttagaacagaaatagtgaaagtaccgtatagtataggacatcctaggcagcaccatataatcaagcacattaagatttttgcagcaaaaagtatatgaatattcacactaagtgggacagtgagactatgaatagcttcacatcagatcagggcataccgccaagtgagttatgaacatgctttcagttttcagagagctttttggattttcaaattgcagagaagggattatggacctgtcttagtgagcatctgcttgtcacgcattatgcagcgtgctgaaatacaaaggaagaaaacatcacgcctgccctcccgtgtagggggtgggtggtcaccacatgcgggtggtgagcccatgctgggagggcactcccggcaggtcctgttgttctccctgtcatctccccctttcctttgcgagcgtcctctacaggtgcggtttcaggtgagccacatggggggctggcagaaggggcactgcattgtgacgcagggtcaaatgtgtccctctcagagtgtaggaggtaaccgttctggatcgcctggatcctgcccttgggtctggctgcccgggtccaaggaggaaagggccgactccaggtgatgctgcagaccaggagcgctgccctcacttcctaaccttctgcacttgggtgccggggccccctctctgcagtcacacactctgccctcttagctgggcctagagctttaaacattaactggattcaacatacgtttttctgactttttaaatataatgagtatagttttattttaatgtttttcagatgcattttgatgtaggtaggtacctttacattttaaaaatttatttgctttctgaaatgggaccagcatatatatatatatatatatatatatatatatatatatatatttttttttttttttttttttttttttttttgacaggttcttgctctgtcacccaggccagagcacagtggtgcaatcacagcgcactgcagtgcagcctcaatctcctgggctcaagcgatcccccacctcagcctcttgagtagctggggttataggcacccaccaccacacttggctaagttttaaaaaatttttttatagagacagggtctcactatgttgactaggctggtcttgaactcctgggttcaagcagatcctcctggctcagcctcccaaagtgctgagattacaggcatgaaccaccacaccctcctggtacctgcattttgaaaatgtttcattgccaagcctgcagggaagtctgccctttttttattagaaaatgaagagctaattctgaaatatgcctactaaatatgcatatctcaagcactttaaaaggatgtagggtgaaatagtctgttcctgaagcaaatatcactgtgtgttcattccattatttccgtagcttttctgtggcttttgataagttgtgtagaatgtattaagtctcatctgaaaatgtatattaaagattgttcttttaatttaaaatgatttgtccaaggtacttgacttaatgattcaagatttaatgagccgtgacacttttagtaacaccgtctcaatctttcagattttataaaagatattaaagttttcagaaagttgagaatggtcttttgtaatgtattttaagatagttaagaatagagtttatataattaagattaggatttgtattgcaaaaactcccttcaagacgcattttgggcctttatgagcgagtaatcatgacaggacagagtggcttcacccacagttttgtggttaatatttgcaagtcgtttatttaacaaggttgaaaagaggcttcctggtgtcttttataattatccttttctggggaccaacttataaagtaaaaaatacctggtggcattatctttgcttcagatgtattatgtttatggaattggaaatgtttgatttcttagtgtgtgtgtatcagtggattatgtagtttaaaatgtttgcatctgtattgcatgcataaacatgtccgtttccaagtgtggcctttaaatactcagggttttgtggccgggcacggtggctcacgcctgtaatcccagcactttgggagcccgaggcaggcagatcatgaggtcgggagttcgagaccagcctggccaatatggtgaaacccagtctctactaaaaatataaaaattagccgggtgtggtggcgtgtgcctgtaatcctagctattcgagaggctgagacaaaagaattgcttgaaccctggaggcggaggttgcagtgagccaagattgtgccactgcactccagcctggatgacagagtgagactccatctcaaataaaataaaatacaataaaataaaagactgagggttttttaaaaggtcataatagaaaaattttatgtgttttaattgtttaaatgttttcttcgggattaaaaaaacctgaatgtattctgggaaaatgt

SEQ ID NO: 78173 - DNA, 1073 bp, Homo sapiens
tgaggtaacaacgtcttttccagttggtgtcagtgaactctgttttgggtatctacaaaagcagaaggggaggttaggatgtggctggaggaggctggttcctgggtgtaaatcctggctcttctgcttgaactgactgtgcctcagcatcctcgtctgtctggtggagccgcctcacagaggaacaagtgagttgtgcgtgtggagcaggtggctgacatgtggtgagtcctccaggaatgtggcagcagaaggaacacgttgagcaccgcagataccaccctgaccgccactgcagggcttctgtgcgggggcagctgcagagccgccgcttcaggacagcatgggagctgctggaggtcgggggagctcagggaaagggccttgctgccaggggtgggaagggagtcagtgaagacgtcctggaggagaagattccagagcctgagatgtgaagtaggttaggtagccagagacaaggcaaagaagggccattttcatcagagaacagcataacattggcagaggtctgacatgtcatttcctgttactagaattggggagtgaccagtagattctttaatttgtttattcattcgtgcagtccttcacctcacacctgttcagggtccggctgggctctggacatagggtggaagaaaaccatctgagcagaggccgcgtggactgtcacctctgtcaggggtgccagggctgccaaaggacagctgttacttatgggtggcggcgtggtgaggtcgcacaacacagagctgccctgctgtgtccatgccctggtgcctccccgtggtcaccatgtgccttgggcaaatggaggcctcaggtcccagacataggctctgtcagtggtggtggcggtggctgtacctgctccgggctgctgtgagggagggacgggctccggccacaggcgtgcaaggtccccttgcagaggacctcccgcacctgctgaggaatgtgtacagccatctggagggtgttctccccctggccctccctgtagtccagctgagtccacgtccttcagccccttttcaatgttcctttctcac

SEQ ID NO: 78174 - DNA, 1029 bp, Homo sapiens
gaattattgaagatgttctttgaagagatctgctttttctttgatttgctaaacgtagttggtttcagaggtgtagatacgcatagaatatattcatttctttaacttaagcaatgacagttacattaatctggatggaacttttcgtcttaaaaaatctcagccactggctgtagatgatgaattctaatctccttagttcttattttgcctttagaagagcattttcagatgtgtggagctctgtgtttatccgtggggtgagctgggtgctacctccagctgctgctcttcgtttatcttagagggaggccaagagtcagagcggagatttattttgcaatgaattagtggccccaaacggtattaaatgcattatgggtggtaatttatatgtccaatgccaagaaatataatgttggggttaccatggcaactgcttgcattctgaaaagcttgtgaatgggttctgaaccttctggcattggaagtgagcttttccagctgagggcctgcattcgtgattagtgtaaataaattcagctttccatatgaagcacatcctttctctttgtttaccagagtagtccattgagctcagttctttctctggtgatgtctgccttggtctcttggttcctggcaacagaatatggttgagacatagttttcaacttcaggctgaggaactagcctgtgtgtgtgtgatgacctgccacctcagtccatgcactgtgtagaaggggctggctcatctgtacctcctgagggctggcaatgcatgatgtctccaaaagcacagttgcagccgcatgtgctggtgggctcctggcacagctttctatccatctgaagggcttgtttccggtaacacttgctagggctcttcctgggaggcagccctgcctgtttccagggtatcatggggattggttttggggagggaggcccaagttagaaagacccatgtttaaaatgtcaagcttgtgaaaatgataaacgagggcctattgtcttcattgccgaaga

SEQ ID NO: 78175 - DNA, 1039 bp, Homo sapiens
ggccagacactgggagaatgttttcatgctctgtagaattcattctctttgttaataagcattgagattatagaatttaaatgttgagcttgaggatagactggccttgaggcacacagcgggcatgctgctgtggctcacctgtaggcctcagttaagaatctttgtctaatccaatccctttattttacagatgaggaaaatgaggcccaaagaagtgatgccacttggttaaggtcccagagcaggtcagaatcagacctaggatcagaaacctggctcctggctcctggctccctactcttctaaggatcgctgtcctgacagaagaggtttgctctcagttaattgatgttgttgttgttttgctttccttttgtcagaaagaggcctgtaataacaacaggcatctaatttagactctgtaatttagaattttaaaaattcttgtcttcccttcttctggttatttatagaatttctactcagtgtgctggagtcacccataggaggggcaaagggcatgacctctgcccttaacgctgtgtgctgtgatgagagatgggtgcatagccgagcctgcaaactggaatgttgggataaattctggcttgacatctccatttctgccaggctgtggtattctgtgttcttacagagaagctgcagtgcccagcagttacccaggggtgaatctgaatcaccacctgttaaatcaaggtcatgatactgtatttactaaggcaggacaacatagtaatttaggctcaacttacaagttgcaacttattacaagtaataagaggttcggcttacaaggtttgaaatacaaattgatttttttagccagattccattgaaccctggtttttaattttccaatcttgaaagaagactgagattttactgtataactcacttagggtgacattgtgttttcctaagtattctcagtgatttctcccattctccctattcttctcacatgggactttgacagagagctgcacctgggctgggtgtgtggcctccctcaccc

SEQ ID NO: 78176 - DNA, 1075 bp, Homo sapiens
ctgtgcccagccattatttgcttttagttgaatttgtgtgtttggagactgagcacttactttcaacagtgaagaaattgacttggcagcagttgctgcaggtggctgttttcggtctacctcatactgtcagtgtgtcgcccagatactatataattactcagttattttgcagtcacaacatctttgtgtgtttgtatttatttagtaattagaagaaagtttttatgttctcatagtatcttcctgtctacacagtgcatttgtttactaatttatatccatttgatacacatctaatgattgcctctgatgggtatatgtgggaacatgtacattccctactgttagctgcaaatagtgagaagtagttagagcataatgtttcacatcgaagtaatctctttttcaaagacatctctgagaatgaaaacattaagtttggcagttccgacaaactcttatagtgataaggtattagtctaattctacttagtaagaaagttattcccggagacttccatttccactatgatggaattagaggtgatttacgccccccaacccaggactagggtaaggcaagtgaggcacttgcctcagtgcagaatttaaagggacacccaaaatctcagtaatcgagattattaatattttaatgcagtgctttaaaaaaatcaaatttgatgcaaaaaaaatccatgatgaaaaacaaaattattttttactttttaagacagggtcttgctctattgcccaggctggagtgcagtggagcaatcatagctcactacagctatggtaatacagatgggtgggctcaagtgatcctccagcctcagcctcctaagtagctgagactacaggcacatgccaccacgtctggataattttttatttttttttgtagagtggtgtctcactgtgttgcccatactgatctcaaactctgagctcaagcagtcctcccgtcttagcctcccaaagtgctgagattattggagtgagccaccacgcctggcccaaaacccaaatttgaaagacaggatcagtattaatgatttttctttttgtc

SEQ ID NO: 78177 - DNA, 1018 bp, Homo sapiens
gctaatttttttgtatttttagtagagacagggtttcaccgtgttagccaggatggtcttgatctcctgacctcgtgatctgcccgcctcggcctcccaaagtgctgggattacaggtgtgagccactgcgcccagccaaaaaaagttttgaatttgctgggtgtggtggcacatgcttgtaatcccagctactggggaggctgaggtgggaggatctcttgagcccaggagtttcaaggctgtagtaagtcatgatcatgccactgcactctagcctgggtgacagaggtcgaccgtgtctcaaaaaaaaaaaaaaaaaaaaaaaaaaaaatactattataccgctgttcagttagcaggaattaaaaagtttggcaattgttgttgaaaaagttaagcaacagaaactctctcatacccttctgatgggagtgcacattacagctgctttgggaaatagtttggctttagagtataagctagcaatcatacttctaggtatgtacaccagagaaacacatgcctaaagtgattgagatagctgtaccagaaaaatcttaagtcgtgtttatatttgctccaaagcagagaccaccctcggggatgagaatggataactaaattatggtatatttactgagtagaatattacacagcaatgaaaataaactacagacacagcaacaacaaaaaaggcaaagaaaaaagcaagacaagaatatatgtagtatgattttgttattttcatctgcttctggtttttatataagttatgtttggtagggctgcacacctaggtgataaatctctaaagaaaagtttggaaatgataaaccataaaagttaaagcacagtagctcatgcctgtaatcccagcactttgggaggctgagatgggaggatcacttgagcccaggagttccagaccagtctaggcaacacagggagatccagcttcttaaaaaaaaaaaaaaaaaaaaaaaaaaaattttccggacacggtggcatcctcctgtg

SEQ ID NO: 78178 - DNA, 1051 bp, Homo sapiens
ttttgaactcctggcctcaagcagtcctcccacctccgcctcccaaagtatgctgcaagcttaagccatggcgcctggcagatctagtgttttttgaaatctcatgttttattctaacaattgatcgaaacattataatctgcttctcaatatggccatgttttatgcttttcacgtcttcaaatacagttgacactccaggaagatgaaccttatcacatttgcaacttctgccccttatacagccccggggctccagccccatgtggcaggcgtgacctaggggaagcctccatctggagaagtgctgcctgcacttggttgcatatcgagtggactgagcccttggctcctctcgctgcttcctgtccagatggcaggactctggtcgtgggccaaaagaggcacagtgtctttgcatataataaggattgaatgaatactttttaaaaatcctaactcttatgaaccaagggatactgacaatgctgggccccaaataactattgttttctcaaaggctttaagaccatgtgttatactgtgatttaatcaggttctttcctaggagtctgcctgagtcacttggtctgtgtgtctctccctccctgtcctaagggggcttttcatgtgtgactgtgttctgcctgcctgtctggtaagaatccagcctcctgttacttgcccaggatgctgactgtgggccctctcccgcagtggaacatttggcatcaggtaccaggaacagagtcagtatgctgaaatgtttgcatgaatgtggattttcagaaagctttcttatcagcagggcacacctgtctgttcgtgatctttgcccttctccctttattggcatcacttggacgatacctttaattgccctgctgggcttgatgttgagctgcttttctccatgtgtgtcgtgttttgtgctttcttgcggcaggagccttttgctttgtttatctgatgcttcccttttttggttttccccgggctttccagctcttggagcacccttttgtcagcagatgtacttttgtttccagtt

SEQ ID NO: 78179 - DNA, 1081 bp, Homo sapiens
gcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgaggtaggcgccctcgcccggcccgtcgcccggccccttctcagccctcggcctcaccctctccttcattcgtttctctaaaaataaacctctagaggtttaaagccctaaagaagtccataaaagcctccgggcccagcttgtgaatcctttagggaggtgcagtgggatcccacgtgtgggtttactgaggcctctgcgtgtctctgacctgccccgcccgtgtcttcccactccgtctgtagagccttggtgcccctcatatgtgttgctgtattttattgaggaacctcacagttccatggaggagatacaccaggaaatgacaagccagtcatttaagggcacgtgtgctggtgtgcaaggatgccgcagagaggagggaggatggggtcagcttaaaggactggacaggtccctacccgagcagaaacctaggccgcatgcttactcagcaggcgtgtgtggaacatgcaccgagcccatggcagccctttgctgctgagtgccagtgctggtaccgctggtggatcatgaaggcaggctggagctttactgcagaatagcatcggccagaagagcaccttgattcaccctgcaggcctcatgttttctggcattgtgctgggtgctggggtcgctgcgggatgccctggtcttggccactgccgtcagggcatgtcggcctgggaaggttgccagctcctcctcccacagcactcaagcctgggctgcacccgagccccagcctgggcacagcagccagccccctgccctgtcacctgccttcaccctcccccttctccatgcttccctctgtggtcttacccactcatcccaaatagtcagctaacctttgcccacttgggggcaaaatgacacttgagcttagtgacagcacaggagacacag

SEQ ID NO: 78180 - DNA, 1810 bp, Homo sapiens
tggtctcttatgtggtctctccatttctccagcaagcgatctatacaatgtattcagttgtgtccagttctgctcttgtcctctggtgacagctgcaccataatggccacctgctccgtgctggctcccggaaggccccagagtctgaatgtgaacctggtcctcctctgccctcatcctgaaattatgtcaaagttaatagaagatgtttagatgctccagagtgatcgttaattatcaagtctaattcattttcttttggcttaactaataaaagataacagttaatgttatttaaattgtgtctcttagtgggggcagcttcttcattctacttctagaaatcaagatggtccttaatgctttctgaagttcacttaagagttcctctcttgttttttttttttaagtggttttgccttgtccaaagtagcagcatgtggagattaagaaatattaatcctccaaaataatgatctttcattttcaggtgtttaaggataattgctgcaagagagaaattctggctcttcagatctattgtcggaatgaaagcagaggttgtgcagagcagttaatgctgggacatctgctggtgagtagcaaagggacactggaaccttttacatgaaggaattcgagtcccttacatccagctgatgaagtggtcagtaggatgtggcactttaagaccatgttgacattagtttttcaaaacacagccaaataggaaagcagtcagaaccacttgagtataagttgttatttttatgacatcattggcagaattgtcaactggtttttaaacactcccccccctacttagaatagagaaaatctgaattggattttaattttggaaggcccattaaaaccttttttcaccatgaaattctacataacttcttatttttttagttagtaccatattttagcttagaaaattatttgaactggaataaaacaaagttcttagcagatattcatttatcctggaagcagagttgacttaattcttcaacaacaatatggtttgagtaatcatgaaatagaatatgaaattcagtgtctcttggcatacttgttactctttgctgtggaaaactggtctaacagcagatgagaaacatttctttagggtttcattgcatagagattagaatctggtatttcagatttagggtttttttcccaattaagaacattgaatggtctgtcttacaggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcaggtgcgggtcctcccattccacaggccttccactcaattcctatatgatacattccacaggccttccgctcaattcgtagataatccgttccacaggccttccctcaactcatagataatccgttccacaggccttccactcagttcatagatattccgttccacaggccttccgctcaattcatagataatccgttccacaggccttccctcaactcatagataatccgttccacaggccttccgctcagctcacagataatccgttccacaagccttccgctcaattcgtagataatccattccacaggccttccgctcagttcatagataatccgttccacaggacttctgctcagttcgtagataatccgttccacaggccttccctcaactcatagataatctgttccacagtc

SEQ ID NO: 78181 - DNA, 1057 bp, Homo sapiens
agcaaaaagccttatgccattttttggaagtcagaagcaagcattagggttaaaagctacagtgtatggccgggcacagtggctcacacctgtaatcccagcacttttggaggcctaggcagatggatcacctgaggtcaggagttcagaaccagactggccaatgtgctgaaaccccgtctctactaaaagtacaaaaactagccaggtgtggtggcgcgcacctgtaatcccagctattcaggaggccgaggcaggagaatcatttgaaccggggaggcggaggttgaacagagccgagatcacaccactgcactccagcctgggcaacaagagttaaactccgtctcaaaaacaaaacaaaacaaaactacactgtggtaaattcagagcaaagattgtgaagcattaagaaaatgggaatattttacatacagtacaagcaaaggtgacgaggggtttttaaagcaattttaactctatagaatagtaattgctgtaagattatctcaagaacatgaattaacttagagacacttcagaaccattttgctcacacatgccgggtggaggacagctcccacattttagggctgccagaagggcccctgtgtggcctctcccaaaggttgcacgtctcacattgcgcttggcactctttctttgagacaggtagattttgcattgacttcacttgatcaggatatgtccagttgggaaaatttcaaggattcttaatgtttctgcatctgtcctgacggggagctcctttagttagtattctgggagtcatctggggctaccctgggctccctggatgtgtggtacgctgatctaaggagccggctcaccttttcacctcagcatttttcaacagcctgaaattttaccactggatactgggtaacagggagaaccagcctcgcatgcccctgactgagcaagagggcccatgtggggctagggccagggactcagggtagaggagggcccagagagccactctcccccagggtgtgccctcccagcaccttgaagctgatgggtgagggcaaag

SEQ ID NO: 78182 - DNA, 1058 bp, Homo sapiens
gttagccagcatggtctccgtctcctgacctcgtgatttgcccgcctcggcctcctaaggtgctaggattacaggtgtgagccaccgcgcccggccaataatttcttatttaaaacattgttaaacctgcatttctgttgggtttctgatgaaaggtgcttttgagctatagattattcttgcccctattccagagatcctgtagattccccgagactcagaatactgataataaaaccaatttagaaaaagacccaacaccgaatttactctagtacactgaaaataacatacatcaaacccagtgtgtcagtgtgtccctggcttaacatgtaatagcgttgacactcaggtttgttattgcagtaatgacactggaagaatacattccaagtttttaaatgaacctggttctgcgcagtcttcacactgcgtttccttgccagtcacctgtcacgtgccttgtgggcgcttcctgcaggggcagccggtctgggttctgaggagcagcaagggcgtcaggctgccaggttcctaccaccttgactctgccctggctctgagaccttccttgaaggttgaccctagcagtggccgcatgggcccctcagtcccttcccgcagtgtccctcctccttagtttcgcagcagggatccattttcccctctgttgtaaatatccacctagagggaaggaccgcctttgtcctggtagactgagaagttgtagaacttagctgcgccctccaggaggatgtgctctatgagccttgggaacacatgcatgctggcacacagaagaacacattcccggctgctgcacccacacacccatcctcccaaaaagagtctgttttctgtgaagaagatctatccctagagtttcctgatgggaatttcttcaataaaagacaaaacttctgctcagtcttggggcatgataaagaaaaagaccaaactatacctcatttgtattagcctaacacatgactctaagtccttaaaatgtaatcctttccattcccttttctcttgttagggcatcataagtaattttt

SEQ ID NO: 78183 - DNA, 1053 bp, Homo sapiens
acttttggttacattaattaaagaatttcttttttaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacaggtaagaatcttaggactacggccagatcaaagggtggaggagcttgcctgtgttccccttaagggtttcttagcaaactctttgagctgagtccttgacctttgcaagcagaaaggcaactgatttctctggcctaagtgaaggcttagaaaaggcagctggactagcacaggcccggcctgggaagccgcaggtcagcgttttcaaactgccttttctctggagagcaagcctccacccctcttccatgcctttgatctaccgttggagaaataagatgcgaagcttgtatttgttaaattagctgtttttattatttaagatttcatattgttcatgagtagttgctgtgtgcaaagtctcacttcctgcagtgaggtgctgtgcagcccagctactctgtgtgagctttccagtgacacgcgctcacccgctgggtttcactgtggaaatccacacgcacctccagaagaacaaaccagtgaacctttgctcccctgaatagaggcgatgatgtaaaggggactgatgaaatgtcgcttctcctgtcttctgtcgtcacaggtgtctgtggggtgcttgttaatagatgatcattgtagatgctctctgcacattcacttactcgtgtgcatttgtgatagcacttcccatgggtgtgtcacacaccgtggaagaatcactcatgtcactgaagggcctgaacttagacggtgtgtccctagattatctggaagagaaactacttctaatagcacagagtcatggcatctttgagaatgccttttctccaatttttgacattggagatgagtcatagtgacttgaattgcgtagggatttattaaattaatttcatttttattatattttgt

SEQ ID NO: 78184 - DNA, 1902 bp, Homo sapiens
gccaggcacggtggctcacgcctgtaatcccagcactttgggagatcgaggcaggtggatcacctgaggtcagaagttcgagaccagcctggccaacatggcgaaaccctgtccctactaaaaatacaaaaattagccaggcgtggtggcaggcacctctaatcccagctgctcaggaggctgagacaggagaatcgcttgaacctgggaggcagaggttgcagtcagctgagatggtgccactgcactccagtctgggcaacagagcgagactccgtctcaaaaaaatgaaataaaataacgagtgctggtgcagctttgctttcctaacctctctgacgttcacctgtctcattcaccaaaccctcctcacctgtggcaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggac

SEQ ID NO: 78185 - DNA, 1150 bp, Homo sapiens
gtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaatgtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatg

SEQ ID NO: 78186 - DNA, 1786 bp, Homo sapiens
tcagcatggtggacccacatcctacagccagaggtgatgttggacaaaggaaggggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagactccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcaggctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctcagtctctgatcacaccgtctcttgcaggctgggccccaggtgagtggcttccctcctgccggactccccgggctgtcctctcagtggctgggcccagtatggccgcctggccaagacctgtgtggccagaggcccgtgcttggtttgctgccctc

SEQ ID NO: 78187 - DNA, 1003 bp, Homo sapiens
caggcaggagccactgcgtccggccccatctgatttcttcactacagagttgctgtcttttgtaatgataattaccatgttatttttgagtgggattagacatcaatttgtgactctcaccagcacgcctaagggccccacgaatcgctggtgtagagcgtgtgtgttttcataacatgaagggagaagagcagttgcgacagttgtccctgagcaaacatttgcatccagctgggcacgcgtgcctccccaggctagggcagcgggtgctcaccctgccctcttcctgttcacagcctgattcggactccaccaaacactcaactccatcgaatagctccaaccccagcggcccaccgagccccaactccccccacaggagccagctccccctcgaaggcctggagcagccggcctgtgacacctgaagccgccagctcgccacaggggccagggagctggagatggcctccagcgtcagtgccaagactgagcgggccctccagtgttgtccaaggaaatgtagaatcactttgtagatatggagatgaagaagacaaatctttattataatattgatcagttttatgccgcattgttcgtggcagtagaccacatctgttcgtctgcacagctgtgaggcgatgctgttccatctgcacatgaaggacccccatacagcctgtctcccacccctgacaacccgagagggcatatggggccctgccaacaccacttcctcagcagaaacccgtcatgacgcggctgcttcggaagcagacatctggggacacagcctcagtacccagtcttttccctagttcctgaaactttcctaggaccttaagagaatagtaggaggtcctatagcattcccagtgtcactagaattttgaagacaggaaagtggaggttagtctgtggcctttttttcatttagccattgcacagtcagctgcagaagtcctgctgaccacctagtcatggacaaaggcccaggacc

SEQ ID NO: 78188 - DNA, 1044 bp, Homo sapiens
tgatggccaggagccaagctacgctgaggggctgtgggggcagtgagcgtgccacccacacagagggactgagcggaagacgcacaccgctcccttgtcgtgtggcacagctgtgtcactgctcttctaaacgtggagaaagccccttaaactccaaatggccaaaggctttgcagtccttggtttcacatccgtggcaccttgggtggagttgcttctgtaagccaacagatgagcaggtgaggagcacagcgcggaccccagagctccctgcaggacgcccttagcctcgcttgcatatgccctcagaccgggctgcagaggggcttcccacgcccccatagcacgggttcctaggggtctagggtcattagtgtggagggcagacaggcagggttgttgcccagaggtcagcagtggtttctgtgtggtttttaatacctacctggaaaccggacttgccatctcctacggaagaattagcctcaccatactgaacagtcggcccctacctgaatttccaaagtgttgagcctgaattagtagctttcaggataatcacatctcatgagagctaaatgaaaaaccagactttttaaaagtcaccttcaacatctgtactgtagtattcaaaatattagttacggaagtgattgtggagcatttaaacattggattgtgtttgtttaaactttgaaatgaagatgaattccagagtgggaacatgaagtctttggtgacgtgaaccagctgagggcagtgctgccgcctctgcacttgttcaagtgccaaggcttggcctccggcccgagggcaggtgagttcctgagccactgtggctcaccccgccctgctccgtctgcgctaggttgcagccccacccacgtcacggtgtacagcgagtatggcgtggacgtctttgatgtgcgcaccatggagtgggtgcagaccatcggcctgcggagggtaaggcggcctcggtgccctcctgtgcgggcgggcttctcccggtgcagtctgtgcgtggccgcgcttactgtccct

SEQ ID NO: 78189 - DNA, 1009 bp, Homo sapiens
tggctagacaccaggcctgtgaggtgcacggccagctccacccacgggcttactgcagtgtgtcccggctccatcccgatggccacaccacagcagacatgtgtgggcagtggggctgggccgtgggcctgcggtgaggtgcaggaaggggccagtcccgctgcctcagcaccccttgtcctggactcttaccccccaacaccctgtcctcttcataggcagccagcacagggtttaaaaccacacaggatttacatttttgcaaagcgtaacgttgaagagggcccaggtcacttagtgcaatgtatttataatcttggccacacgtgtctggcgtagacacctgaagttcctcggttctccgccttggtgggtcttctctcctgcgggcacagtgcagatgcagatgagtttcagagctggtcaaaagtaattccatcacctgtaggatgcagaactgctcattctgcaccctttgctagtgccctgtgtgggtggcctcccctgcccctccccatcccttagggcaggtgttatcagccctgttggagaggaggcagctgaaggccacaggggccgcgtgctctgtatcagtcacatgtcacatctgtcaggctccagagcccatgttcttttcactagaatctgtttcactagaatcttttcactgggcatctgtttatcactgagtcagcaaactagacttcttcctgcttccttgcaagcgaatccccacatactcggcaggcaagggccttcccagaagcccgtgtggagagtggttccctgaagggcagtgtctggggctgcttttgacttggttctcagaggcctcacaggtgcatctgaaatgctccttctgagacagtttggtgaccaggccagtatcttttgtctttcttgcaaaccctgtttgatttccctttttgtattcagaagaaaagtcctgatcttgtagcctgtttggagtctgtgatagaaacagagcagaaggcttttaaaatgcatc

SEQ ID NO: 78190 - DNA, 1029 bp, Homo sapiens
tcctctgtggccggaaccaccatgtgcacctctatccgtggtcgtcccttgatggagcggaaggcagctttgacatcaagcttccggaaaccaaaggctgccagctcatggccacggccacactcaagaggaactctggcacctgcctgtttgtggccgtgaaacggctgatcctttgctatgagatccagagaacgaagccattccacagaaagttcaatgagattgtggctcccggcagcgtgcagtgcctggcggtgctcagggacaggctctgtgtgggctacccttctgggttctgcctgctgagcatccagggggacgggcagcctctaaacctggtaaatcccaatgacccctcgcttgcgttcctctcacaacagtcttttgatgccctttgtgctgtggagctcgaaagcgaggagtacctgctttgcttcagccacatgggactgtacgtggacccgcaaggccggagggcacgcgcgcaggagctcatgtggcctgcggctcctgtcgcctgtagtatgtatatgttttctgttgcatatccctgttgctgcttttcccaccgacagtcagcatgtgttcgattttgctttggtttgtcttccagtcccttagttgagtagtcacagagcatcgggagaggtgggccccatgccagcccgcagcagagagcatggttcagatctcacgtctcagaccagcagtaggcgggctcagcaacctctctccctgagcacatggggccggttcttccagaggcctcagcagaggaccccgtcggcgggcataggcccctgggcagaagggctcggcgaaccgagaacggggcgtggcattcatctctcatttaaaaggccttcctcgtgataatacagaaacttacacagtagtaaagacaagcttgaggggttttggtggccagaaaataattcacctctggtgtcttaagttacagtccctctaaggacaagtattttctgaaagtggtaggggctgtttttcaaacagttgggtcactga

SEQ ID NO: 78191 - DNA, 1033 bp, Homo sapiens
acaggaaattaccatcattgttactggaacgatggtcatttggtagcatgcgtgctcagaggctgctcacagggaggcatgatttgggccagtgtttttgagatctgcttttcctggacacattttcagaatctacttttataatgattattcaagaaagcagatttaaagtaggcagctactcgtagttttgacaaaagcagaattaacgaaaatgggaccaggaagcgatctcacggggctgtttagaaccccgccccttccgtgtcctgccgcgggagcctctgcaaggcgcccagcgaggtggagtcaggggtccctgcctgggaagcacatcagcccccgttgctcctggggtgcgtggctccagcagggccgtggtagctgcgtgcggctttggcgtttgatgacttctctcttctcttctgtttcctgtcatgaaggtgacggcctctctcttaggtgcaccttctaagaccagctcgctgctcattctgacagaaaatgagaatgaaaagaggaagtgggttgggattctagaaggactccagtccatccttcataaaaaccggctgaggaatcaggtcgtgcatgttcccttggaagcctacgacagctcgctgcctctcatcaaggccatcctgacagctgccatcgtgggtacgtcccaaaggttgtgtccttcaggtgtctgaagcaacagcacttccggcggcgctgcagtgcccatctgaaaatcagatgaaggtcacaggtccatttgggtttgtagacagtttctccatgcatgttaagaagcagacgaggccgggtgcggtggctcacgcctgtaatcccagcactctgggaggccaaggcgggcggatcacaaggtcaggaggttgagaccatcctggctaacacggtgaaaccctgtctctgctaaaaaaaaaaataaaaataaaaataaaatatagctgggcgtggtggcgggcacctgtagtcccagctacttgggagactgaggcgggagaacagcatgaacccaggaggc

SEQ ID NO: 78192 - DNA, 1056 bp, Homo sapiens
ctgtgaggtgcagtgaccaatagccatgcccagccactcttgaaagcagccccttgctgcggcaggtggccctggtgccagtcctagggggcttaccctcctgggcactgaggccatcaggtcggcgcagccgctgttctgaatggcctgggcatcctgaggcctccacgcagacgctcactcagagtccatcctgggctgagtgtccagccagtgggcagaagctcagtctgaaagccactgtgccaggcccacctctacgagactgtcgggctgcgtgtaccacagcaccctgcatggggtggacacagcgttggctgagctgccagctttccctggcaccgtctgctgccacgcatggacccctccccagcaacgccttgagccttcttgggcaaacatccctctgtccaaacagctctgccgccagcctggcagctggaaggagattgtgaacgagtgtaatggggcctggcggcctgcctggcctggtggaacgtggccactgtttgtttttattcataggtcccaaagcccacgggggtgaagaagggatggcagcgcgcatatgcagtcgtctgtgactgcaagctcttcctgtatgatctgcctgaaggaaaatccacccagcctggtgtcattgcgagccaagtcttggatctcaggtctgcgtttgggcagcactgtccttgctctgtgaatcttcctcagctatctttagccaaaaggacggtgtgttccttagtagtctttcacctcattagtacttcacctgcttcattattgtatggttgcaaaaatgggtacagcttagtcatgacttcaggcgctcacatgcgtatgaacagacatgcatacgggcctgcgtgcgcaggaacgggagcgctgtagacgcttcctgcctcgcatgtgtttgcgttgagaagtttgccacaggggaattaatttaacataagaaaaccacatgcccaagaacaagcagaagatatcccagagaaaagccacgcggcccacagccgtctgtgcgttttagagaccgcagcaggtgctggtgtg

SEQ ID NO: 78193 - DNA, 1051 bp, Homo sapiens
aacttctatgaggctacctaagggtttggcttttggactaagactcttgcagagtcagggaccaagtcgcgaggtcgtttatttggttaccatatttgatagcaactctgcagagtgctggtgtgtcactcctagtcctgatggcccggccaccgccccacggcctccctgcccacctcagccagcctcttcccccacagctctctggagtttgtgtcggtcactcccctacttcttgcaagtggtctcacccacatctgtttcctgctgaggatcgtattggtctctgctgcgcctgagcttggtaaacaggcggtcccgcatggcctgcaccacgaccctctgttcagccttggggctgctgcagttgccgctgggttcacaatgtgtccactcctgatgagggaccgtgagcctttccaggcgtttgctgttatgaactgtcctcctgtcggtgattcttgggtgtctcttggacacatgcaaggcctgtgtgcagcccaacctaaatgtggccccaggtcggcccccaagagccagttggtgctggtctccaggaggccaggagcatgagccagaaagagcactggccatgccacctcggccctctggcccagctgacctcgctttttggtagcagtgctctcccactgaaggaagtatttgttggcctctctctggctcaggctcgtaggtggttttcaccactatttgatgagccctgttagggaacacgtagaccaagaccagaacttgcacatttccaccttttcaggataatgcccaagctgtgtataaactggatcacaggcagatggatctgactctcaagagtccatggttcacctcagtgttcttgattttctccttccagccaaaagctcaccagttcagcatcaagtccttctccagccctactcagtgcagccactgcacctccctgatggttgggctgatccggcagggctacgcctgcgagggtgagtgtcgttgcagctcctggggtcagcgtgcacagccccacacccctgcagctaagggcaccagccgg

SEQ ID NO: 78194 - DNA, 1049 bp, Homo sapiens
aaagtgctgggattataggcatgagccaccgtgcctggccgctaatccctctgtgatttaaatgggaaggcatttattgttgaacagaaaaaaccctccatcaggggctgggtctgttagagcttccagactcttttgaaaattgtctttgagaaacttcttatcccacgctgcctgcatgaaacatgttggtttttactagaaacagtttgtcaccaagattaagtcaatatatcttcatgccagtgttgactgggtgggaaatgatgtttgttcctcctgtctgttacctccaaggactctctctcctcctcgtctgcatcttccctgctagccttttgggaagaagtaagtggctgccagcgctggcttcccgcagctttcactcctgttagtgcacagcctcctcaatgttcctgttcctgaatctgcatccctttgattaattaaccaactaaatgaaacgagtggggcttttacatgcctaaaattaatattctttttctcatttatctaaagatggaaccgtaacacttaacataccttgtttatggggcagatttgcttacatttttgagctttggtaattagccagtcgagctagcctttcccttgtgaatttgcagtacacagttgtgtgtgtgttttatgtgtgtatgctgccatcccatctgaatttggctccttcctcagtggcctaattaattgcaactgttggaaagtgtttatctgatttggttcattgggattctgatgtggaacacaaaatacagctgtcaatgctttaggcgcctacccagccatgtctgtgtcccatcacactgcttgctggtgctaacacttgctactcagcatacctacatgtgcgtctgtaaacagcagtggcctgtgatgataaactattagtttcaggaatacttgttgaaatagagttgtttttaagtggtttcagagtgtagctttagcttcaaataaatcactgtgaaattagaactcttaatttgttaaaacaaaacattgcttccctgtgtcataaaattttcaaggaa

SEQ ID NO: 78195 - DNA, 1011 bp, Homo sapiens
tgtctaactttggttccataaaccataaagtcttatctcaggtgtttttgtttgctgatttaaaaagactatctttcacctcaggaagattgaaaatgctaatgaaatcgctaaattttcagtagatcaaaaaaacctgttgcttggtttcccagctgtttttctgatcgaggctctctgaagagcataatgcagtccaacacattaaccaaagatgaggatgtgcagcgggacctggagcacagcctgcagatggaagcttacgagaggaggattcggaggctggaacaggagaagctggagctgagcaggaagctgcaaggtgagggcagcgccggctccggggccaggcgggggcgctgcggccaggctgcacctcacgctgtctctccatccctcagagtccacccagaccgtgcagtccctccacggctcatctcgggccctcagcaattcaaaccgagataaagaaatcaaaaagctaaatgaagaaatcgaacgcttgaagaataaaatagcaggtatgtgtttaaaagtgtgacttcttagtctctatttttggtcattactgtcttaaaagggaatttcagagtccttttcataaagtgggaaagcagaaaaaaagcttaggctttagcaagcttatttagagttctcaaattttggtcagttgtttttttttagacggagtttcacttttgtcacccaggctggagtgcagtggtgcgatctcagctcactgaaacctccacctcctgggttcaagcgattctcttgcctcagcctcccaagtagctgggattacaggcatgtgccaccacacccggctaattttgtatttttagtagagacagggtttcaccatgttggccaggctggtctcgaactcctgacctcaggtgatctgcctgccttggcttcccaaagtgctggaattacaagcatgagccactgcgcccagccccaattggcttagttctaatgatattattttatagtcaccagctagaa

SEQ ID NO: 78196 - DNA, 1011 bp, Homo sapiens
atttatttgcattgaattttgcattattgaggtttttaaattccgttttgtttcgttagagacagggttggggaccatgttgcccgtgttggccttgagctcctgggctcaagcggttctccggcctcagcctcccaagtagctgaggctacaggctcgaggcactatactcagcttgaattactgggtttaaaaaacacgatcattcatcagttttattctatgattatttcattttctgcctccgctatattttagagaaagtagttggaaatatgtgattggagatgccctagggtttccttcagcacctccttctcccctaaggtgcagtcctccgtggccgtgggcacacctgactacatctcgccggagatcctgcaggcgatggaggacggcatgggcaaatacgggcctgagtgtgactggtggtctctgggtgtctgcatgtatgagatgctctatggagaaacgccgttttatgcggagtcactcgtggagacctatgggaagatcatgaaccatgaagtaagacgttgcattttttttttttttttggtacctggctcaggcctaaagtacagagagcacaactagtgcaggaagatccgttaggaagcaacgcgagtagttgaggaagaggtgacggggtttggaccaaactggggacaggcagattggagtagacattggagagggcatccagaggcggggtcggcaccaggagatgtgggcgccagaggaaggggaaggaggttctgagggtgacccccacccccactctcaggggaaggacgctggcctgctccaagctggcttcctggagggaaggcaggtttctgtagacagacgcgtcgtctgcacaggcgcatggagtgaggcgcccgggggtagccagtggggaggtccaggtgggccctttgacctgtggctctagattcactggttaggtgccaactttgattctcaagtctgttccccagaaatcagtccctgtaaatgatcatgtgt

SEQ ID NO: 78197 - DNA, 1081 bp, Homo sapiens
cagccagcttcctccacacgtgtccctctgtccctttgtcccattcctgttttccgtggtactcagcacagagcttgcaccgtgtgagcctgcctgagacagcagtgcctatttgtgtttgcaagacctcagctcgtgtgcaggcttcatgaaggcaggggcagcgttgtcacgtgcataggtgggtgggctggagagcagtgcctggcaccaaggagatgctcaggaggggctcgttagctgggtgggcagacgagtaggaatcgtcacagggcctcgccagggtaactggggactaaacgaggggcagtgatacgacttcggctgccaccatgccagctgaatgtcacacagaggcatttgtactggatggtgacagctgttcacaagaggatattagcatttattcatctgatcaccactagttaagggctttgatctacctaatgtgttgcatggagatggttaatttgtgtgtttattttacaaacagagacattaaacctgacaatgtccttttggacgtgaatggtcatatccgcctggctgactttggatcatgtttgaagatgaatgatgatggcactgtaggtatttttgttggagattttccatttggttttgggtttggcatatagtcagaagggaagttttcaatttgaggtacaattaagaaaccaagtatattaattcagaaaatgaatccattttggagatagttgaaattttctgtttggggagttttgtttcccaaataaaaattaagttggaaagcatctttattgctttttatgtttacaaaagtaatatgtgtgccttccagaatgggagttgtcaggtttcctcaatcccaaggtggctaaaagcatgccagccctgtagcagatcgagggcgctccctgcttcttccttaaagggccctgtccaggctggtcgggtgggcaggcattaaccatgtaactgtactttctcacttgtgttggggcaggtaacttcctgctaggggtttcctctctatgggtgttgtagacctagaaatagagtcctaggtgctcagtgttacggggccagctgacactcc

SEQ ID NO: 78198 - DNA, 1028 bp, Homo sapiens
gttggagtgaacctataagtaattatctttcggctcttttatgatataatctttccaataagaactgctgataccatgtgtgatgttaactactttgcctcccttctctggtctggtgtcgtcctcacataacatgagggcctggagaattatttttaaacccataggattgatgggctattaactgtgcttctgctttgggtcactagcttttagagtgccctctccaacctcaagccctttcatcattcctcccattgattaaatacatcacttactgaagtccactctctgccatatgcacccctgaagatggcggcgtcgtggacgcatcggggcgcatgttccagaaggagggtcttgggtgacagaagagcagctgagatgccacgagccagacctggagcctgagaacctcgccatggaagactggcctgtaactgtcaggtttagtggtgactaaatgtggtattctctccccttctctttccaatttgtagtacttagtcatggattactatgtgggtggtgatttactgaccctgctcagcaaatttgaagacaagcttccggaagatatggcgaggttctacattggtgaaatggtgctggccattgactccatccatcagcttcattacgtgcacaggtaaccggcttctgatatattttatggaaaccacgtttaattgttaaaagactcctttcagagctcccaagtccaggccgtcccaagaagccatgtaggtagcgagtccccactttgagctgccgcagcacagactgatttgcccacatcaccgtcttccagccccagcagccggtggatcccagctctcattgttgcagttgtcatggtctgctgtcagccgaagccactgtgtcttttgatatttatttgacattgactcaacttctccccgtctgagaccccctccctaaaatgcctgtgctccctggggctcacgtgggccccggggtcctctgtctctaccgcccaagaccccctccctaaaatgcttgtgctc

SEQ ID NO: 78199 - DNA, 1015 bp, Homo sapiens
cagctcagtagtgggtataggacggagagggcagacacgtggggctgcccatgccatcgatacttggcagaggttgatctggtagaggagtcaggaggtgccaggtgggaggagcccagtcaggaatccacataagggtggggtgaatctaagtgtcagccacagaaatggtgcccgtgggacagcagggtgcaagtgcctcctcagcagcccttggcacttgcacggggcttgggagaggaagggatgagggatggctcagcctcagcagcctcggggtggtgcacgaggaggagcccggaaggcagggacaccgtggctggagccactgtcccaggagggaccccgagaccggcagtacgctctctggcctgcttcccagtgaacacagactgacacccctcgttgctttgcagaccgcgtgcttccgagaggagcgcgatgtgctggtgaacggcgactgccagtggatcaccgcgctgcactacgcctttcaggacgagaaccacctggtaggtcgcacagccagagactcggtcagggcattcgctccggctttattcctttatgctgtcactaaaaattcagtcagacaatgtggaactgacatttaaaaaatgtgtattggactcgataaaacggcggggcttgttttcatgcagtaattgtcaggtagaacttctttaaaatacacatgtggaagtaaggactttgtttttttctaatcactagagaagctgattcgtttgtttgctgggtttattacatttaaatcagctgggagtttgaaacactttcaatcttggattattgagaataaggaaccgcagtggggattaagccacgtggatgtttttgcctccatctcagctagggctgagtccgggagtgcctctcgtgggcctgcagtcctcctgtcttcccgcggtggggggggtgccccaggccctttcgacaggttttaggtgactcttagtctccacgctgcctgtgtatttttccgatttaaacaggg

SEQ ID NO: 78200 - DNA, 1036 bp, Homo sapiens
aatggtgcagacatcttgacgggtgttggtagtgatggcagagcttattcaagatttggtagaaactggaaagtccaagaggacttcctgaaggaggtggcacttgaattgttctttaaagaatgtggctggtggccgcgcgctgagtgctgactgtgccccacagtgtgctgggcacattaactgtcagtgctcatgggtcctcataggtgtctcaggagtccggtcctgccattaacctcctgtagtggtggaacccgagccataaaggggtgaatttgcaggagtgaaactccggagcccacgtggccggtccctttctctgtgaagaaaaggttcttgatgcaggaactggcacatgctaggtgggaaacttggctttcggtcactgctggtttcacaggctcctgggctgttaggatttcactacagtttagctccagcgtgctagccttttgttcaagaaccgcatctttgttcaactcacatttgcactgcaggttgctgttgtcaaaatgaagaatactgaacgaatttatgcaatgaaaatcctcaacaagtgggagatgctgaaaagagcagaggtaagtatggagcttgaaaagccatacaaatggggcttggggtgagcagaaagtgactgtgaagccagctggggaaaagctgcagccaccccacagccctgggcctccctgccccccggacagagcgagcactctcttttgaggaggtctcagtctcctccctggcgcctgctgctccccgcctcagcgaccacttgcttgctggacactgttcctgagagtgcaccctcgagaatgttggcgggtcctgtttactgtaaaggcaaataaaaagcatcgggagagtttcagcattgattgcagttctgctccatacacaaaaggaattaacacgtttggaccctgctcacatacagaataggtctttagattcccacctagaggatcctcacgattagaaatgaagtggaccactgcccagcaggctttgatcagctcctttttcttagttc

SEQ ID NO: 78201 - DNA, 1097 bp, Homo sapiens
agattacagtcacccgccacaacatccggctaatttttgtatttttagtagagacgagatttcaccatgttggtctgactggtttcgaactcttgacctcaggtgatcctcctgcctcagcctcgtaaggtgctgggattacagccatgagccaccgcgcctggccatatttatgtatctaaacataggaaagatttggtaaaaatacagtagtataaatcttgtgggatcactgttctgtatgtggtccgtcgtcggctgcaacagtgttacccagtgcgtggctgcaacagtgttacccagtgcgtggctgcagttgctcaggatccacatctgtgtccattggtataagtgctcactttccaaaacatgtcagatattaaatattttcaaacaaacttttttaaaagtataacttagtgcaacaccccactcaattaaatttttatatagtatgaactgattagactaaattgttggttttactgttttacttgtagctaaaccatttacacagctggtgaaagaaatgcagcttcatcgagaagactttgaaataattaaagtaattggaagaggtgcttttggtgaggtaagataaacttcattttgttaactttgcctaaattgccaaaacatcagcagcttccatttcacctttttgtgcacctatacattggtttggggatgaggtaattagtattatttggagagtttgttttttcctctctctctttctaagatgaggtctcaccatgttgcccaggctggctttgaactcctgggctcaagtgatctccccgcctcggcctcccaaggagctggggagaaaatctgaaagatagaatgaagagaaaggagactcgaaagcttctgactgacctgggagattgttgggaccaaaaatagtttcttcagatgtagttttttttgtttttgtttttgagatggacgtcttgcactgtcacccaggctggagtgcagtggcgcgatcttggctaacggcaacctttgccttctgggttcaagctatcctcatgcctcagccttccgagtagctgggactacaggtgctgacactgtgcctagctaatttt

SEQ ID NO: 78202 - DNA, 1038 bp, Homo sapiens
ttaatgatgcttaaaatactgcatttataatttgagagaaatattctcagtaaaatgaactttaaatgttttcatttttactgttttttaaatgtgtatttttaaaatgagataaggtctcactagttgagcccaggtttgtctcaaactcctggcctcaagtgatcctctcaccttggcctcccaaaacgctgggaataggcatgagccatcacgcctggccttaaatgtttttaaaaataaagtttggtatggagaattttaaatgtttcttgtttgtcctaaagcgttctccagtaccacattggaaaggaagacttagataaacattttaacagtaagagagtcgccatcttagactttttgaaagtccagtcagtccaaagggcctgtatcaatcagatgcaggagatggagacagatatgttacgctgaatactgaagctgtttgccatggcagctttgtagaatccgtacagaagttttatcagctcataaaactgctttatgacccagaaggaatgccagcaataaaacaaacgtactcatggcaaatacaccaggcgtggggctgattttcctgccgcaatgcacttccagtgaggaaactgctgtgtggtttggggcaggagcttgtagtgatttcgattcaatcttcctgttttgggtatttgtaaaaggaaactaatttttcagaaacttctagctggtatcccatgtcactcagccatcctctatttaaatattattgaaaatagtgatgagctcatgtatgaaaatgtcattcttccttttttggagtctcttgagttttttatatggtggtatttgtgtaatgagtattaataaaagtgatagtaattggtaatatttcctattcaaatttcaaagtttaaaatttcaaataggaaatttcagatacctttagaagtagagcagctgggtgcggtggcttacacctgtaatcccagcactttgggaggccgaggtgggtggatcatgaggtcaggagatagagaccatcctggctaacacagt

SEQ ID NO: 78203 - DNA, 1047 bp, Homo sapiens
caaggtcagtagttcaagaccagcctggccaacatggtgaaaccccgtctctactaaaaatacaaaaattagccgggctggtggcgcacgcctgtaatcccagctactcaggaggctgaggcaggagaatcacttaaacccgggaggcggaggttgcagtgagccgagattgtgccattgctctccagcgtgggcaacaagagcaaaattttgtctcaaataaataaaaaaagttaaggttaacagcacttcccaccatgccccatggggtgattttcttttaacatcatttaacttttatcaatgtaatgcatttacttagttttggaaactaagcggtactactgggttgtagtgcaagacagcagtccctctaccagtcgcttgctccgcgctccaacttcccacagactaccacttttaactgctctgtttctacttatcattttagttaggatcacatttagctgccagtaatggagaacaaagtgacagtgacttaaataaaatcaggttgatttctctcacgtgaagttgacgtgtcagcagtcagtgctagttggacagccttgctccaagaggcctccggggctgtggccttttcccaccctcaggccaccatctgagacggtggccatcccaccctccttcagccaagcaggccgggggtgggatgttactatagaagatccttggatattggtgggtgcttagcaatgcctgccttaaatttcatatttctgtgtagcatgctggtactgctaatttctgattttaccattttagacattgctgacttctgctgtagaagaggccttagaactgttctacattgtccctccactgcctgaaacacattcaccccttgctctttttctgtgttccaaatatgtttatataattttgtttaaattggtaattcagtgtctgcattcttattgttaggtaactgtcttcacagctaagccatgtaagatacagtttactaagggaaatagttttgtgttattggagtgaattttctttattttcttttcttataataat

SEQ ID NO: 78204 - DNA, 1089 bp, Homo sapiens
cgtcagaccaggagggaggcctcaggcttgatgctggtgtcacagaggcggaccgtgggtttccagtccccagtccgggcatcttctctcgagatgtgcttcctcttcatgaatagaattaatcctcctagtcttctgggtggttcctcatttgtggcttttctcaccatgagtgtgatagtatcttctcacggtcctcctccatggatgtgaatgcccatagctgttagtgtgggaatggccagcccaaggtgtgagtgggatgatgccaccgaatttaataagtaaggcttaactgacacggtgctaaacatctcataataaaaagtgctgggattacaggcgtgagccactgtgcccggctcaaatacatttttatcttaatgatttctctggatagaatatttgcataacatgggaacactttttaaaaataacagacttaagaaatagatcttttgagtaagatctgaattatagggaaatgttaggattgcatgataaaaattagtttaacctaatttagatcatgtagattctatggtagctgtttgatactgactataatagcatgagataggacagctgaaaccattaaacattaacaacccagccctaccttttctgtcttaaaacttcaggccgggtgtggtggctcacacctgtaatcccagcactttgggaggccaaggtgagtggatcaggagtttgagaccagcctggccaacaaggtgaaaacccgtctgtactaaaaatacaaaaattagccgggtgtggtggcacgcatagtcccacctacttgggaggctgaggcaggaggatctcatgaacccaggaggcagaggttgcggtgagctgagattgcgccactgcacaccagcctgggcaacagagcaagaccctgtctccaaaaaaaaaacaaaaaacctcttccttccatgacagttgggcttcacagtgagcagcagtgtctctcttaaatctagacttcaaagaaataaaattggatttgaagaaatagttctcacttcaggataccactgtgtgagctacctgaaaaagtttaaaatgtgcagtgaattgcccttc

SEQ ID NO: 78205 - DNA, 1183 bp, Homo sapiens
cccctcctgggtgacagcctgtctacatccccttgttggtcagagcctgaatacctactttgctgtaacaccttcaagggaattttaaggttaaggctttattttaaataaaccgtgcaagaggactttttttttttaattccaattctgctagacctttgtgatatttggaggggtagctggagctatcacttagaaactttctcatctgaattttgcatgccttctctagttcgttccggatctataatgttttaatcattggtcagctaacctattatgcttttttaggacaaaaatttgattaaaccatttaacgataattaggatcctaaagacaggtaaaagtgcagcgtgaaactcttttacttcatctctccctaacgggtgtgccggtcaagaccctcagactgtctcacctaaaaccactgagtaggaggaggaaatgcgtatgttcaggccaaacctatgaaaaccttatccttgggtcatttgcgtcactgggctaggactgttcagttcgaaccagtaatttctaatctttggggctgataaagctgatatttatacgaagaaacaaatgaaagtgttccacagtgaggcctccaggcctcctactctactctgccagattggtgactggaatttggaattttgtttacaaataaaacttaagttgcaatattctttagagggcttctgttggattactctgtagtgaaatgttacacggtatcttgtgagagcagcagtagaaagaggtcctgagatcaaggacagcctgtgatgctttatttccgtgggaaccaccattcttggttacttatagtatcagtaaattaagagtatttgctttctagcgtcctttgtcagtgacacgatttccaactgaataattaattgacttcaccgttgctttgaaagtgaggtctttggtgcatgttaaaatctgaatattttgtttaccttttctttcttttctttggagacgagtctcactgtgttgcctaggctggagtgcagtggcatgatcttggctcactacaacctccatctcctgggttcaagtaattctcctgcctcagcctcccgagtagctgggactacaggcacgcaccagcatgcccggctcatttttgtatttttagtggagaaggggtttcacagtgttggccaggctggt

SEQ ID NO: 78206 - DNA, 1041 bp, Homo sapiens
cgctcctagtctgcggcggcggcggcggggagggcgcggccgcgggcggggctgagggcggcgggggcgggccgcccgagctgggagggcggcggcgccgaggggaggagagcggcccatggacccgcggggcccggcgccccagactctgcgccgtcgggacggagcccaagatgtcggcctaggccggggcgcgacgacgcggacggggcggcgaggaggcgccgctgctgccggggctcgcagccgccgagcccccgagggcgcgccctgacggactggccgagccggcggtgagaggccggcgcgtcgggagcgggccgcgcggcaccatgtcggccaaggtgcggctcaagaagctggagcagctgctcctggacgggccctggcgcaacgagagcgccctgagcgtggaaacgctgctcgacgtgctcgtctgcctgtacaccgagtgcagccactcggccctgcgccgcgacaagtacgtggccgagttcctcgagtggggtaagtgcgcgccggcagggccggacctgcggctctgcgacccccgcgccccagcccgcgcatccccacgcccgcccatccccgcccggacagaccctgccgccctcctgcccacccagctcgtgggcttcgcctcctctcgctctggcagcgcccccaggcccgcagcccatctctctccagccgctccttgcaccctcgtccctccgctagcttttcatccctccttgccctccctaggctcgacatccgcgttcgatcgtcccgccccctcatcctgccccttggagccacatcctacgttcccactcccaccccctcccccccgccgggccctcgccctggcggcttcctagatccaccctccgagtctggatatcatttcctgcagcactcactgggatatccgcccccgcccccgcccccgcccccgcacctcgcctttggggtccggaggcagtgtggaattagttccctttccccaccccacgcttctctgcgttgtgggggcagctgggtgtgctttctgcatct

SEQ ID NO: 78207 - DNA, 1014 bp, Homo sapiens
ttgtggcagagggagggggcccggcttagaccctgagggttcctaggcccggagacaggaagtcagggttttcctggcaggaactgtgtgcacatgtgcacctgtatctccatgccaggagggtgtgtatgccatgtgtgcagatcctcctgaacccagcggtggctggggctgggacttcccaggccaagccaggccgagctgggggtgggatggcagctcctagaggatgcagtcagggaggctgggggcagaggcggggctgagaccggggcaccctgggtgcctcagtcctggggtctggccactggcctttctgctctaaggggtggaggctgagcccatgagaccttgcaatgagcctgcagtgcttccttggccatctgttgtccaggccaagcctgcagggtgccggtgggggtggggctggctctcagagaggtacttgggttctcattggccaggtcacctggctgataagtgtgtgtgtgtgtgtgtgtgtgtctgtgcacgtgtacctatgtgcaccagcccctgtcagcacccccaggatggaggcccttgcctagtctcctcactcctctcagaaagcaggacagcctggaaccatcctacttgcccccaagctcagcccccaggccctgcctgccggcccctggcccgcagccttggccagtgcctgttccctgctgcatggcccaggtctcctccctcttcagggccagctgggcttcccccagtgccaccgtggcctggggctcctgcatgtcctggggttccctctggtctctgtccctgagcttgaggtccttgagactgggtctgctctgtgaatcttctggggccccaccccaggcccaactgggagggcagagagaaaccacagagaacccacatgccccagacccgcacactctggtctgcagagatgatccactgtgtgtgtgtgtgtatatatgtatgtatgtgtgtgtgtgtgtgtgtgtgtgtatgtgtgtgtgtatatgtgtgtgt

SEQ ID NO: 78208 - DNA, 1050 bp, Homo sapiens
actgctggaggccacattcctgtccagtgaggcggtgagtctccacctgggccagggaggggcagggaggcagcagaggagaggctcggagacagacaggacatgggcagggagcttgacgggtcttccaggtgagcgaggtgagggatagtgccccagtgacctgcccctcctcctccaggccaatgtgagggagttgatggaccgagctctggagctagaggcacggcgctgggctgaggatgtgcctccccagaggctggacggccactgccacagcgagctggccatcgacatcatccaggtactgcaatctgccccagggcacacgtaccgcccgtgcacgtgcatggggagccccacgcacattccgtcctgtgtgcatacccatgcccacctcggggcaccccctctgttcccgcctgtttcctccccgtcccctgcccccttgtccaggcgagcccctgctcagctcacccaccaccaccctgcagatcacctcccaggcccaggccaaggccgagagcatcacgctggacttgggctcacagataaagcgggtgctgctggtggagctgcctgcgttcctgaggaggtgggtgtgtgcccaggatggggtccctgtagccaccgctctcagagccacggcccctccctagtgcctcaggtggggagctgagctggatccccgccctctacccctgtccctgtcattctgagccaggagttgtttcccactcagccagggcactgagagcctcaggtggtctgacctccaccaggattcaacgtgggagcctcttgcgcccaccccatcagcaaagctctcagcagagcagcctctagcttcaaagaggataccccaggagggactgagaccccgccaccccttcatacaacactcctagtctccaccacctgaattctctctgctctctccctctcgacctctgagggcttctccagccaaccacacgctcactcctacctggtctcccaactctagagagggcctgggagcagcagagatgggctggtaccctcttcagg

SEQ ID NO: 78209 - DNA, 1004 bp, Homo sapiens
ggcctggctacaaggcttcaagggaggtggcgagctccccatcagcagacagctcacacgcccctggctgcttgccctcccaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacgtaagccgctgcccacctctcccaagcccctctgaaatggctgcctcttctcccctagccctttcagggtcggagataggccgctggtgcctctctaagcccaacgagtcgctgacccgagcctctggacccctgggtccctccaaccacacccactcctgcagggctccccggcgacctggctgcagcctgctctccctacgctggccgagatcattcgcctgcaggaccccagtgccatcaagattgaggtggccacttatgccacctgctaccctgacttcaggtgagaacctggggcacctcaggaccactgtcacatcactgtggccaaggcctcacagggctggcattgggaacccagatcctggcagctgcccacgtgccagtcactgtgtgaacctcaccaggggctcattcttgtggccttcaccacagcactacgaggacaatacttcccattcccgtttcacagaggaggcctggagagctcacaggatgtgtccaaggtgacacggctagttagtgtctggctgcatggcccacactcttagctttacctgacactgcctctcacaggggagactgagaccagagaggccagcttcacccagcctggggggcctctgcggcctaggcctatgctctgggaccagggctcatattcgggagtggaggcttagcccttggctgcctgaagttctggtgggccagggacattgtttcttcctgggctgggtcctctgacatgttagggtaagtttg

SEQ ID NO: 78210 - DNA, 1001 bp, Homo sapiens
tttcagaagagaaaccatgactaatatatgggctgctttaggaagagctggtctagaatccaggtgttagacaattattttcagggctctcttctacctccctgccagctagaaacattttttattttcagataatgtatccttccaagtttgaatttgaatctttttttaaacgtagatacatttgtttaattttgtgttactgcccagatcaagtcagctcctagtacttttctattttaatgatagctgccacctcccaacaaaacccagcattcaatgttcaacagaaattctgatatgcatactatgtgcctacgagccttttaaaattgcaatgacagtgtttttatttggttctttggattaaattgtctaaagaatttattgtgaacattattgtatctctgattctgttggccttctatgaaattttacacgtcttgagacagacggatttttatctttggttctcaggttattaacatgtactgtgagaatttagattgttttagtagaactctaacccggggcacaaactggcaggcctgggatgagcagggcctctgtaggcatgtcatgctcgccagcactatgcttcaaaatacctttttccaggccgggcatggtggctcacgcctgtaatcccagcactttgggaggctgaggtgggtggatcatgaggtcaggagtttgagaccagcctcgccaacatggtgaaaccccgtctctactaaaaatacaaaaattagccgggcgtggtggcacatgccagtaatccctgctccttgggaggctgagacaggagaatcgcttgaacccgggaggcagaggttgcggtgagctgagatcgcactggagagctggagactgcactccagcctgggtaacagagtaagactctgtctcaaaaaaaaataaaaatacaaataaaaataaataaataaagtggaatgagaaaataaaaaacttgcccaaaagaatgatcaagttctctaggg

SEQ ID NO: 78211 - DNA, 1058 bp, Homo sapiens
atcttttgctattgtgactggcgctgcaataaacatgggggtgcagatatctctttgataatattgatttgatttcctttggataaatacctagtagtgggattgctggatcatatggaagatctatttttagttttttgagaaacctccatgctgttttccctaatggctgtactaatttaccttcccacccacagtgcatcagagttcccttttctctgcacccttgccagcatttgctattttttgtctttgtggttttgatttgcgtttccctgttgattagtgacattgagcattttttcatacatgtgttggccacttgtatgtctttcttggagaaatatctattgagatcgtttgtctatttaaaaatcagatttatttattttttgtcactgagttgtttgagttccttgtttattctggatattggcacctaaaaattactcttaatcataccatttgttaaatgcttatcatatcctaggagttttctaagttcttggaatacattatcttatttcccaggccctatgaggaattcgtatttccattttacaaatgagcgaaccaaggcttagtggaaaaaaattaagcaacttacccaaatcatgtacctagtaagtggcagagctaggatttaaagacagctctgtctgatcccaaagcctgttcccttaaaaattatgtggcatggcctctccagataaatacaaaaacaaacaaaactaggcattttacatatgtaatcccattctttaataatcatgtaaggagatgttgttatacccattttacaggtgaggaaagagactcaggaaggttaagcaattttccccaaagtcgcctccctaataaatgatggacagcgtttgaactccagcttgtgtgacgccaagctcattgcacaattccacttcccgtttctggatctccacctcatttggctgcattattttccccagtcaggtgctcacagtccgtgcactaatggacacttggtgcttgtcaaaaccttgctgaatgagtgcatgaattgcacacctcagtgcatg

SEQ ID NO: 78212 - DNA, 1007 bp, Homo sapiens
accctgaagtttgaagacctcacttgactgatggagcgagagccccgctaacctgcactctggtctctaaggtgcagtcatcgagaagtcctgagcggccgtgcaggtttcccgatctggaaaagagaaatgttgctgaggacaggatgaggtagataaggggctgccctttgttttggaccagttgcatttgcactgaggttagaattggcagctatgttgatttttatatcaaaatccaagatcgtgcttccataactaaaagctttataaacaacttaaaaattggcagtgttggtaggaagaaataaaggcacaatccagaattgagaggtgatttgtgtcctttagggcagggacttttataatcccgcagtgtgtaccttggtgtatagttgttaagccaagtgcacagtgccttgtgagtaccagggttcccatcagacaaactagaaaaggggatcccagacatgctgctgctgtttcactgtggagcatgacttagcagtattgaaacagatctgactttttgcttggcagcacaaaaatgatgttattttagaaactctgttggaaagtataggcatgaaactagtctgaggtgagaggcctgccttttcagaaaagttttaatgaaacacgaagtaattagcttttttgtatgtttagtggcacaatttttaatttcgttgaagtttgtaataattttaactgctttttaatatgtgtaccactcatttgtatgcaaccatggacaacttaaaaaaatacttttgtgttctttttctcccttttatttttagttaatacataataacacatttgtgggatacaaagtgatatttcagtacatgtatacaacgtgtaatgatcaaagcacagtaatcagcatatccatcacctcagatgtttatcatttctttgtgttgggaacattcagaattctctcttctagctttttgaaaatatacaatagattgttgttaagtatatttaccttgaaatac

SEQ ID NO: 78213 - DNA, 1325 bp, Homo sapiens
cgagtccgaaacagaagacgtccctgggatgaaagacccaggcctggggcttaaggtggaaaaacaactcattcctcgaggcccggagtcgggcgtcccgggagaacgggaaagggagatgagcgcccgctgcggggagaacgcggtcgggttcctctccccgaaggtggcagccgcaaaaacacggcctcgaaagcagtttcgaggacgatggctcctgcgtcccgggagtcgccatgacgccgcggcctgtcccagacccggcgagggaggggaccaaccaccatctccccctcaaggcccaaaccgacaaagaacggcccccggtaccccggccccgccaccagggccactccgggtctcgcgagacccaagggctgcgccgcgaagacctctgggaaaggcggggggaggggagaggaaggaagcgagaccggggctggaggcgggccgaggccgcgagttgagcctcaggaagcagaaggggcgcggaaagatgcgattgacgtcgcaagcgaaccaatgacgagcgagctgtggcaggcctccagccaatgggcagtgaggcctgacgcggggggcggacgctggggccgagggtagcttgagcgcggcggcggcgttgttcagtcagagcgagaacattccagaggtgagtccggtgaaggggcggccccctgcccggtgcttcccgccccctcgacccctcgggccgctggctggcggggaaggtgcactccccgaccgcccacggctcacggcgccgtctctccgcgccaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacggtgagtcgcgggcgcggcgggccaggagatggcggccgcacaagatggcggcggccgccgcgtgaccccgccgcggcgtgtggcgcagtttgggcggacggcgggcgggcgcgggcccgggcgccggccgccccctccccgcgcgctccccggcccggcctcgccccctccccggcatggcgggagcgcgtcgcgcgtgcccgccgctcgggctgactcaggcttcagctgctgcatttgtgagtcatcgcgcgctctggggcgggggcggcccgatcccggcacccctcggccgtgtgtcgcttcccggctgtgcaccctccggggccgccggct

SEQ ID NO: 78214 - DNA, 1003 bp, Homo sapiens
gctaccgcgctccgaggcgtttccgcgggggctggcgaaccgggcagctccgcgaaggaggggggcgcgcgaccggggcgtctggccccatccccagcgcgtcccccgagagccggcggccccggagggtgcacagccgggaagcgacacacggccgaggggtgccgggatcgggccgcccccgccccagagcgcgcgatgactcacaaatgcagcagctgaagcctgagtcagcccgagcggcgggcacgcgcgacgcgctcccgccatgccggggagggggcgaggccgggccggggagcgcgcggggagggggcggccggcgcccgggcccgcgcccgcccgccgtccgcccaaactgcgccacacgccgcggcggggtcacgcggcggccgccgccatcttgtgcggccgccatctcctggcccgccgcgcccgcgactcaccgttttcgtcaaataaagacataaacccaacgctgctcgcccgggactgggatgaagtgaggcgcgatataaacccgagtccgagtccgaggaggcggaggcgaagcgcagcgaggagcggccgggccaggtgccgccgccgagcagcggggaggggctgtcccagcgacgtccgcggtccacacccgtcagcgccggagctgggcgacctggcgcggagagacggcgccgtgagccgtgggcggtcggggagtgcaccttccccgccagccagcggcccgaggggtcgagggggcgggaagcaccgggcagggggccgccccttcaccggactcacctctggaatgttctcgctctgactgaacaacgccgccgccgcgctcaagctaccctcggccccagcgtccgccccccgcgtcaggcctcactgcccattggctggaggcctgccacagctcgctcgtcattggttcgcttgcgacgtcaatcgcatctttccgcgccccttctgcttcctgaggctcaactcgcggcctcggcccgcctccagccccggt

SEQ ID NO: 78215 - DNA, 8420 bp, Homo sapiens
ccgagtatttgaatagcgaggaaaagggaggccggggcgagcctggcgttcgctcgcgctctcttgcttaatggcaaattgtgggcgagcgctgcgtttaaggaagtgctgctttgaagtaagccatggttgccgaagcaacgattagttgtagagaacagttccctaggttgcccttaaaaatgaagacgaacgggggtgtgcctgagaagtttgcttatccaggcggggtgggcggcggagagggctcgggttcgttcttcagcacttccaggatggccgcagaggcaaacctgctgattgccctcggtctgatggaatctcacggcggctgaggcagcacagcttgtgttttcttgtcaggcatttccctaccagtcacagcttagtcgaaatggaggcctttttatgttcccgcagattgtactgtgttacatgagaatggctgtttgcatgtgatctcagatgctttttaaggtggagttaagcagaagcataactaggatgtaaaaaggaggcgtttccatccagcgatgatgttaaacctggggggatttttgtgtgttctttccctttttctttcagagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggtaataaactgctcttcaatttagttgatagctctttttgtagaattttgaagtttgcatttgtcaggggaaactgcacaactaaaattcttatttcctttaggttgagggcaaaggcaatggaatcaagacagttatagtcaacatggttgacgttgcaaaggcgcttaatcggcctccaacgtgtaagtaaagcttggaaaagtccacagggcatattatggatagagtcttcaaagtctttgagctgcaaaacttgttctaattgtatgctagctaattaccttacaagttaagtgaggaaccgtggtttattggttgccatgagtttacaaaactaccaggggaacgcatttaaagagtggatggctgggcgcgttggctcacacctgtaacccccagcactttggaaggctgaggcaagcggatcgcgaggtcaggagttctagaccagcctagccaacatagtgaaatcctgagtctactactaatacaaaaattagccaggcgtggtggcatgcgcttgtagtcccagctacttgggaggctgaagggggagaatcgcttgaaccccggaaacggaggttgcagtgagctgagaccacgccgttgcactccagcctgggtgacagagtgagactcttgtctcaaaaaaaaaaaaaaagtggtgttcgtacaaatgtgagtgagtagccagagatctagttaactgtaacgatccaaactcctttttcattcaaatagatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgaatgtgagaatcctgaaacagatttggtaagtgcttttgtggttgtcgaaagaaaaagccatatacctgcttctgtgataccgctaagtcaccttcctgagaaggcagagcaaatgtaattttaaatcaaacacaaaactccagttttcgagatatttccattcttttttttaaagtaggtcactgtgtgaaaaaagttttctttgcatgtgaagctgtctgtggtttagatgtcctctgattagatattttcatgttatattatggataacatttgttatttttttggcagcatgtcaatccaaagaagcaaacaataggtaattcttgtaaagcctgtggctatcgaggcatgcttgacacacatcataaactctgcacattcattctcaaaaacccacctggtgagtcttccatgatgaactcctaagatcctaagataagttactaactgttgggaacaaaatagaaggtttttttgtaataggaatgtaagggagactgggcacggtggctcatgcttgtattccccgcattttgggaggccagggcgggcacatcacttgaggccaggagttcaagaccagcctggccaacatagtgaaacccgtctactaaaaacacaaaaactagcttagcatggtggtgtgctcctgtaatcccagctactccggtagctgaggcatgagcgtcgcttgaaccttggaggcagaggttgcactgagctgagatcgtgccactgcactccagcttgggcaacagcgactctgtctcaaaaaaacaatataaggaaccttttagtccttgtactatattttatcaaatctaagacatctttcaaaagtgtattgttaattaccattaaaggtgaaaaataggctgccaattaaactgtgccatatcaattaagacattatctgagggtagatgaagtaatgactaaaattctgctggaaacccagcaaagtttcttttactggcattgtttggtaaagagggcccccttcattaaacttgaatattgcaagcaacactctgtggcagatgatcaaaactgtctgacacaatttgagcttgctatagcaagaaagtctaacctattccggtgttctctctcccatgagacaagccgttatatagacttaaacagtgttccacctgttggctaaagctgggttgagttaatgactttgttcatgagggatgacagggatccttagggccacctctccctagtggaggcatcatcacttcatcttactctttcttagcagttacaatacccctaatattttgtgtcactccattcttagactaacattcttacgtatgaaatacatgatgaatttgatctgtgaagcctcttaggtagcattgtgtgtgctgtgtggtttttctgaggggatccataggaaaataagggcagggttttaaacgttaatgatgggcaatgaggtaatgtaagttatggggttaaatttttatttccctttttttctgtagagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggtgagtgcagggttgatggcctagtgggcactaaagttgtgtaaagtatatggcatttggttgaggtgggtggaaatgttgaaactagccttcagtgtgtaatacactaatattgtggattccaagtactgtttgttgtttgaattaaggtgaacccaattttggatggagatggacttgatgccattaacttggcaaaatctgaacctttttgttgttgtttttaaggcctttgatcaagtagctctgttttcataaacaggaagaagaggaggatgatgactggggagaagatacaactgaggaagctcaaaggcgtcgaatggatgaaatcagtgaccatgcaaaagttctgacactcagtgatgatttggaaagaacaattgaggagagggtcaatatcctctttgattttgttaaggtaaaacatttgcttggtctgtaaatcagcttcaacccagccttgtttgtgcctttagatatatgatactttagcagtgtaattaggattactctaatgcacgactttttagaactcttgttcatttaaatattttttgcgcgtgattccaggcactatgtgtcacaactgccaaattaggcaggaaaaatatgttcatcagagcagggactggctggtgtcttgagcctggcaaagtgtgcctccattgcactgaattgttttccttttctttgcagaaaaagaaagaagagggtgttattgattcatctgacaaagaaatcgttgctgaagcagaaagactggatgtaaaagccatgggccctcttgttctaactgaagttctttttaatgagaagattagagaacagattaagaaatacaggcgccatttcctacgagtaagcaaagtgctctggattcataaatgagattacagttgtgtggctttcgagatggtcatattaaccacttttgcttgtcctgtcatgcttgaaagtggggaaattgacccaccttacaagcctctgagtatctgaaagtgccatacctaggcccttacaaagtaacagggatgtttatgcattgacctttttgaacaactatggtatgggccatgcacttgcagacactcttatttgggtaatagagttgtcaacttagaacacataaaaaagattgttaacaccaaggtgtctatttgcagttttgtcacaacaacaaaaaagcccaacggtaccttcttcatggtttggagtgtgtggtagcaatgcatcaagctcagcttatctccaagattccacatatcttgaaggagatgtacgatgcagaccttttagaagaagaggtcatcatcagctggtcggaaaaggtggggaatacataggtgggctcttaaagttcacaggttttggggggtttttttgtttggttgattgtttttggagacggagtctcattctgttgtccaggcaggagtacagtggtatgatctcagctccctgaaacctccacgtcccggcttcaagtgattctcctgcctcagcctcccaagtagctgggattacaggcacctgcgatcatgcccagctaatttttgtatttttagtagatggggttttaccatgttggccaggttggtctcgaacacctgacctcaggtgatccactggcctcccaaagtgctgaggttacaggtgtgagctcctgcgcccagccgttcacaagtattgagacggctttgagatgaagaaaaaatgtcttaatatctatagctaaagttcagtgcctgtgctgtagattgtgattcgcatcatgtcagatttgtagtcataacagactgctgagactaacgtgttcactgagtacattgattctgtttgaggattcagacttgttaggacccagtcccctcagctcagtaagggggattgtataaataatcaaaagttgttaaaattcctcaactaagagacttgtactcacattttttaggcctctaagaaatatgtctccaaagaacttgccaaagagattcgtgtcaaagcagaaccatttataaaatggttgaaggaggcagaggaagaatcttctggtggcgaagaagaagatgaagatgagaacattgaggtaaacattgggggaggagggtattggatacagtgctggcatgggtgtttgagatttaaaaaggtttgtgaggagtgatataatggcagtttggggtaatttcaggtttagaatttaagatgcagtaaaatacagcctctcaataatttggaaaataatagaaagggtgatggaaactgtgttcctactcctacacattatagtctataaaaaaactttaaaaatgctcttagactggagcctgtgtaagagaacttgcagtgtttgcataacagagctgttccgtgaagaagaaatagctgcatctaggcagtttcctcctctgtgaccacaatttacattgatttgttttataaacagatttatcagcttatgttgaataaaatcattcctcttaacaggtggtgtattcgaaggctgccagtgtaccgaaagttgagactgtaaagtcagacaacaaggatgacgacatcgatattgatgccatttaaagggatggatgcaacctagcttaacagtataatgctgcaaattttcctccattatcagccagaagtgcaacatgtatgtgcaaaagctaaaatggcttaacatcatgctacactttacactaaaaatctattactgtgagtggtctgttattaagcccaatgagacatctagggagtccatacacatcagtgagcagatgtagtttgcttatttatagcatgtttctttttgaaaaactagtggtggacacatttggatcacatttatacagttataaaaataaaggtttgattttggtcgttcttcagatgtttggctctgaatgacttaagctgaagtaactggctccttactttaaatgttctgccatcatttcacctgatgagcattcttggagcctgccagatattgttaggtcctggggctgcaaagaggtcctcaacaggatgtaaagcaaacttaattgtaattaatttattcagcccattaagaaagtactaaagttttatctctgtagttcctcaaattggcatctggtaatgtacattgtgaggtagactgataatgaaatgacagtgtaacatcttaaccaagaagtaaatatgacctcagtgtcctataaataatgtaagagcaggatttgaaacttggagagctgttttctcatttcatgtacacttgccccaaattgtctttgaagtcgtgtgcattgcacgttggatgagccagggaaattattacattaacaagcattttgtgtgtacgtagtagttactttgtactgagagaacttgctttggggtgcaattaataaactgattttatttgggagaaacaaggaagggtgcacttaactagcaacctaagcatgatttttcagcttttgcccttagggtttaaattacaattccaaaatgttagacatactgtattttttcgttcagtgtggctttaattttcccctcttgcagtttgttctgtaatgccttttacatttggacacatagtttatgctttttagattttggttgctttcttgccaaaataagtgttaactgtgtttcaaacttgattttctttcctttttcttttttttttcttccagaatgtcttatttaaaaagaaagctaaaagcatacttctaagtcagagcctctattttggtgtaagacttgggatattttttacttcacattgaatatagccaggcacccaagaagtctgatggccacctgagtgcaggtgacaaggacctgacagagcccatgcagggctttagatttggacacacaagagttgataacttcctcatgaactccttgcctgatctaaactcatattatgggttctgactgtttgagtaatcatcttcaaggttaaacctcttggcagttacccttttcacaaagtgcacagtgggaatcgagaatcgatagggttaattttggagcagtggcttataccattcacctctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaagaattggtctccagctgcctttgatcaagattcgggtgcaagtggagcaggagccatatacctggagggaatgtgctttgtcacaccaaagaggatttttttttcttcaaacttgtatgttgcctaggtttcaaattctttgccgcaaggctgatctgctttcattaactggaattctgtaggagatactggtgacctaagctaagttgcactcagcatactcagtgtcaagctaatgaggttctattataaaggttctacttttaatctgagggaaaacatgttcagggcttctagaacactaaaaaatttggcttaaaccagtgttcagtctggtgccaaacttcgaatggaatacaaattcacataatctgaactttgttcacaggttatcctaatagagtaattcttcactttgctctattgaactgtcttaaggatttgtttaaacagctaagttacttgattaaaataatgataaaattgtattttgtctttgctttaatattaaagttaacaagttttcattttataatgagatcaaagcattggaatctgccctgttttgtagccgttgctttggatttgtgttggatgtatcctgcagttacacttgccagccccactcacaaaagttgttcatttcattgggtcactggctttatttgctagtcttgtctgtgaactgagcatctgcctcagttttattacttgaaatcttggcaggtgcttaatagggaacatacatacagctatgtaactgtgaataattgtatatatctctagttaagaatgagggaatgg

SEQ ID NO: 78216 - DNA, 1690 bp, Homo sapiens
ccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttttgttttgaccctcgcattgtgcagaattaaagtgcagtaaaatgtccactaggaccccattgccaacggtgaatgaacgagacactgaaaacgtaagtaacctgggcgttgtagttggcggaccttcggggtggcattcgtgctcctcgggcagtgccttgcagtcgggtgttccccccagccgaacgctctggaaatagagggcaggccgtagtcacccaggaggcagccaggtcggaccgtttcctccagaagtctgccgtgtcccgctgttcgcgggcgggtctgcgaagtacatcgattatgccggcagtctagtcggttaataaagcccaggagttgcagcgttacggatcggtgctttgagaggccaggttgccgcgcaatggattgtgcaaacgtgtgtgtcagatcactgcagtggtcagtgcttattttagccgaactctgcttttaacttggtcaggcagttcttgagagactgtcacattaataacatatgttaccggtgctgattaagagtaatcgattgggtcaagtgggcggtctcgttctttaagatggtctggaactaaatttaatcacagtcactaagtgtccactgagggatctttgcggtccccttaggaattccaaaacactagcgcgcagcctttattaaggcagtttcctttccatacaaatcttttttgaaggagttggttaaacattttgaaaagcagatgtatagtgaagctctgctctgccactcactgcctagctgagggacacccgctgggggcttcgctgtcctccttcctaaaaagagattggcttagatgagctcttaggtccctttcagcgctcacaggctatggttttataaaaggaacctttgattttgttcatgtgaaactacaaaatgccaggaacagcattgctagagaatgagaacttgtagtagaaattccattgaagaaacgtttgactctgttcgttttctaactctgttctcctctaacactgggttcaaaagtgtttcaatctagttgttgactatattctgtaaaacatctagtaaataatttgtaaagaaacttcactggcctttcattaaaagtgttatgaggtaattgctggcacgaaatgtcttctcttagggaatgcttccttgctttgagtgttttcatgctttcagtaatgtcctgagatgttgtggcctagtggagttaatgctttcattttgatcttcaaaaatgcc

SEQ ID NO: 78217 - DNA, 1429 bp, Homo sapiens
ccttggcctcccaaagtgctgggattacaggcgtgagccactgtacctggtcaaaatatgctttttaaaggcaaccaaacagtttgcatttcagtttatgttctatagttatatggagccacggatacatcctttttctatactggcaaaatgagaaacatatttttcacctgaatttcaaaggatatgacacttcgtaagcctggtaatgttattggccaaagtaccagaggcccagggctttcccagttatttaacagttactgatatgtgtgcatcatgtacttattattagttaatgcaaatagtcccccaaatttctgacctctgtgaaactgatgatgctgttgtctagtcagtcatcggttatgtgagactgaattaacctattcagcaagtgtgaatgcctaccgtgtgtatgatactgtgctaggtgctgtagaggccatatacctgggacacatagctttcctgctctttaggatttcctgctccttgcaggacaaagcagcctgagctttatgaaactagtctgtaactctcaaacttaagcaaacattagaatcacctgaagggctttagaaccgtgatcactgggccctacccctagaccttgattttacccgtagaattggaatttctaacaagttgccaggtgatgttgatgctccaggtccggggaccactcttaagaatcactatagcaggaatttctgatgtttatttattaagaaaaaaaaatcactgccttagtgtgcagtgaaggcttgctaactaaactatactccttttagattgtactgtgactatcaaaggaagatttccagaccatttaattgagttttcaggttccatgagtttaaaaaaaactgtttattaaaaattgtggttctggaaaataacaatagttgccatttggtgatcacttaactgtataccagccagcaatactttgtagagtatctcatttaaaatatgtaatatggttttatttaattagctttttttttttttaaatttcctgaggcggagtctcacactgttacctgggctggagtgcagtggcacgatctcgctcgctgcaacctccgcctcccgggttcaagcgattctcctgcctcagcctcccaggtagctaggattacaggcagccgccaccacacccagctaatttttaaattttattttattttttgagacagagtttcactcttgttgcccgggctggagtgcagtggcatgatcttggctcactgcaacctccgcctcctggcttcaagcaattctgcctcagcctcccgagtagctgggattacaggtgcctgttaccatgcccagctgatttttttgtattttcggtagagactgggtttcaccatgttggcaggctgatctggaactcctgacctcatgatcctcccacttccct

SEQ ID NO: 78218 - DNA, 1050 bp, Homo sapiens
aaaattcatttgtctcatatccattttcaaatttcaaattaaacatgaaggagaaaataaatctcttacctgggaagctttaatgtcctgtctcacacaagaagttaaaggttgtgcttggagttggtctgcaaaagtaataaggaatttgtactcacccgtctgcacctgcttgtacagaacaattggaagggcagaagttggctttgaaagaaaaggcctttttttggaggtgggaggggcatccaattttgtcttcagccgagagttcgctagcactacactctagccactcaagctgctcaactatggttggtcttgtgtacttctgtgtgcactagataagacattgtttctgtgggttatgtgggaccttgaagttcagtgttgaagctcaaacaaagcaggtgttttttctgtatttcttgttgacaggcatttgctttttgttggacctaaatattgtggggtttgtgtatggacatttgacacaaaaatctgtattggtagaatttaatataaaatcagagaagttgaattcacaggttttgttcatagaattttacataactctagtcttttttctttttttgtgatggagtcttgctctgttgcccaggctggagtgcagtggcatgatcttggctcactgcaacctctgcctcctgggttcaagtgattgtcctgcctcagcctcccgagtagctgggattacaggcacccgccaccacgcctggctaatttttgtatttttagtagaaacggggtttcaccatggccaggctggtcttgaactcctgacctcaagtgatccacctgcctcggcctcccaaagtgctaggattataggcatgagccacagcgcctggccacaatcttacactactttcctgaagggatgtgtgatggaaagagtctgggcttgaaagtggaagacaaaaatgagagtctaagactgatcgagataaagattctgaagaggtagaatggacctcataagatggagcaaaaaagaaggaacaacatataaaaggagaaattagaatttag

SEQ ID NO: 78219 - DNA, 1142 bp, Homo sapiens
attactgttagcagtgtagtatagaaggaaatcgggaatccagattctctatggatttccccctgaacagttatgtggctgtatccttatctagtgaatggtgacattagcttttcccctgctgcacgggctgtagtgaggctcaggtgtgcaggtgcacttactaacatatggaaaagttaagcactgtataaccagaaggtagcccttttactcctattttatatgacagccacgtatgcaaaatatctaatttcttcctgaacactcaattgaacttcaacacttcgtatttttcgtctcagaatttttattttcctcaaatttatattatgtggttaaattcctttgaagtgctagatactttaagattaaaattaaagtaggaatgttttttcttcaattagaagctcttagaacttggcaagtactctgtgttctctcatttccttatctttgtgtatgctgtattgcagcacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggtaaataccagttatgcttatttctgttatgacagttgctctgtttatttccatgtaagagaaagaaaagaatatagatataggccttatttcttttttttaagatggagtctcgctctgtcacccaggctggagtgcagtggcatgatctcagctcactgcaaactctgcctcccgggttcacaccattctcctgcctcagcctcccgagtagctggcagtacaggtgcccgccaccacacccagctaattttttgtagagacagggtttcaccgtgttagccaggatggtctcgatctcctgaccttgtgatccgcccgtctcggcctcccaaagtgctgggattacaggcgtgagccatagcgcctgtaatatatagctactatgtattacatgtattacatgtcaagttctaaccacataatataaatttgtaatacatagctgggattacaggcgcacaccaccacacc

SEQ ID NO: 78220 - DNA, 1122 bp, Homo sapiens
gtttaatcggttattgtgtaggaaggcacatactttcctaacctttgtgaaatggctttctgctcagccccgttcctattaatcaaaaatacatgcattaaaaccacaaaactaactccctcctcttgttatactcatatggtacagagcctgttttgcctctttttttttttttttttttttttttgagacggagtctagctctgtcgccaggctggagtgcagtggtgtgatctcagctccctgtaacctccgcctcctgggttcaagcaattctcctgcctcagcctcctgagtagctgggactataggcgtgcgccaccatgcccggctaatttttgtatttttagtagagatggggtttcaccatgttggccaggatggtctcaatctcttgacctggtgatctgcccgcctcaacctcccaaaatgctgggattgcaggtgtaagccagcgtgcccaacctttgatgtagtttcttgcatttaggtctttgcgcctgcttttccctgtacctgaaatactctttactcttctgtttagggaacatttctgagaagtaatcattgacaaatcccctttccccaggcatgggattccataaaaatcccgatactccccttatatggcacaatttacattgtattggaattgctcgtttgtctgtctccttctctagtttgtaggctgtctccagtctgtaggggaagatgacagaacttaacacagtgcttggaacctgttaggtacttaataaatatttgctaaatgaatgcaataatactgttttttggcgggggggaggtggtgttggcaacagagtctcactgttgcccaggctggagtgcagtggcgtgatctcagctcactgcaacctcccgcctcctgggttcaagcgattctcctgccttagcctcccgagtagctgggattacaggcacacgccaccgcacccagcgaattttttgtatttttagtagagagggggtttcaccatgttggccaggctggtctcgaactcctgatgtcaggtgatccacccacctcagcctcccagagtgctgggattacaggcgtgagccaccatgcctggcctgaatgtagtaatacttttgaaggaa

SEQ ID NO: 78221 - DNA, 1048 bp, Homo sapiens
aattcaactataatggattggaaaacaagatttctgtgttagtttaacagaggagagctaaaaaagaactcaggcctgaatggttgtcaggaatttacttgggtgactatcttctcatctcagaacataaaatgtaggaattaccacagttgcaaagggagatgtttatgttggagataaaaatgctcctcccttcaaaaatgagacagtattttagataggaaaggttatttatctgattacatgttttaaaattctgagcgtaaggttatatgtcaaatcctgtccatgggctgggcacagtggcccacacctgtgatcctagcactttggaaggctgagggggaggattgattgagcccaggaggtcaaggctacagtgaactatgatcacaccactgcacttcaacctgggcagcagagcgagaccctgtctcaaaaaataaaaataaattaacaaaaaaatctggtccatgtccatctcctcttagctgctaattcaattttagattagacacagtggacaaggacaagtatggtgagagtcctgtgatttctcaccagcttcctttccacataggccgctgcttctcttcttccaaggtttttccccgcttttgcctcctggaggttgtatcctgggtgttaggagactgggttccggacacattccccacagaaggatagcaggaccttagaagatctttttctttcttttcctggtttcctcttgtttgcaagagggttgaataggatggtctctaaaatcctgttgtttttctgggttatattaacccaggccataatgataagaacctgctctgaattcacaacatgtatttatacaacagcaatttaatatttcttattctgtggaatggctaggaagctctgctggtcttggttggatggttttttgtttgtttttttttgagacagggtctcgctttgtcgcccaggctggagtgcagtgacgccatcagctctctgcaacctccacttcccaggctcaagtgattctcttgctcagcctcccgagtagctggga

SEQ ID NO: 78222 - DNA, 1619 bp, Homo sapiens
gtcttccccaaggccagaaatgatggttacagtacacatcactagagtttccttaaaataaagattaatgactagtaactatttgcctatggttttgtaaaaatgtagacattttctgaaatgcgtgtttatagctgctgtcttttataatgatttgtattttatggttgagattgggctgggtttgtagtttgcgaccacacgtgagtttcattgtctgtgaagggcagaagctttcttgttcatctttttgtgtcccctgcctctagcacactgcctggcacacagcagatactcaacagataagaattagactgcatttaggaattataaactactgggtacacattctgttaaactctatcgtaattttatcattagcactttgatccatgttacaaaacctgaagatagaaagttggattatagtctcatttgagtgagtttaccattgaaaataaaaagattgtaaacctgttgtggaaaacaatgagttgtagtaagcatacctttgacaccacttttttatactcctaattcattattagttgtgtattttatactttatatatgtctagtttgggaatttcattgggattttcaaaacttcaggggtagtagaaagaggggaaggttaatttcaggaccaaaaagctttatggagttctaatactttctgtgggcaaacaacacagagtaatgttcatagccctcacgttgtacagcctctacagtgtacaaggtgctttctcttaccagatctcctttgaccttcacagcgactccatgctgtggccaggcagtgagcgatgggctttttacccatgaggaaatggaggctgggaagtctcactgtgggcgctctgggcctggaccgccagtgctctgacagcagatagcctttctagtttgttggtcagtcacggctttctgttcccatctgttttagctacccaggtcacagagattactcatataggggcaagacaaaaacatctaagagtcatccaggtttagtagaaagaggatgggctctggaagagacagacatggagtgaatccagccagtggccctcattggccatgtgacctggcaagtaacatgtgctgagctgagcttcacggtgagcataggaaccccctctgagggctcagtgcacttggcaacattgtaagagcctttaatcatttaatcgaaggtggtggttctgtattaccttgggtttttttttttttctttttggagacagggtctcactctgttgcccaggctcaagtgcagtggcgccatctcagctcactgcaacctctgcttcctgggttcaagcaattctcctgcctcagcttcctgagtagctgggactgcaggcgcacaccacacctggctaatttttctaatttttatagagacaaggttttgccacattggccaggctggtcttgaactcctgacctcaagtgatccacctgccttggcctcccaaattgctgggattataggtgtgagccacagcacctggcctctttaacagtgttttgttgagtttattaaaacaatttccgggacatatgttttattgttgatgtgtttgccattgtgaaaagttttattaaattgg

SEQ ID NO: 78223 - DNA, 1631 bp, Homo sapiens
aaataattaatgttgtgtaaactgccacctaggcgtgcatcagctggttctgttgttttcacctccattgtatcctgagctcctacttctcaccaccactgtgcttcccactctagtccccgtcactttcatgattggtttgattattgtactgatctccctcttggtcttcctgtcccttcccgtcattggaagcctcttccccgctagcagccagtgatccttttaagaggtcagtcttttttcatctctgcttctcatctcacttgtagtagagccagagtcctcaccacggcctacaggactcttcctagcctcatgaactaccctcttcccctcattcacacttctccagccctgtggccttcttgctctttctcttaattactgtggaatcttaccccagataactacattgtccacaccctcaagtagtcagcaaaacacaagggtgtgcacacacaggctcacttgtctgtctctcctactttttctccacagcacttactgtcctctgatacactatatgtttattcatttattgccccctcccccaactagaatgtaaactctatgaggaaaaggatcttgtgttcactgctgcatctccccagaacctacctagaacagtgccttgcagttagtagacattcaggaaatatttgttgaatgaatgaatatactcaggaaatgctttgttgtcataatcctgcagtgaggatgtcctcttctaacacaaataacttcatccattttaattttctgttttaattgcttagtttttattaaagcctattgaaaacgctctttaaaataagagttatataatttaagtatagggaatttaattttaaggcttttcttcagcttaaagattttgttggtgaatttaaatgcctgtagttaaagccagcttagttcaaattccacatatttctggctaactttatatctatatttaaaaattagagcattgctaaaagtgaaacatcaatttatgggaaaattaatactcagaagtaggatttctacttacttttatttctctcacctataggtgaagtatttgactatttggttgcacatggcaggatgaaggaaaaagaagcaagatctaaatttagacaggtatgaattaatgtgtctttactatgtcaatttgataatttatctcacttaaaccctgaagcaaacaagtgtttgcctccataaatgcttataaggcctgttggatggcaggggttggccattcaattcaacaaaaattgatgaagaacttttcatacctaaggcactgtgctggaggcagccatggttctattcctagctttgtaatgggagcattagtcttatacttaaccttccctttttacaactgagccttaaaaatctagagcctttcaaaaacacctgtgattacattaattaaagccatttcagagtttttagcaagcagaatgtcagaaccccaaaattcattattagctttgtctgacataaaccaaggccaagtgtaactgaaactgttaattagtaactttacttcttgctttgtttttactctgctttttaaagagactcgggttttaataagcaggttttaagcaaacaggttacttgactctcctgtc

SEQ ID NO: 78224 - DNA, 1842 bp, Homo sapiens
tcacgcccacagcatcctcagtgccacccggcattcatttctgctgctttcatcagtattctctcccgttaacagcagtgcctgtttgagacctctttcaaggtcctcagcctctgccctcactctggcataggatgaggtttcgtatcgcacagagaaaatagaaacaccatgcagaaactctcattttctaccaggccctcaaacctagcagcacctacccccatccatcacttctttcctcctgttacaggaaagtggggtgcttctgctctgagctctgggtcctgattccctctgggggctgtgctctgtctgatgcctcttttctctccgtttgtttattcactctccttctctactggcttttcaccagcagcatttacacatgctcaagtctatatacctttttttttttttaactaaaaagccatgcctgttcctctttcagatacacgctttttctctcttccctttcatagccatatttctctaaacatttcctagattctgtgtcttaacttggcactcactttcactctccccttacgtaattgccattgacttgcttgttctctgcacccgcccctagagcattcacattcactctctcaactgcagtggccaactgtatgctgatggccccaaatccattcctacggccagagcactcttctgggatccaggacccagctgagcaaagggtgtcttcatataagcatcccttgggtgcagcaggttcaaatcctataaacatgaatgttcacttctcattcaggtgtctgatgtccctcaagtaccttactctcctgtgctacccactcagtcaccaggtccttttgctgctgtgttccaagtatctcttaagctcactcttttatgtccctgttacactatccaaggccagaccaccattatctcataggtgattccgacactactttcttatatgttcttctctgtttctagtgcctcttcctcccatgtatgttttctacactgcacccaaaatggtcttttaaggaaacacaaataagatggtcatttctctgcttgaacaactcttcattggcttcccattgctcttacgatgaaaacccaaacttctcaagtacaatcctttgtgattaagccctgaccatctccccagccccctctacacatctctatctcacatactgtctttcaatttcttgtgtgaaacatactgtgtctcacatgggttctcagactctttattctgcctgaaatacccctcatcaacacatccattatgatcagatgcaccttctggtgctttgatttcacttcatctgggaagccattcacacctttcagtgccaacccacaactccctgtgcctcttcagttatggcattttgtctcaggacagctgcttatcattctccttcttcccttctaaactgtgagctactgagggtagggctttatctgtcttgttcatcattatccatccagacactaatatagcatctgctgtggagtagccacataggaaatgtttcttaaagtgactgtgatttgtctctttttttttttttttttttttttttttgagacggagtctcactttgttgccctggctagagtgcagtggtgcgatctctgctcactgcaacctccacctcgcaggttcaagcgattctcctgcctcagcctctcaagtagctgggattacaggcgcccaccaccatgcccagctaattttttgtatttttagtagagatggggcttcaccatgttggccagactggtctcgaactcctgacctcaggtgatccacccgcctcagcctcccaaagtgctgtgattacaggcgtg

SEQ ID NO: 78225 - DNA, 2463 bp, Homo sapiens
tgttggccaggctggtcttgaactcctggcctcagatgattcgtccacctcggcctcccaaagtgctgggatcataggtgtgagccaccgtgcccagcccccatattattattatcaattgaaaaactcaaggcttttcttgatcttgggacattgatgtttaaattagtgctagaattaatctgtacttcatgtttgttattgttaatattataaaataaggagttctgacttgtctcctgtttttttctctagaaagaatgttttcacattaattaggaggtaacttcatatcattacagaaagcttttctaaaatgcctaatcctgtcataattctaattctattttggctaaatttcatttttgtcttgatgttttccctctaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggtataagaagctgcacccatgtacttcactaaactaaaagaagtttcctaatattacatggcttaatatttttaacattatatcagtgcggggggtttcagggggttttttgttgtgttttgttaactaaacctaaaggttgacttactcgttttctttcctctgtacctctccaaaggaactgagagagagagtattaagagggaaatacagaattcccttctacatgtctacagactgtgaaaaccttctcaaacgtttcctggtgctaaatccaattaaacgcggcactctagaggtaatcatgtaggtggaaacaagcagtaactttggagagtctttagagtgaccttagatctttgcttgatttgtatgccatactggatatatcctgcggctttttaagcaagaattgaaacattaaaaaatattttttgagtttatgctttgaacgatagtcaatgaaatgttgaaaataaatttttgtaaatattacggttatcagaatatttcattttactctgctaatgaacagtttaccttttttagcaaatcatgaaggacaggtggatcaatgcagggcatgaagaagatgaactcaaaccatttgttgaaccagagctagacatctcagaccaaaaaagaataggtaatcactccatgcctgcatgttcatgtgtttttgtctaagtaacatatttctgttttgactcatgtctgtgcctaaaatgtgaataatggaaagttaagcacaagtcatatgaacagtttatctgttctgtcatatttaggaacgtaactacctgcagtttcctataatggcacccagtaactctgaaacaagtgcccatttatgttacaaaatatatgtaatatgtcatcttttaggtcaaatgaaaattattttaccctacaaaagaatgatttctggccgggcgtggtggctcacgcctgtaatcccagcactttgggaggccaaggcgggcagatcacctgaggtcgggaggtcgaggccagcctgaccaacatggagaaaccccatctctactaaaactacaaaattagccaggcacggtggctcatgcctgtaatcccagctactcgggaggctgaggcaggagaattgcttgaatctgggaggtggaggttgcggtgagccaagatcgcgccattgcactccagcctgggcaacaagagtgaaactccgtctcaaaaaaaaaaaaaaaaaaaaggatgatttcttacccaaacaaaacacataaactgtattatgcccttcttttagatattatggtgggaatgggatattcacaagaagaaattcaagaatctcttagtaagatgaaatacgatgaaatcacagctacatatttgttattggggagaaaatcttcagaggtaagagtaatcagaaagagctgaaataccctgtatgtaattattagtttatataaactgttttcttagtttttatcttttgaatatttgtaacatttgatacatcattttttagatttacttgcaaatagcaaatctaaatcctatgactattataagctattttaacttaacccttaatgatggatattggccaggcgtggtggctcatgcctgtaatcccagcactttgggaggccaaggcggacagatcacttgagaccaggagttcgagaccagactggccaacatagggaaactctgtctctgctaaaacaaacaaacaaacaaaaaattagctgggcgtgttggcgcttgcctgtaatccctgctccttgggaggctgaggcaagagaactgcttgaccctgagaggcagaggttgcggtgagccaggatcac

SEQ ID NO: 78226 - DNA, 1045 bp, Homo sapiens
gactctgtctcaaaaaaaaaaaaaaaaaaaaaaagatggatgttgtcataaacctggtctttcataaattaacctgtagtcattaatagcttagaaatgacgtaaagcatcagatgaagtaaatacaacatttaaagttatttgagaaagcctggaaagaaaatcataaataccttacctttagtgtctttccagccgtcagaaaactacttttgcttgagtttagggttgtcatttttgtacgttgtgattcctcctctctctgaatgaacggtttatgagaggtctgtgttaatgaaaagtttaacttcctaataagccatttgggttcgtgttgtggtttgctctgtttttctcattttctcttagctggatgctagtgattccagttctagcagcaatctttcacttgctaaggttaggccgagcagtgatctcaacaacagtactggccagtctcctcaccacaaagtgcagagaagtgttttttcaagccaaaagcaaagacgctacagtgaccatggtaagttttggagtatcccagtgccttctcttagagtccaggcaagaggtctcctagcactgggaagcattctcttgctcagagcctggcttgatgtcctttcttggcattgctttctttctttcttcttttttttttttttttttttttttttttgagacagagtctcactctgttgcccaggctggagtggagtggcacaattttggctcactgcaacctccacctcccaggttcaagcgattctcctgcctcagcctcctgaatagctgggactacaggtgtgtaccaccatgcctggctaagttttgtatttttagtagagacggggtttcaccacatttggccaggctggtcttcagctcctggccttaagtgatccacctgccttggcctcccagagcgctggaattacaggcatgagccaccgtgcctggccagcattttttcttagtgttcctgcaggtgctgccatgattacatattacttcaaggctcttatcttctttatacatgcagtag

SEQ ID NO: 78227 - DNA, 2261 bp, Homo sapiens
aggttctcactctgtcacccaagccacatgtagcctcaaactcttgagctgaagccatcctcccacctcagtctcccaaagtgttggaattacaagcatgaactaccacacacctcccacctttaatatatctaaaatataaattctcttctgccttagaaaaaacaggctgggcgcagtagctcatgcctgtaatcacagcactttgggaggccaaggtgggtggatcacgaggtcaggagatcgagaccatcctggctaacactgtgaaaccccgtctctactaaaaaaaaaaaaatatatacaaaaaaaaaaaattagttggcatgcgcctgtagtttcagctactccggaggctgaggcgggagaatcccttgaacccagtaggcagtggttacagtgagccgcgattgcgccactgcactccagcctgggcgagagagctagactccgtctcgaaaaagaaaaaacaagcatttgactctgtcttttaagattaccactggattatcatatctgaggcatatactagttatcatgttcatttccaagattctttgccctctgaatctcctgtgctgctattggagtctctatatggtttactacaggacattagtctgtcatccacatgtccctaggcacatgtccctggacacactcctcctggagtggcaggaatgactagtgacctccaccgacttcctccctgtcgcttgcatgattcctctgcttctacaccttcccctgtctactcaaactccggtttatctagaagattatgagtgcttttaaaaagatccaagataaaacttcaaaagaagtggcccataaaatctatacttttctcttccaaaaggtgatggcatctctcctacaaaagaggatgtaattcactcagatgtacaagatgaactggttcattctgcttgttacgtatgcatctaattagtttgaatctatgcagtaccaccaccttaagatgtttccaaaggacaactctaaactcttactattaaaaaaaaaatgttttaagtagaaaggagtattaagtgaaatttcaatattgaattcattgcataaggcaaacattagatataagtgggaaacatcttagaggattttactgttttacattttttaggtgaatagcaaccttagatcatcttacaaaatatggttactgtcacaaaataaaacttgaaactatattcagtcatttaaaaaatgaactctttattttagctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtgtaagtgttgttgaactatagagtggtcttagggtggtagggttggaaccagctagacaccaggtgttcattttactcctgtggtctctcgtactggaatgccctctctactaggcagccatgcccaatcttaacttacagaaatcctacctgctgcattgtaggtatttattgttgacactctcttagttcattcttgctgctgtaacaaaatacctgagactggctaatttataaagaaaagacatttatttcttaacaattctggaggctgagaagtccaagatgaaggcaccaacaagttccgtgtctggcaagggccctgttctctgcttccaacatgatgccttggtgctggcatcctccagaggagacaaatgctgtgttgtcatgtggctgaagggacagaaggggtgaactcaccccctcaagcccttctataaaacactaatctggccgggtgcggtggctcacgcctgtaatctcagcactttgggaggccgaggtgggtagatcacgaggtcaggagttcaagaccagcctggccaagatggtgaaacgccatctctactaaaaatacaaaaattagctgggcgtggtggcaggcacctgtaatcccagctgctcaggaggctgaggtagagaattgcttgaactcaggaggcagaggttacagtgagccgagatcgcatcactgcactctagcctggcgacagagcgagactccttctcaaaaaaaaaaaaaaagatactaatcccttcatgaaggcggagccctcgtggcctaaacacctaaaa

SEQ ID NO: 78228 - DNA, 1155 bp, Homo sapiens
ggaaagacctcacagtctaacaggaagtgaatgaaaacagtgacagtgcagatggaagcctacgtgcacacacggggaggtctgactgccagtgccccaaagatgtggtgttcacactgagtcttcaaagagctctaatgatgaagagtgttggctgagttcttaccatgtgccaaggaccatgctcagtgctttttcatggattagctacattttaaggtgaaaaaaaagttgggtaattgcctaaaattacactgccaacctgaatccagctcttaatccctatctgtaacaaaatctccccagtaagtagataatatttactaaattaaattgaatccattcagcttcagaaacttttttctgtgtattgaagtatgttctatctaacctaacatattaaagaatttgcagagaagtaaacaatcttaagattattctgtaagcacgtttttccctacaaaattaacaatgatgcagccctgcctccaactccagaaaaaccctggactgaggaggctgtggagaaaccctgttgctctctgaaagcccttcattgttccattctggggactgggtgcatgaaggaccccaaggggctttgcatgtttcatcctctgaccttatgcttagtcgaagtaaaccctgtgtgaaaagtttattttggcctccaaatgccatacagtaggattattgtttccatactcctgcagttaaaattccgtctccaacgtttgttgacagttaccagagaagatgagggcattattccctgccttcatgacttctcttcccctttgctcttgtctacacacgctgcccttctgaaagtgaatcatgagtattttcagtccacccatactaaattacttacaaaggaaaaaaggtagttagcaacattattattttctcccatgagtctttgggatttctctgtagatggtctgctcaagctgtagtaaaagtgactgctctatctttgtttaaaaattatctgataaaattccatagctatggccaggcacggtggctcacacccgtaatccctgcactgtgggaggccaaagtgggcggatcacttgaggtcaggagttcaagaacagcctggccaacatggtgaaatcccatctctactaaaaatacaaaaattagccg

SEQ ID NO: 78229 - DNA, 1095 bp, Homo sapiens
attctaaattctttttgttgtccagagcatcatcctcctgcctggctgtgtatgatgattaaaaggcttgagttaaacccagggggtttcctagaggaagtagatagtaagctgtggttatgttgtagaacagtgaataaggaaatggagattgtcttgtgctcattaataacttgaacaaaagccgaaagtgggggaagataaggacgtgaggcagagagtcatacctcaggagaatgtacagcaccaggtagcattaaaggtccgcagtttaccaaagggtccagatggctgagtctaaatagaaacactggagaagccaagagaagtggaaagtccagccttctgaatgcttttaatttggctacatagcaagcatacataggatgagcgtgactttaaaaagacaatgatgttacatgtcaataaggagagcatcctatcatgcacatgattttcttggggttttgaaataaaataagtagagtcagtaaaatgggattggataggtgtagagactctgaggtggggttagtctgggtggagagaaaagagaagttagattggtagagaatagctaaatatgctatattctgttcagaacaaatttcccaggctggcatggattttccttctttgtttttggaagagcagtaagtgtacatcattcttttaacttgaacattgtttgcatcagaattgttctgacatttactttctgcagttacggtgtgaggttctgtttcttaatcctaacctatgtttgatctcattagtcaaacaaaatgtttgatcactacattttgtgacagcctaatcaaaaattctctcctccttcatccttagttccaaactgcttatcacttccctgttccataggccacttaggattgagttgatatgaggagtaacatttgttctgtaagattatggttattattcgttgaatttttagcaatatttacattctcttgttctcttttatgactcgtgtgtgtgtgtgtgtgtgtttcaacattgtcttttcttatgattaaaaactactaagaacttgagtatagcagctggggtagatagtttacagataatgattga

SEQ ID NO: 78230 - DNA, 2231 bp, Homo sapiens
ggcaaaaccccgcctctacaaataatataaaaattagccgggcatggtggcacgcatctgtggtcccagctactcaggaggctgaggcaggaggatcacctgagccctgggaggtcaaggttgcagtgagccatgatcatgccactgtgctccagcctaggggagtgagaccctgcctcaaaaaagaaaaacatattttttgatggtgataatcaagaaaccaaaaatattgctttcttaatgcacacatgaggcaggaaatctttcctgaagggctacattgtacctgtgcctctcaagtcaccagaaggccaagctgcaggtcaaaactgcgggaaaagcactttcttcctgttggcagttccattctattattattttttaattgatcttcccacttgtctgatttttccttggacagaacaggtaataactgaatatagaatccagctgatagcctcattggcttttaattggaaacccattatactgtgtggcacaattagaaagtgagaataaccccattctgaggccgagtgtgctcaggctgaagagccagcaggagtgcccgctgtgcgtgcgtggtgtgcggtgtgtgcagtgtgcagcgtgcagcggtatggcatgcaatgtgtgtgatgtatgcagtgtgcagcatggagctggcccctgtgcacacccctgcagccttgtggaagaaggtagcgctggctcagtcaaatgagaggaagagttttcataagcccggctggtgtttaaaacgtgttttggctttgttcattttatggtgttggtgttggtattggtggtcatgtactggcatgtaagatttcttttctctttccctcttctctctgcttctacattctgttcattgaggcttccaactgaatatgagaggaacgggagatatgagggctcaaggtgagggaaatgatttttacttaaaatttttttcaggtgtttacttcatttctgtggcagaggcgactattttctgaatgttccctactgtattcctgctgtctctgtaggagttacgtagagagggtggccacaagggggcgccagcctgccatgagcaccgtccagatccagcttggcctccgctctacatttgtgtttgtgttcaaagcacggcgaggccttcagccttcctgcctgggcgttaacagcctttggaggtctgggttgggtagcagtgctcagagaaataagccctcagttcatcactgacccctcacatggttctcttcacaaggaataaaagcaaagtacttaatagaatgtccatatttcaaactagatatgttttcttctaagaatggtgattatatagttgagtgttttgcttttcttttttttttttctgagacacggtgtcgctctgtcacccagtctggagtgtagtggcgtgatcagggcttactcgagttcccaggcttatgcgatcctcccacctcagcctcctgagtatctggaaccacaggcactgccaccatgctggctaatttttgtattttctgtagagatgggggtctcgccatgttggccgggctggtctcaaactcctaggctcaagtgaacctcccacctcaacctcccaaagtgctgggatgacagacatgagcccccgcacccagccttgcttttccattttgtatagttatcattgcatggatttgaggggaggcaatcaccaggtagccttaggactctatgtcccttgttctaggtctcttccacttgtgccctttttttatgccagtcaccagcaggctatttcaggtcctcattcaccgtttgtccttttggtctttctaaaagcccgcttctggtcatatgacctttctgaattaaaaccttcagtgacctccactatttcacctggccacgtccctgcgaggccctgagtggcgtggtccaggctgccccagcagccccagctctgctgccccatcaaggcagagcactagggtgagtgccaggcagcattccctctccaggcctacccatcccagccaggagcaggctctagatcctggtttgtttccccacccataataggaaggtgacataataggacctacgtgggcatcaagtaagttggggcctgaccaccacaagtgctcattaagtgccaccagctgttgtgggggtgatgacactgtgcctccagttccactcagtctgtgtactttattatgccacagacacatcctgtactttcc

SEQ ID NO: 78231 - DNA, 2611 bp, Homo sapiens
cttacattctgaatccacagggcatccacatgggtggtgtcagtcccccacagacagagaagtgtcccgttgcatttttccatctattccagtagtaagattgtgtcatttgagattttctttaactgtataattggacgtttaattaacaaaccagagaggaggaaaaacaatgaggtgggtagagcatcatgttcagcctcagggctgtacagcaaagcaattttagactgcggatgttgagtctccagttaccctgagtgccagttacagtgattcacatctgaaagaacagtactgcaggagagggacagcccagggtggatgggtggggtgggcaggagctggctggcaactccttccctgagctgggcctgcagagccctgaggagtggggcatgctgtcctttttgcctgatttccaaggattctgcttaacgaattacttcgttcattttagtaagcacaggtggctggtgaagattttccagctaggtagatctttttgtgtgtggcttatgacttttagggggtgagggaagaaaatagacgaaaatagacttagttacaaatgtgagtctgtgcaggaaaatgtggaggtcagtcgttagttgtgttgtatcaaagacgtgaatgaggaactagctgaagtgtaagaggttgattttcctgtacgattaaaaataaacctgcctctatgcatttcagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggtgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaatcttgcattgtctcctaatgctgtatttaacacatcctcaagttgagcagaagtaatgtgtatgaaggcttggggccacgtggaccttcgcaggggtcccagcattttgtgattaccagcatattttttctcccaaggcaataaagagagaagatggccctcatggtgacccaagaaggaagggaatccagagcagctgcagcttaaccctgggagttgtggcacagccctatggagaaacaccaggtcttgacagttctgggttggttctctgtgaagtatgtaaatttcctttctcctttcttgtgattcagtacatgaatcagacctgcagcttttgtccaacacctacatggttgtgtaggggtaatgagctcataactcattgtgttgctttattctcacagggaagttgtcacactgattggtgtgctattctgggttctgggtttgttgttggtcagagtatgaaagtctggaggccggacacagtggctcacacctgtgaacccagcacttttgggaggctgaggctggaggaacattgagtctggtagttcaggaccagcttggacaacatggtaagaccccatgtcttcaaaaaataaaaacatgggccaggggcggtggctcacgcctgtaatcccagcaatttgggaggctgaggcaggcggatcacaaggtaaggagatcaagaccaacttggctaacacggtgaaaccccgtctctactaaaaatacaaaaaaattagccgggcatggtggcgggcacctgtagttccagctacttgggaggctgaggcaggagaatggcgtgaacccgggaggggagcttgcggtgagccgagatcgcgccactgcactccagcctgggcgctagagcaagactccgtctcaaaaaaataataataataaaataaataaataataaaaacatcagccaagtgtggtgg

SEQ ID NO: 78232 - DNA, 1007 bp, Homo sapiens
tccctggtgcaacccccccgccaactcaccctagttgccagttgccactgtccctgcccagcctctggctcagggctcctaccatgattgggcaccctgaggggctcggccagctcagggagtggaggcggataggtgagccagcgggggctaggaatcctgctccccaccttcctccagctcctaagcgccaaggacgcagcctgtgctgccacctgctggccagggcctcctctgccccacccctggggatcagggtctgggacaggcctcatcctgcatctccatgcccacctggacactaaaagctgcggatcactgggctctcacctccttgggacacgaggggattgccaacctagacactggggcccaggagcagcagtggggtgcatccctgaatctgctgctgggcttggcttgtggggggtcctaagggcagggttgaagtgtccacctccctgagtgaacacctggtaggctaggggcatagggggcaggtcccctggtgcagaaggctggggggacttctgcatccagcctttggaccctagactgggccctccctggctgaccagcctgggcacaaggccagtttctggcttagccttttgctaggaaggcccgggccaggataggccgagctgtacaatcgagagtcttgggagaagggcggggacgaagggcccgaggtgagcacaggaagtgagcccctccagaaaggggaggctgagggcagtgaggaaggggtgcagacccagtggggacctgaccagcaaagccccacccccagggggccttgtcagtgctgccctcctcccgctcaacagcggcagcccctcctgctggctcagtccctctcatcacggcttgggcagagccagcctgacaatcgctggggtggtgtgggccccactccgaggtgaacacagggctgagggcatggctgggcaggcctaacacttgtgtttcaacgctccccttttcccatgttgactctcagagtg

SEQ ID NO: 78233 - DNA, 2896 bp, Homo sapiens
ggcggcaccaccccgcggcgcgggccaatggaatgaatgggctataaatagccgccaatgggcggcccgcgttgtgccccttaagagccgcgggagcgcggagcggccgctgttcgcctgcgtcgctccgggagctgccgacggacggagcgcccccgcccccgcccggccgcccggtgagtgggcccgggggccgggggcgtccgcgcccgggctaggggcgctgcgtgcaaagggggcgcgtcgcctggagcgcgcgccggaccggccgggggtccccggcgatgatggcgctccccgcgcgcgctgcggaccccgctgaccttggccgcgtcccggggggcgccggggggcccggcggcgggggcctgagtggtacgcgggagcccgggaaccccggcgtgccggtcccctctgaccccgcgtctccccgcagcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggtacgcgacccctcggggccggggtcccggccccccctccccccgcgcagccgcagggtcctcagcagcgcgctcgggcccggcagtgacgtcactgtccccgtcccgcgccccctcccccaggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcaggtgcggggctgcgggcgggccgggcgggcggggccggggtcttcgggcgctcactcccgtctcgcctcccagggcggcgacgacctggaccccaactacgtgctgagctcgcgggtgcgcacgggccgcagcatccgtggcttctgcctccccccgcactgcagccgcggggagcgccgcgccatcgagaagctcgcggtggaaggtaggggccgggcgggccgaggggcggcggcggccgcgtccccctcccggcgcggtccccgcccgcttttgtttacgtcgcccgggagcggcagccgccgtcgcgctcttatctgcgcgcgcccgggttcagtttcccggagggaccgagggacggaggcccagccccgcgcccacagcggcctggggcccagggagggcgggtcctggcgcggggtcaccgcctgggaccgtcgcccgggccgtgaggactggacgcccgcagatccgggcgggtggggccctctgacgtcccccgaggtggggcacgggggcgggcgggtccgcgctgcgggctggaggggcgggcgcgggagccgagcgtcctgagcgcacccctcgcagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggtgcgtgtccctctgcgccctctcgcggcgtcctccctccccgctacctccgctttccctctcgcccccctcgcgggggtggggcccctcgcggcgaggaggaggaggaggaggagggaggggccggccgcgctccgggtctgggttccgtgccgcgcctcctcctgcgccggtgaccttggccgagcaggtgcgttaagggactgggccccggcccgtgggggctcaggactcagcaacacctccccaccccgagacgtgaggtgggggcggggctctctggcgcctctccccgacggccctgggagctggagctctttgttttcttttctcactcctccgccgctgggattctaccaggggctggtgacgccaaagcttctccaggggcagggctcctacccccactgtggggggcgggtcgggctgtcctggcggtccctggccccgccccacctcaggccacagcgcatgatggcagctggggttctcctgctgtgaggcgtcccggttcccccgcccgccccgtgttggcgggtggagtcttggcagcagcctccactcctgggcatggcagggagcagcacctcagggacttgggaagttcctttggtctgggggcggcctggggcttttttctgggtatgccctgagaccagccctcccgcaggcacaatgacaataagaccttcctggtgtgggtcaacgaggaggaccacctgcgggtcatctccatgcagaaggggggcaacatgaaggaggtgttcacccgcttctgcaccggcctcacccaggtgccagggacggggcaggcccagaccccagggccccagcagggatgtgggtgccccagcatcagtccccccgggggatttccggcactggggagtctcagggcctgtaggggtttcaggcaggccttctccctcataccctcttctccgtctgcagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggtgagcagggcaggtgctgcggcttcccgtggcctttgggcagccctgtttcctccgccctgacttgctgtctccc

SEQ ID NO: 78234 - DNA, 1014 bp, Homo sapiens
ctcgggggacgtcagagggccccacccgcccggatctgcgggcgtccagtcctcacggcccgggcgacggtcccaggcggtgaccccgcgccaggacccgccctccctgggccccaggccgctgtgggcgcggggctgggcctccgtccctcggtccctccgggaaactgaacccgggcgcgcgcagataagagcgcgacggcggctgccgctcccgggcgacgtaaacaaaagcgggcggggaccgcgccgggagggggacgcggccgccgccgcccctcggcccgcccggcccctaccttccaccgcgagcttctcgatggcgcggcgctccccgcggctgcagtgcggggggaggcagaagccacggatgctgcggcccgtgcgcacccgcgagctcagcacgtagttggggtccaggtcgtcgccgccctgggaggcgagacgggagtgagcgcccgaagaccccggccccgcccgcccggcccgcccgcagccccgcacctgcaggttgtcggggttgaggtcggtcttgtgctcatcgctgggcttgtagccgccgtgccggtcctcgatgatggggtcgaagagatccttgaacacttcgtaggactcctcgtcgcccgccacgcagcccacggtcatgatgtacgggtggcctgggggagggggcgcgggacggggacagtgacgtcactgccgggcccgagcgcgctgctgaggaccctgcggctgcgcggggggagggggggccgggaccccggccccgaggggtcgcgtacccgggttgtccacgcctgtctggatgacgtcgtccagcgtgaagccgctcggcgtgctcttggcgcgcagctccgcgtacagctcgggggtcagcaccttggccatgtggttgttgtgggcgctcaggtcggggaactcgtcctcggccgggaagcgcagcttcagtgcgttgtggctgttggagaagggcatggcggcggcgggctgcggggagacgcggggtcagagggg

SEQ ID NO: 78235 - DNA, 1021 bp, Homo sapiens
gggtggaggtgctgggcgccccaccccacctcaaagatgagccgaggcctggtgcgaacagcaaggctgtggccgggggtcccctgctggctccagcccagccctgactcctgggtcctggtctctgctgaggtgggtagctgtggggatctccacaccctgcctcctaggcttcctgctctggggacacttctgggcctggaccatagtcccagggaggctgaacccggcagagcctcccctggggcccccctgctgcctttgtgactccttcctccagcgtggctcggggaacccgcgcctgcctctgggacctgtccctttccctgcgagctcccccttctgggtccaaaggctcctggctcattcatgggcccggcatctcctgccggccacgggagcccgctggggaggatgcggcatgctcagcctctgtgccctgtctaggctgttgtcacacagcaggtgcctcctctaaccccgaacctcctggcggccccgtgttagggtacagctgaggagaccaaacctcagggacgtttgaggacacttgcctgggccacatacctctacccggccctggcttccccaggtcctccctgccaggacagggacccgggctgggttctcattcactgcaggccaggccaagtgaagcccgtggctgccctggtgggaggcggcagggaggggctgtcatgctcgggctctgcttcgagtaggcgcctcctgttcccgggagcagcgacagcctctaatttcctgtgacagcagcggcccccgcaccgccccacgctgccgtgctgtcagagctgctccgggcccagagctccagcagccctgtggaaggcaggagagcagtgcccgctgtgggccaagtgagacaatggcagcgcgggcttgacccggtgcctggcacatgggagggcctggcatggctaagctgggtgacatgaacagcggcgccaggccccatggggggctgtcagttgagggccaggcccctctgccctgcagtccc

SEQ ID NO: 78236 - DNA, 1198 bp, Homo sapiens
gggctccgcacccaggtcagacagttcatgaaggtgataatatatagagaacacacacctcagactcacagcctttctccactgcaagcgtaagagactggttttatttcaagaataactaagggtatattaacacatgtatctcaaagtaacattgaattattgaagacatactgttccaatactcaaacagttcacagagaggggacaggaaccaatgtactggaaaaacacacttgtattatatgtaaaaatcgatggccaatatttctcttattaagagaaaaatacccaacaaattaaaaggtgaaaagctgtgctcaaaaaaaaaataaaaaaacccaaaaccttgcatgcacaagctaagctcagacccttaaaaaccagatagaaattgacaaagtcaaacaaaggagaaaaactagctgaacttctcaaactaaattatatcaaatatatgtgcattttagcaaaataaaccactaaactatactttgtagacatattcattacatttattttaataactacttcattataggctgactggctttcctgtgtggataaagtgtgatctgaaagcaacgctgactgaatgtaaataaagcaaacgttcccagccatttttggcatgaacatggactacagcgtttaatgcagacccaaagccacacatttttggggagtaggttttacttgcagtacagattcttttcattacagatcacaaaaatacaatacaatgtgacaagcccagtttaagaattacatgcagtagctcatattaacacaaacagctccccacgaaggccgacaagagctaaatccggtgtcaacagggttcattgcaggagtagaataatccggtacaaggaacgagaacagattgaaaccagaaacaaagccatgcctgacagtcaatcaaggtcaatctgatcatttccatgaccaattacccatgtgaacaattcaaaatgacggtggaagagctgagcaccctgtactcacacacgatgcccacagcttggcaaaaggtacacaaacacttgtttgaaaagaatgactgaaacgtctactttcaaagaacaatggacacttttaaagggaatgctgacatttaactttacaaaatgaaatttaaaatgtaagtagtactctggggaagaatatgcctgaagcgtaaccatgatttcccagt

SEQ ID NO: 78237 - DNA, 1866 bp, Homo sapiens
atgctgccgtgcgccgcgggagccagggggcgtggggccatggtggtcttgcgggcggggaagaagacctttctcccccctctctgccgcgccttcgcctgccgcggctgtcaactcgctccggagcgcggcgccgagcgcagggatacggcgcccagcggggtaagcaggggcctggggacattgggccgggaggggtgaccggaagggaagacaaacccgggcctcggggccactccctgttctgcacagccgcctcaggcctttgtccaggtgctctcgcgtcctatcccgaacagtcccgcagccccgaggctcccgcatcaacgccctcagtcggatgggactgagggtgccgccgccaccacgccggggactgttgacagccagaacctttaagcgtaacagagtcacctggcaagtttgtacctaccttatttgttcccgagaatgattattttttatttttaaagagctcttggcttaccgtgcgttttttttcgttgtgtgtgtgtgtgttttggctttgttacaattattagtgcttttcttcaagcggcgagcactttatcatcgtacttttgtagcacttcacgttgaatagttgttatttgcaaactatgtgtgggtatatgcatgttactggccaaagatccgcaaagaatgtctgtagcaagaatgtctgtggcaagcaatttttataagtggtacttttgggagggatgttttgtttaagggaggcctaggccttgattccgtctgtcagatgaaaatgttgactaacggtgtggaatgggctggagataaaatattcaagcaaagcatgcaaataccaaacaggctaatgaaggaggctggaaaacttggtttaaacaataattaaagaagtattaaaaaagtgttaattaaaaattggacgggctccgtggctcacgcttgtaatcccagcactttgggaggccgaggcaagcggatcacgaaatcaagaggtgagaccatcctgcccaacatggtgaaacgtctctgctaaaaatacagaaattagctgggcatagtggcgcgcgcctgtagacccagctactcgggaggatgaggcaggaaaatcgcttgaacccgggagacggaggttgctgtgagtcgagatcgcgccactgcactccagcctggcgacagagggagacttcatctcaaaaaaaaaaaagctaattaaaaattgcaaatgtacttgcttgtacattttcatttctgttgggctgtggctgttagtacactttcataattgtagctttgaaggtctatctagtttacaatttaaacaaggagttaccagggcaacttgccaaccagacacccaagtggctagctcagttctgtgttacagtgaccaagtccttgccttctatccctagaacatagaaacccacccagcatctctatctttgggcagaaagatagagcaggtgtctgaaaatgctctaagagagcaaacgggaaatcaaccaagacatttcccgggcgggggggattttccctagcttattttgtgaacttgtgctggaaagaaacaacagcacccaaataaggatttctctattgtcatatacacttcttttttttttttttttttttttttttgagttggagtctccctctgtcgcccaggtgggagtacagtggcgtgatctcagctcactgcaacctctgcctcccgggctcaagcgattctcgtgcctcagccttccgagtagctgggactacaggggcccaccaccatgcccggctaatttttttgtatttttagtagagacagggtttcacctgttggccaggctggtttcaaactcctgacctcaagtgatgcgcctg

SEQ ID NO: 78238 - DNA, 1061 bp, Homo sapiens
atctgaggtgtgattattgataattgaaaacttttcccaataccctgccgtgatgacttgcaatatagtcagcactggcaatttttgacagtctctacagagactgaaaacaaaaattttttttatagagatggggtctcactttgttgcccaggctggcctcaaactcctgagctcaagcagtccacctacctcggcttcccaaggtgctgggattacaagtgtaaaccaccaagcccagcccacaaatcatctttagacaaattgtctaatcatctttagacaatactgaggtgcaggccttgtgtctgttggtggtgggaaagagatggttgactagggccttaaagataataaaaataattaacgtatgtatacagcaggggtggcttcctgctgtggtcactccagcgttgggtgaaagtgttccagcctggatagctctcccatctcgttggcattcctgaaattaggagactgttttcattgactttctagtgtttgcccttctggtggattatccttcttttatattgctggatcgggtttgcggatttgtctagcatccatgtagaatagggggctggggaccctaaccctcagtaaatatgaagttcctgactccttctcagatgggaactcaaagcctttatagaactgagagttagaacaggaagcaagaacgctaagagcttgctaacatttttctcttcattattccctggtggtttccccatggtagctttgtgtcatgtacgggcacttccaggaatagggtgcaggagaaacgtctcagtgtctccccttccgaatcttggcttctggagggagagatgctggggtgggagtgctccttggtggagtactcaggagcttagtaaaagcagagggggctggagaggcaggcctggcctgcagagccagcatggagaagcctggtgtagggctctccagcctgccaatttacagttaagaagaaaggagatatgtatatatatatatacacacacatacatacatacatacacacacacatatatacacacatatatatacacaca

SEQ ID NO: 78239 - DNA, 1051 bp, Homo sapiens
gaggcaggagaatggcgtgaacctgggaggcggagcttgcagtgagccgagatctcgccactgccctccagcctgagcgacagagtgagactctgtctcaaaaaaaaaaaagaaagcttagcaaaggtggttgagtttcgggaaagggctgttattatttaaaccagaaactaggccctgtgtggtggctcctacttgtaatcccagcactttggctgagatcacgccactacactccagtctggcaacagagcgagactccgtctctaagtaaataaataaatccagattgtacattttataatactagagattcattttgtcatatgttaatccaatttactttgttaaaggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggtaagtttaagttttagatcagaacggaagggtgcggtggctcacgcctgtaatcccagcacttcgggatgccgaggtgggcagatcacgaggtcaggagatcgagaccatcctggctaacacggtgaaaccctgtctctactaaaaatacaaaaaattagcccggcgtggtggcgggcgcctgtagttccagctactcgggaggctgaggcaggagaatggcgtgaacccgggaggcagagcttgcagtgagcggagattgcgccactgcactccagcctgggtgacagagccagactcgtctcaaaaaaaaaaaaagaaaaaaaagttttagatcagaatgagaaataacacagttggccacttgagggtgctaggtgtttagtatattgctttgctatttgttacgtggtagtactgggtctcagtccatcccccgcactgtatgtacatatatgcatatagttttaaaaactaatatgtaactgtatataagaaat

SEQ ID NO: 78240 - DNA, 1029 bp, Homo sapiens
cagtggcgtgatctcggctcactgcaacctccgcctcctgggttcaagcagttctcccgcctcagcctcctaagtaggtgggattacaggtgcccaccatcacattgggctaatttttgtatttttagtagagacggggtttctccatgttggccaggctggtctggaactcctgacctcaggtgatccacccacctcgtcctcccaaagtgctggcattatgggtgtgagccactgtgcctgacctattctgtggatttataaacaaacagcgtctcccaaagtttattgaacatcttctcaaatcctgtttcaagcacaaaacttttaaccacattcagagggttttaaacgagctttgagatgggtcactagcttctcagaaaatccacatctaaacttctccagtacaccgtgagctgtgctctagccaaagaaaaatggaaagacagagaaaggagttctgagagcctttttttttttttttttttttttttaaggaaaaagaagaatttattcactcaagactaaaaactaaaggcctgggcctgagaactgaatcaggttagtgtgtttgtttgattgttttttttgctttctttgcgtttgagctagtccatgaaaagggaaaggaagggcggtgagagaggtggggaagttcagggcggtccttggcctgctttggggcagtgctcggcacacccctgtccaagttctcttgcacacccagttcccaggcatggctctccaatctcagctccctcctttctctccggattttaggtggttatgatggatgaccaacctctgacctttgactttcgtactgaggtctcagcctttgcagcttctccctccaaagcagcttttcttctgattcctgatctcagttcagtgctcaaaatagcctctccttattttctcctggtgtcagtgttaggcctgaataacatctcatgctgttcgttaaacagatgtctgctgccaaaaagttgttctgatagaaaatccaaaatcatcgaccccaaa

SEQ ID NO: 78241 - DNA, 1033 bp, Homo sapiens
cccagctggtctcaaactcctgacctcaggtgatccacctgcctcggcctcccaaagtgctaggattacaggcgtgagtcaccacatctggctaatatttgtatttttagtagagatggggtttcaccatgttggccacgctggtcatgaactcctgacctcaagtgatcctcccaccttggcctcccaaagtgctgggattataggcgtgacccactgcacctagcctattttgtatttttcagtgtacacatcttacacgtctcctctcaaatttattcctaagtcttttattatttttgatgctatcataagtagaattgttttcttgatttcatttcagactgttcattgctagtgtatagaaatacaattgatgtttgtatattggtcttgtatatatcctgcaagcttgctgaactcatttattagctctaatagttttttgtttatcctttctccttaagtcttaatgtttaagctgaaattacctttcaggtcagaaagcaacattgaatgcagaagaaatggcggacttctacaaggaatttttaagtaaaaattttcagaagcacatgtattataacaggtaggtgtttactcttttcctgaaaatttgaatagcacatccagattaggtaggagtgttttcttacctgaatttaacaacattcatgtttatatcagaggtagaagttgcaagactttatcaacttttttttttctttttttctttttttttttttttttgagacggagtttcgctctctcgcccaggctggagtgcagtggcgccatcttggctcactgcaagctccgcctcctgggttcacgccattctcctgcctcagcctcccgagtagctgggactacaggcacccgccagcacgcctggctaattttttgtatttttagtagagacagggtttcaccgtgttaggcaggatggtctcaatctcctgacctcgtgatccgcctgccttggcctcccaaagtgctgggattacaggcatgagccactgcgcctcgtcta

SEQ ID NO: 78242 - DNA, 1107 bp, Homo sapiens
gaaacagggctggagaggactccaggcgtcgccagtgggcctcactctcagcctgaggagaggcaggcctctatgaatagtttagctttaacaagggcagggaaagggcaaagcagttgaggcctggtcagttgaactcatcctcaactgggagccacttctgggccagggcaccaagcctcagtccctgccaccgtgtcacctgtgcatcctctgtttctctacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactgggtgcccgtttcctgtgtttcgaattataccaattcaaaacagaactatttaaaaatattggccaggcacggtggctcacacctgtaatcccagcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaaaaagaagtctgctgacgggaatgatgtggaagctgactgccaagcgatcggtgtgctggccgtggagtcagcaccaccctcactgtgagtcgtcagctggtgggtcctcacaggctgcgtcctgaatgcagtgcggtgtgaggacatgaaagcaaatgcaattttat

SEQ ID NO: 78243 - DNA, 1937 bp, Homo sapiens
ttgggacgtctgcaggcactgggagggtttttcccaagccgctggcagcagcgagcggagcctcgcccattgaatcagcatgccctcccggctggctgctgagtcaggcctgcggagccggcgaagccgcaggacttgacccaggcgcgctccgctgcccttcaggccgggctggaggtcgaggccctgcagccagggagatgcgccggtggctgcgtggggacagaggggggttgtctcccaccctcacagtctacaccccggcccttcccctttgcccgtctgaggcgcagtttgtgtcgagggggagcgcctggaaagtttcctcgtacagatacgagggtccaaaagccccgaggagagggaataatgagaaggggagggcgcagggttagaggtcagggtctcgaccaaaggctgtcggttttcctggaggagggagaaaggcctggccgggatcatctgattccggggcctcccgaaggcctcctagctgggttttggggggaccgaaacgagcgcatgaagctcgcgggcctgggagtggggtggggcgggagcccagtggtggcggctgcggccgggcctgcaccgtccccggccgcattctggtagggcccacagtccggctggaagggaagctgccgaagcgctcggtcatcgcggctgcggagtcggagaggccagggcctggccgcccaccccgcgagccgcgccctgccccgagcgccccacccccgtccgcgttacaaccgggaggcccgctgggtcctgcaccgtcaccctcctccctgtgaccgcccacctgatacccaaacaactttctcgcccctccagtccccagctcgccgagcgcttgcggggagccacccagcctcagtttccccagccccgggcggggcgaggggcgatgacgtcatgccggcgcgcggcattgtggggcggggcgaggcggggcgccggggggagcaacactgagacgccattttcggcggcgggagcggcgcaggcggccgagcgggactggctgggtcggctgggctgctggtgcgaggagccgcggggctgtgctcggcggccaaggggacagcgcgtgggtggccgaggatgctgcggggcggtagctccggcgcccctagctggtgactgctgcgccgtgcctcacacagccgaggcgggctcggcgcacagtcgctgctccgcgcgcgcgcccggcggcgctccaggtgctgacagcgcgagagagcgcggccctcaggagcaaggcggtgagtccccggcgtgcgccccggaccgcggccccctcctcatcctccgccccgtccctgtcccgctcctcttcggacccgccccggccgtaactctgtccccatccaggcctccttcccggtttgggtcccggcccctctccgttcccaccccggtacccgccccagttcaccgccccggccggtccgcgaccccttccaggttcaggtcgggttcttgtccccggcccttttgccagccccggctcccggcgccgcgcgtcctccccatccgcgtcccactgcaggttccggtccccggccctgcccagggccccgccctggccccgcatccccggcttggccctgctgcgggcggcggcggccgttcccggggacagctgtggaccccgggaacccgcgacaggggaggtggctgaccccgggatcgcggcgggcggggaggccggaggcccggcggggctggctttgtccgattcctcctcttccttccacccccgcctctcccggcaccgccctgagcggacgcgcctgtcattctcgcgggcggcggggggccgggtccctcccgagagctggctccgctttgcctccttggcgaccccttattttcagtaaccagatgcgaaacgtttcaggcgaccctgttcacctaggctggcgttgctc

SEQ ID NO: 78244 - DNA, 1073 bp, Homo sapiens
ggcttgcaaacattctgagaaaaaatgttgttcaccgaggctatgtgttttggaaatgccatttagatgttttgctgcttttaatctttggcattaatttcagttgctgtcataaaaaagaattaagacataaaccagaaaagtaattaaatgtgtctgcaaaggaaaaacagaaactgcagaatatggtatttcaaggtcataaattacaaatgtgcatatttattattcccctataaaatgttaattaaaaaattttcatatttacttgatgtaacagaaatgaaacctgtaatgagggatctaatttctttttcttttttcattccagaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggtacgagtgagaatgactcagacgttatcaggaacttttgatggtaaaatggagacttgtttgaaataagcagtttcactaaagaagaggaaagatgattatagaataacagatccaggccgagtgcggtgtggctcaggcctgtaatccaagcactttgggaggctgaggcaggtggatcacttgaggtcaggagtttgagaccagcctggccaacatagcgaaaccctgactctactaaaaatacaaaaattagccgggcctggtggctggcgtgtgtaatccagctactaggcaggcttgaggcaggagaatcacttgaacctgggaggcagaggttgcagggagccaaaattgcatcactgcactccagcctgggtgacagagcgagactttttctcaaagaaaaaacaaaacaaaacagatcatgtgttctgtatgttaataaattactattgatttgggcctatcagaattgta

SEQ ID NO: 78245 - DNA, 1009 bp, Homo sapiens
agctgtgttttcattgctagttcatttggcatgctcttcaaaaaaataagtatttttttgtaggcattctgagcgtgtgatattctttatcataccctgctttgtagtctgtggctgaaggggaaaagagaagtaaatggcagattgtacttatatgtactttggagaaaatatctgcgagtgtaagctacagccccagccacagaatgttcgcacgggtgggagggactcttgctggacaacgtgccacagtgctgcacacgtttctgtctgctcaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgtgagtggctctgtagcaaatgtggtgctaatgtttaaaatggagtcactgggaaagtcatagaggttctgtttgccatattcttttcatattagaacatattagaacattagaacatgcaaaaatgttttgtaaatataagccacaatccagagagacaccattaccttcaacaaggtctgccccgaggtctgtcccgaggtctgccccagcttaggctctggagcttccttgcccctctgtagcttggcttccatgccatcagctgctggtctagcagtggtccaatctggccgtctgaatttggactctgggcaacctctctgccccttagggtgggtgctcttggcattgccattctctttgaaactcccctggccctctggacaccacctggctctcttgccgcctctctcatcctccccttggcttcccttgccagcttatctttctgtatctgcaggggaagaaacgatcttggttttcttcttcttcttttt

SEQ ID NO: 78246 - DNA, 1079 bp, Homo sapiens
gcaaaatgtagggaaacatgggtcacaggcctttaaagctgggaggtttcaaactgctcccagggatcctgccccagagccgattgtggtggtgaggaatctagcccctccacttctctggggatcagagatgcaccattttcacctgttgctacatatttggttcccaaataagattttattttgagtcagggttttccctgctctcctagacctccctcaaagcgcgggagaaggatctgaggcatgaaatgcagccatggcccatttcgtcaaactgtggtctgcactcaagtatttgtattctagtctaaaaagcttttcattactcctgttcaactgatggataagccagattgtcggcgatcctacatttgatgttaaaaactgatcatcttttctaagattcttagttaaaatgtatttaatattaaaaattttcaggacaggatgtgtatagcacgtgtaagatgaagtgttgtcctgggtctgttttataggaggacaaagacactgattctaccaaagagcctctggatgaccttttccccaatgatgaagacgacccagggcaaggaagtgagtgatgggtgatgcaggcatgttaccgagtgcagaagagaggtgttcctcctagaacacggtcatagcaatcagtggcagccttagtgcatgcggcctgcctggaggaagcaccaccagagcggggttgcctttggttttccaaaataatctgtgttgtgatacgggaatatgctagagcagaccctaggatacagcggcatgcacgtgcagttcaggcgtggtctgcagattcttacagggtgaagaggtcagaattacttatcctgcttgtttcatggcgccaagaggagtctcatggcactgagtggccatgttgccatccctgacactgtagtcactactcttaccctgcctgcccagacagtactaggaaaagatttaaatagcactgggggccaagtactaacttgaaccaaagttagtaaagataattttaaagaaactgactcatctggataattgtctttaaaaacccatctgaagtgaactttctc

SEQ ID NO: 78247 - DNA, 1091 bp, Homo sapiens
tctactaaaaatacaaaaattagccgggcgtggtgacagatgcctgtaatcccagctactcaggaggctgaggcagagaattgcttgaacccgtgaggcggaggttgcagtgagccaagatggcaccactgcactccaacctgtgcaacagagtcagactctgtctaaaaaaaaagaaaagaaaagaaaagaaaagctgtagtgatctacatctgaaacacttaatgtgtgtttttccatttagggatcagaataaatacaaagatgcagctaacctactgaatgatgccttggctattcgtgagaaaactttgggcaaagatcatcctgcggtttgtatatccagttctttcattcttttaatattttattttccccatatatttcttttatccaactcattttaccattaaactcaacagggaaagtttaagtgctgccttttccctagatggtgcaggtaggaggtcttcacttactcagtgctagtgacaggccagagcacacttaatttgtttatgaccccacctcaaatggatcaccaactgtattgtttgattgtaaatcaaattgcatgtccttctagaaatttttttctgaaaattatattgtcttcattaaaatctggtcagatttgcatatgaatctgttttggttggctttgtggcttccagggaaatttttaaaaagtcaggaatacgttgttgatttgtttaattttagtattctgcagtgttactttgtataatctatactctagtgaattgcgcttttcattttaactgaagtcatattgttctatccgactaagaatgctttactgtatagattgaatataaatgaatatgtggtgtataaatgtactcttatttggttatcttttaccattcttagtggttctctctgtgttgacaggtggcggcgactttgaataaccttgcagtcctttatggtaaaagagggaagtacaaagaagcagagccgttgtgtaaaagagctctggaaatccgagaaaaggtacaaaagaagggggcagtcgttttctttgagatttttgttttgtgtgtgtgtggttttttttttttttttga

SEQ ID NO: 78248 - DNA, 1068 bp, Homo sapiens
gctaatttttgtattttttagtagagatggggtttcaccatgttggccaggctggccaagaactcctgaccttaggtgatccatctgccttagcctcccacagtgctaggattacaggcatgagccactgcacccagccgcacaaatggtattttaacctggtattttttgtgattatttatcagtgattcttatcagttaattttgagccacatggcaaggaattgggggagagaaaataaaaaggggctccttatcaaattatacaggtaatattttatcatgctgtcaatctgcatgatatttctgaaatagaatggttgaatttggggtgggctggagttaaagtcagggagagcacaaaagtatcaaattaaggattaggaaccatataagatgacctgccaaattcattcatatatttaccctttcattcatttagagccccctgcttagagttggtgatttacagatcagacatgtagttcctcccactaggacacagtccactggacagactgaggaccgcagagggcacatcagcatctagaatagagagctctgggaggatatgaagtgtgggcttctgcgggccagagccagggggtgttggggatggtttctcagggaaggtcggtgttggaactgcatcttgaataattgagttaaaagtgtcctaggcagggggaggtagggaatgcagaagggagtagaaaggcagcttacctccctgaggaccacatgtgtaaaggcacaaagcggagagaactcatcacttgttcaaggtactgagggaggaggttagtgttcattcatctatctctgtgccagacccctttttcgatgcggagattacattggtgaagaagagagacaaagaatttatactcttggggcttacattgtaataaaaaatattcaaggtagtttagagaagtgattcttataaagaacaaccaggtgatgtgcctgtgagttcactaggtgaggtggggtggtatagggaagtctcctttgaggggaactgaggagaaccctgaaggataagtcgtagctagtagggagggc

SEQ ID NO: 78249 - DNA, 1048 bp, Homo sapiens
aaggatttaaatctgaaagtgtagcacagtcgtgcttatgttgaggaagatcctgatgtgacagtagggtggagaatggattggatggaagcagaacaagtgtctctaatatgctgttttttattttcaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggtgtgttgactgcacagcactagggagggggccaggagtgctttcgtcccaagtccaaacactttctcatttaactggagattaaaatgtatgctttatttacatctgaaagatatgaaatattttattttattttattttaaggcatcctgctatttgaaacaaggaaagttcaagcaagcagaaacactgtacaaagagattctcactcgtgcacatgaaagggagtttggttctgtagatggtaagaaatatactcccgtttcaagtgaatttaattgtataatgacttgactaatagtaatatactaatagtattagttactgtttattaagcacttaactttgtacatcactaagctaaatagtttaaatgtgtgatttcacttcactttcacagcagtcttgtgcagcgggtcaaacattaccccattttaaaagcaaggataccacaggccgggcgtggtggctcacgcctgtaattccagcactttgggaggccgaggtgggtggatcacgaggtcaggcgatcgagaccatcctggctaacacagtgaaaccccgtctctactaaaaatacaaaaacttagccgggtgtgatggcggccgcctgtagtcccagctactcgggaggctaaggcaggagaatggcgtgaacccgggaggcggatcttgcagtgagccgagatcgtgccactgcactccagcctgggcaacagagtgagactctgtctcaaaaaaaaa

SEQ ID NO: 78250 - DNA, 1018 bp, Homo sapiens
gctcacgcctgtaatcctaacactgggaggctgaggcaggtggatcacttgaagtcaggagtgaccagcctggccaacatgacgaaaccccatctctactaaaaatacaaaaaaattagctgggtgtggtggcgggtgcctataatcccagctacttgagaggctgaggcaggagagtcacttgaacccaggagctggaggttgcagcgaggcgggatcacaccactgcactccagcctgggcaacagagtgagactccatctcaaaaaaataaaaaaccacagaggcttcatgatttctagtttacttagcaggctctgttatccttcatttatagtacaggttaaatatcccattattcaaagtgctccaaagtttgaaacttttcgagtgccgacttgacactcaaaggaaattccccttagagcagttcagattttggagttttggattaaggatgctcaacctgtatgctgtgttttcttccctagatgaaaataaacccatctggatgcatgctgaagaaagagaagaatgcaaagtaagaatttattattttgagattttctaaattgtatatactgcattcaagataattattcatttgaaattatttcttataatttagggaaagcaaaaggatgggacatcttttggagagtatggcggctggtacaaagcctgcaaagttgataggtatgtctggaattgcgtttggctggaaaaaccaaaaagcagggggaaggtaattgtgttctacagggcagcttataaatgaccaatgtgtagtgttccttaagtgcacagtcccatgtttttcccgaattccaattaaaaaaaccccactaaccttgtaaatgagatcacttacatgtataaaacccactatcatgttaggttggtgcaaaggtaattgcgattttgccattacttttacttttaatggcagaaaccatacagtaaattcatgagaagcatgccagcaggcctgggaaagccagcccctcacacacagcgc

SEQ ID NO: 78251 - DNA, 1051 bp, Homo sapiens
ggctgctgtccctgggtccaggtggctcacctgtttggctgtctttccactctatttttttttttgagatggagtttcgctcttgtctcccaggctggagtgcaatggcgtgatcatggctcactgcaacctccacctcccaggttcaagtgattctcctgcctcagcctcccgaatagctgagactacagtctgtcgccatgcctggctattttttgtatttttagtagagacagagtttcaccgtgttggccaggctggttttgaactcctgacctcaggtgatccacccgcctcggcctcccaaagtgctgggattacaggtgtgagccactgtgtctttccactcttaactttcctcatcctttaagactcagcctaccattcatctattttcagaaaactctctgaactctctctagggctcccatagcacttaccatagattacttgtttcagagacatagaaaatagcttctttatttctgtacccaaaatgcctattgtaagtaagtgaacagaactctctcgaagtacttatctatgctaaaatgaatctaggtttatttataatttttttagtaagtctgctctatcaagaatgcagaaacatcaagctcaatgatacagtttgaaaaataagaaagaaagaaagaacacagaaacacagccgtcctctcggccatctgcttattgcttccctggtacatgaagcatttatcctctgccctcacaccccactgataaggaggttctgctttgctgtcttctcccgggtacttgaggggagacggcagcacgtgagcagcaacattcagagcactgttcgtcgttactgtcagcgcagaccaagtcgtctccagggaaagcatgctgataccacacagacctggcccagatgtttctgttgacagagtggccagtggtctgtgagagccgcctcagcctggatggagtgtggtgttagcctggcctgcaggggctgtctacaggacgggccagggtcatgggaggtagagctacctgagagggaagaacgctttacaatttt

SEQ ID NO: 78252 - DNA, 2330 bp, Homo sapiens
tcacagtgagatactacctcatccccactagactggctataataagcgaacaaatggaaaataggcattggtgaggaggtggagatgctggagtctcatgtcttcttgctggtgggaatgtaaaatggttcaggcattggagaagtttgatggcttatctaaaagttaaacttagaaaaccacatgacccagcagttgcagtcctaggtatagacccagaatagttgaacacgggtacacaccctgtgcaatcccagccccatcactgttcctctgaggggtcctttgtgtttccagttccccgcctccaccctcaccccctccaaggaaccactcttccaatgtttttccctccagtgattaagaactgttttttttttttttttctagcgaagtatctcagaaatacctaagaaaatcttaagtgctaatgggtcaaaccattttcccctgcctggctcacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacggggtaagtacagtacacagcgggcacgtgctccgggaggcgcccccaagtggcgcttgccaggccttcctcctgtctcatgtgctagaccttctgcttttctcaaattaagtgccaattaagctttctgtaagttcttcacttctgctaatactgaagtctgttatttgtttaaagtggtaattttcttctcaggaatccatgaaagctgtttggcttaactttgagcacttaaatgctgattgagtgtcctggctatttaaagcatgatccctgtctggtttcattttaatattgggatcagtgtggcagataactaacttgcttctttaactcacccatttcattgctaactccagtgctcctaacttcactgaccaggctgctctagattttgttagaatgagttgaaatgctttaaagggagatgctgtttaagtggaatttgtttttagaaaacaggtcagaaacaagagcttacatggctgctctcttgatgtcctgcctcagtcctgagcgtcctgcatttcccctgagagggcgtccagatctttggggctggctcttcctggttgccagcccgccatgtgcctgagaggctgcacagggccccctctgggttttactggtttgcccctggaaattcctaaccactgctgtttatccagtggttgccaaagaccatgtggccttctggacattttttctccagtgaattttttagcacatggatttttttttttttttttgatacataagctgatgtctttggtattttacttttgtcagggagaattgaaggcggcatttgactcatctaggggcacagttggttttttgaagttgccgtagtacagtttgattagttataattctacagatgttctgccaaattgtagttttgggctttcttacaatgtaaatccttttattctttaggattttctatagctatagcaatttggtaggagctagcattctaaataaatattttataaaaaatgttagtagcaaaatttgagggagaacattctctttgactgtctatctggcagctttcttgctttggtttttctctgtgccaagacaaccaatcagcatctgctttgcccactcaaccccagttgggcagtagtctaaactgaaatcctggcccgcaggcctccctgtcgcccgcatcctgtcagaactgtgtactgtactcttctcttggttgctgtcgtatctgcatgcttcgtatagaaggacaagtcctttatctaggctgtaggagccagggtgcagattgtgatcctcttgaatgaagttctggaggaagtttctcttgagacagtatttctaggtccatgttgacatgaaatcatctgatgataaaatggtgacgattcagagctctgttaccatcttaaagatggactcggagaggaaggagaactcgtgtcccctgcagggggttcgtgggcaggtgtccccgtcaggcccgcgggctggaagtgtcgctgctggggatgaaagcagctgctcctctgcacgcctgctggtttcctccttccacgcttcctttctcactttggacacctgattctataggccatgtgcaggctgtgtatctggtgtgtcccctgatagctctgcaggtttgatggaattcatcccagggtgcgttggccacgggtgatctaccaaaacagtttgagttttaaatt

SEQ ID NO: 78253 - DNA, 3532 bp, Homo sapiens
ggccttccccctggttctcacagccaaggtcctcaggtggcaagttcagggaagcaggcagactgacccagagtggggcagacccgctccactgccaaccccaggtgctggtctgggtctgcagaggctcagggaggaggaggcagctgggtcggaccccaattctgggactcctgggcccattgcccagctgtcagctgtcagcttgctactccagcagctgcagaggggagagagagcatgagtgagcgtgtgtgcacgcgtgtgtgtgtgtgtcacatgaaatacttttgaatctgagtgaaatgaatcttctgtgttctgccaagcatttagttgaggtgtattataaactactgtagtgtagcgctgagttttgaaatgaacagcaggggctgcactgttaatgacgatacgttagcattttagcatcctttttctcaagagcagcaaaaacttatgttttcttgtcctccccacatttttgaggtgttggtaacaagtgttatttttccattttaaagatgaggaaaatgaagctcgggctggttaactgacttgctcagcgtcccatggtgagtccgagcgggcggggcgcaggccctgccgtctggcgcttctgtcgagacgtcggctttccaacctggcaggacccaggacgcattgctgcctgtggaaattaattttcttttggattatcaactgcatgtttaaaatgggctgtagacttttaaagtccgtggtttcctaaagtttctgaaatgtctaaaatgtgtttttaagagaatgaaagtcatacctgtagcctttattttggtccctatgtttttcattgcataatctccttatatacagttacttgtaaagccttttacaccaagtgtcaaggagatttctaatacgttgccaatctttacgcttaaagtgttgacatttactttgatgaccattgggaatggaccagtctggattctgtgaaatgcaccatgaggcccagcacctgctttatgctggactggtagaagcaggcagaaggtcatcccagtcctaaagccactcagaaggctgctgagacttgtgacctagaaatactgtaagccaggctgttatgcagagcctgttgcctttcctcgccgcggtttcacgtgggttttctctctcctttctgtctgacaggcctagccgcccgtgactctcacactgtctcctgcatgacgggtggcgcctcccgcagcttcccttctctctccagtgctgcccgctgtgtctagcagcctctaggatcttgtcagagctgcacctctctgtgaactggccattcctttcggtgctgctgtcctttttgggggggttcctgatttctgtatacatgtagctttgccagatatgtacttagtaatataaactgtattaataaaatccatttactgtgtaatacacgagtttaaaaattaagagcgattagctgttcactttggtaacaggtagttaagtgtcacacaaggtgttgttgcaatggcatgacggtgacctgttgacgtaactaagccttacagcaaggcatgtgccgcacgtgctccgtggtacttagagccctgggggccccgctcggactccgggtctccctaggatatgccccagtagcatttgctgtgtagtctgtgtgtgaaatttgggcattctgcttttctctactaatcttgaagtgctcagtgatttgtgtatttgtgtctttctaacttctaataaactcactccgactgacctgtgtcttggtgtctgtctgcttggtagaacttctcactctttatccatgaaacgccgcatggcacagctgctaggggtcatggggtgacagttcatctcaccaaggagttccttccaagaagaaatgctgctgtatgcacatcttcttcactctgtgttttttattttcatgttcagatactgccaagtatttcacttattaatacctgaatcaattaagatgagagctgggcactctcacctccctacaaggttgtctgaggatttttagttatttgtatagaatgggcattttatttaattttccaaccacctttgtagttaacatttaatgaaactgttctgtaaaatttactgaaggaaacagtacctccaactattgcatttagacgaaactgttaaaaggaagagcctctgtcagatccaaatggtttgggtcctgtactgtgttacttgtaccagatgcttatgtatctgttaaatgtggaagtcgattttgatgatattcttagaagctgctttaattttcctgagactttgtgtgttggcttttgtctcaaaatagcaggattcacattgcttttgggatgcgatcacttgtttgaatgagcttccttatgtccaaaggttttcatgatcattggattatctttaatgaaacttaaaaagaacaatttctagttaaagtatattcacgtacatggtaattggtggtttctgcaagactctgtcagcagtgagctgctggcaagcagggcggccttggtggagctcttatttgcacccggtgtggctcttgtgggaaggagggagaaccacctgcagcttcacgtttgttcacgtttttttcaggatggcactggatctttaaaacgcagtggttcctttagcaaactccgggcttccattagacgcagcagtgagaagctggttaggaagctgaagggaggaagttcacgagagagtgagccaaagaaccccgggtaactatctcttccagctctcccgactccctgcacgccggctgctgggccgcttctcttcctagcgcagccttcctcacccacagacttgaggaaagacactccagttggttcccgtattctcacaaccgaagggtttcatagttgccacgtaggtttttcccaggataggttgagaagtaattgggtaacttcctgttagtggctaaagggcgaatacctttaaaagaaatttatggaattttttgattctgtcacatgttctaagaaagccttagcaacgaaatgtgggcatttatattaaaatgttgagcattttgaacttgtttactctagatatgcattattttttaaattagcattagtttaaattctttaaaaattttaatcttttaaataaatcagatgttagctatgactatattaaatctcatacagtattataatagggagaaaaatggtttcaaataggatcagaacttttaagactttattataaggagattttcaaaacctcaggcttttcatatgtttaaaaaaaggtttgagtcatgggtcttagaggcttttgaaaaataacatttaagttgtcaaaggaatttggttcttaagatatcctttgtttttaatatggtgcacaaagttgacagattgtccctgccgcagtgtccagggtcacctctgggcagctgctcctggcttggacgtatttctcatgaggcagacttttgccagccactctgtgtaactctgacttcctaaatggtgaccgactttttaga

SEQ ID NO: 78254 - DNA, 1774 bp, Homo sapiens
aaaggttttgaatgccacgtgttcaaacaaggcagttcgcaagagtggtaggaagagacgttgaggattcgagttgttctttcgtttcgtaaaagggggtttgagggaaggttgtgtagctcttttaaaaagagttaatggcggccggtgcagtggctgatgcctgtaatcccagcactttgggaggcctaggtgggtggatcacttgagatcaggagtttgaaaccagcctggccatcatggcgaaaccccgtctctactaaaaatacaaaaattagccgggccaggtggtgcatgcctgtggtcccagctactcaggaggctgaggcaggagaatcactggaacccagtagggcagaggttgcagtgagccaagatcacaccactgcactccagcctgggcgatggagtgaaacttcgtctcaaaaaaaaaaaaaagttaatggccactttatagcaagaataactgagtatgtcagatgataatttacttgtgatttggtttgattttatactttgttcttgagtggttctaggtagagaaaaacctgtttgggactccagcaatgtctgttgtgggcttcattgggatgtttttgttttgtcctggttgggacattttgggggtgagttttgcctggggataaggaaattcaggtcttgcttttggtgcagttgttcggcaggggctggctgagtatctgccatgtgccaggcgctgtgctcacagcactgctgacacacgggtgggtgccctgggctttcagcctcatcccagtgtcctgtgtgaggctgtccctgtcacccctcaagcctgtgcctcagcctcacagccaccgtccttggctttcccaggaactgctgcgctcatgttcgctgtcccatgttgcatgcagttcacgttcagaattcaagtaaccctcagtatcggttgctttagctttaaaacttcaggggagtttatgttcaaaggcatccatggtggtggtgaacaacgatagtcattttatgactgtccatcatttaagttatagattatttataggctgtttcatcaagtattttaaatacatcagatggaggaaaagtaaatatatgtatacattcctgtattcctttaagtggagaaccatgactttatgttacattttgctttctaagtagaaaaatactggcttcagagtttattttactaacaataaagttgatttcccagcttttaatatagaaagataaaaaatatgacagtatatttatgcatcatcttttagcagtgagttttgagtgtctcttcatgatcccttagtggtgacgagtctgacatgagccctggagcaccctccctgaaaagcatcagactgaaggcagagcctctctgctcccagatggttccccccactttttttttttttttttttctgagacagagtcttgctgtgtcgcccaggctggactacagtggagtgatcttggctcactgcaacctctgcctcctgggcttaagtgaatcttgtgcctcagcctccagagtagctgggattacaggtgtgtaccaccacgcctggctaattttttgcatttttagtagagacagggtttcaccacgttgcccaggctggttgtgaactctgggcctcaagtgatccacccgcctcagtctcccaaagtgctgggattacaagcatgagccaccacgcctggcttttttttttttttttttttttttttttggtaggtggagtctcactcttgcgtaggctggagtgcagtggcg

SEQ ID NO: 78255 - DNA, 2182 bp, Homo sapiens
tttttaaaagtgcaagtctaaggacattttgagtttgcatatggtactttaaaagaagcattttgctgtgaaagatgcagagaagctgtggtcttttctcctgggcactaaatagagtgagacataggactccccggttacccaagcaagatgaaggcaaggtccctagagcccccagtgtcacagaggcgttggagggggctttgcttgtgcttcctgttgctggttgaccgatgtgctgatcgtttgtccttgcatgtccgtgtccgggttgcagcatgaagcgtgccagctctctgaatgtccttaacgtgggtggcaaggctgctgaagatcgctttcaagtaaggagcctaccccgaattgtgtcctaggctgcccagaccacgctggcaggtctgctgcagacccgcactcggcccctgctcggcccctgctcctgcagagggctggggacgccgccacgtttgttcctagacagacagttgtgacagtagtatttttatattctgcttaaccactgattatgtgaattatgggcatgttcacactgtgaacattctcagaatattaattaatgatctcaaatggtctttaaaaatagtttaacctaattaatgtattctgttaaagtactgtcaaagctcgaccaattactagtttgtatgattgtttgattttagcctctactaagtttataactattaataattaattgtctacttaagctgttgttcagtgttcagaagtattcaaaactctgttaacatgatgactagcgtgctgtcagtttgacactaaaacctgaagcactcggtgcagttgctcgggcctcacacagacacatcaggtttacatctgaaagtactgcctcccttccccatcacggaggccgtttgagttttcatccactccgccctttggtgtggctgtcagtgggtggccgggtgcctgtggctgctctagaacctgtttctcaggtgcctggggcccacccggcagctcgagctgttgggacttggcagtccctgcccctgtgctggtgctgagagttcgcgacagtggccaggcactgccctcccagttgtccagatccactaatcctcacagacaggccagtgccccgacctgtcccccaacactcttgggaggcagccatctcgggaaagcttttccccagcccccttctcggtggctgttaaagaggcttgtagggtgctggacatgttgcttgaagcacccctaatgacaagaggaaagaaagtctcttcattttacagggtcctgtagctgacccagtgtttgccctccagtttcttggagtttctacatgcacattgacccctgggcctctcgagtgccaacctagatttagctgtgcagctggtactgttaggcctgaggccatttgaagctggcatcatttgaagtcctggttaagtgtaatttttctatttgttttttcatgcaggaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtccaccaaccttggaggtgccttttcaaaacacccgggaggccgtgcctcagcattctgttactcggcctgcagccccagtgccaggagccaccccgaccgcgacccggccaggctggctcagggaggccgaggtggcgctgaggtggcttcagcacgctggggattggctcctgctcacggatgctgttgcatttcctgcctgccacctttttgccatgacaccagactctcttttaaattgtaatattgtaataaggctgtaaattaagaatctggaaacataaagtacccctttcagaacgataggcatttagtgatctatggcagtaaagcctgaagcttagcggacactggtcagtgggaagtgaattccttcccagctggagcatcttccgggtctctctttccaaggtccccatgcctgtggccctggggccccatgcccccttttgagctgtgttctcccggacgcccctgcacacgaagcccatagagacgtgtgtttcacttttttttttttt

SEQ ID NO: 78256 - DNA, 1007 bp, Homo sapiens
tgtggagagaagaagcaggcggctcccagggagtcactgtaggacaccccaggctccagccctgagaatcacctctccccaagggccagctcagcagtggggaccaggtacccagcaagcgggcctgtccccagacccagggagaggcagaacatccccccagctcagatgggggtcagtctgtggccaccatcttcggatgagaaagtggagccgctgccctggaagagctgtgtctgaaccaggctcccagctgtgccacggcccaggcagacgcgttttaaaggcccgagccccgtgtgtcggggcttctcaggcagggctgttgtgcagccgccaccgtgtcagtgggactgggtcccaggtgtccctcgcaccccttcggcactgatcgtgtaggaacaggaggaggggggcaggtggggggcagagagcacccgcagggtccgggctgggcagccgagggcagcctcttcctcgcggagccggtcagccagcagtctcaccaggagctggttagcccaggttatgccaagggctggggaaacacgttcgtcccagaacctgagaaacaggaagcaggcaagctggcgctcaggcttggtggccccgcccacttcggcccagctgtgcccctggcacctgcacagaggtgcacacaccacatggctgcactcaccccagcggcccgtgtgctgcgccctgctcctccatggcctctgtcacctggaagagcacagtccaggtcagctgcaacggctgagggtcttctcgatggttaggcacaggctgctacccgcaggagccggaggccacctcactgccacccgccccacctccagaccggctctgcttccgcatcctggctaaaaatacgagctcaggggtgcaaccctgccttggtgctcacctggttgatgcacagcacagggctctggaaggcactgctcagctcacgcagcgtggcccccagggactgcagatgcctggccctgggggcggaggcc

SEQ ID NO: 78257 - DNA, 1092 bp, Homo sapiens
agaagcttcaggctcacacaactggttcccttggccccatgtccttcctctggcccccccaggcagtcaccccttggctgtgccaacaccgtcctctgtagaggtgtcctttgcgcaggctcctgagtccttgcgggggtctgctctccttctgccatggtttcaccctctccccctcacaggtcagcagcaaccagccccctccttcagtggccccgcaccaggtactcagaccacccaaacctggccacagtgccaccaaagccagcccgtggtggccatgacctcttcagacgctcagcaaggcaggggcctgatgcccttcaggcgttactcaggcgagtcaggcctggcctgcctctgccaaggcgtggggcactctgggagaccacctgggggtcaggatggggctgtaggttgagacaccctcaaggccagtgcctcccgtgcatccaggccttagccctgtgctctgagctggcctggcctggccaaggggtggaaacagccctgtgcccaccagctcccaggagagcttccaggggaggacccccccagtgaaggcaggtgtcctcggcctccctctgggtgctgccgtggcctgtgggtgccagagccattggcatggctggcctggcctctgaccgcacagcttggtgagccatggtgatgggggagggtgacacagctgctcctggcaccaagcagtgtagttcaggccccacgggccttgccagcagctctggccagatggaggctgctaaggggcccctaggctgtccctcaagtccaaggtctgcagccacacgctggtgtcacgcccggagctctgaagacgcctgagggccgcctgcacgccctgagtgaaactcgtctgtgcttcatctccagggcgtctctggccgagcctctttttgtggaaaacgacagcagcagcagtggcctggaagacgccaccgctaacgtgagtcccacggcctgcagccccaggaagcaggcagctgggccagggagggactttgcacatgcagggactggggggagctggggatgggcaagtggtgactgctgctagctgccaggctgggcctc

SEQ ID NO: 78258 - DNA, 1038 bp, Homo sapiens
ttgtctgatctgcaggctgccaagctcctctatgaatctcgggaccagtaactctacgtggggctgagcttggagtacgtgtggtcaccaggactgagtcgcttggaacagcagagcctgctccttgcgtaccacagggattaatcctgcttgtgctgggaaatgcaactcactcatgtatttggagaaacaggagtgttcacttatctagtgcaatatgttcacagtttattaatgctttaaacagcttcatgttttagaatttgtgtattgtcaatacttaattgggggtgggagagactgagctacactactgctaaactatttttagcataatatataccatttttatgagttcgcaggtctactagaaggttctggcccatcaatattcatttcatttaattcttccacagaaccagtttgggcagtaggaactcaggcttctggtctgcagtggagcctgttcgcctctaatagccagtttacagcacttgccttagcctgtttcacagacttgtccacttaccttgtcactaatttggggcttctgggctgtgagtgatcctttgatacttcaccaaggggaacgtgggggctttgtgttttgtacttttcactcactatttcactttattaagatgactgtacagcaatttgtatataaagcttatgattaaaaactattttgaacatacggacaaggcctcgccttcctgtgtccagatcacctgaaccctcgtgccacagcgcagtctgggtccagaaagaagactcacagccgccggggtgagacgggtttattgtgcacatttacacagcgtcagcagcgtctgggctggcagcggccatgctcctgtggtcgggctgctctacaagggcgttcacttttcttcaccacactatgtacagtcagtgctccaaggtgatgggctacagtgctgcatcagtgagtctgtacacacatttttacataaattacacacgactcatacatgaaaaatagagcctaagggcctgtattttaatgagaaaaaa

SEQ ID NO: 78259 - DNA, 1206 bp, Homo sapiens
agagcctcagcatatactcttctcctccgatctcacagcctgtcatgctgctcagtgtggttctcacccctgcaagctcaaattcagttccctgaatggagtcaggtgctggaggccgtggcagcggagggtggttggggttggggctgggggtggactggtgtgagggcagaccagggccaggtagacggggctgtttggtgcctgaaggatggcagacgcctggtgtcaggaggggccgccaccaaggagcagcagctggggcagaggagctggggtcaggggccacccctctctgccgatctccctgcctgggctggctgtgaggccacctttgtcccaggcccagcctcaaggcaaggagggcgcttcactgaggtgtgaattgtacgtacaggctttttatataccaaaagtattttttgactagaccattcaaagctacccgaactatgttggaaattttttttttctcattaaaatacaggcccttaggctctatttttcatgtatgagtcgtgtgtaatttatgtaaaaatgtgtgtacagactcactgatgcagcactgtagcccatcaccttggagcactgactgtacatagtgtggtgaagaaaagtgaacgcccttgtagagcagcccgaccacaggagcatggccgctgccagcccagacgctgctgacgctgtgtaaatgtgcacaataaacccgtctcaccccggcggctgtgagtcttctttctggacccagactgcgctgtggcacgagggttcaggtgatctggacacaggaaggcgaggccttgtccgtatgttcaaaatagtttttaatcataagctttatatacaaattgctgtacagtcatcttaataaagtgaaatagtgagtgaaaagtacaaaacacaaagcccccacgttccccttggtgaagtatcaaaggatcactcacagcccagaagccccaaattagtgacaaggtaagtggacaagtctgtgaaacaggctaaggcaagtgctgtaaactggctattagaggcgaacaggctccactgcagaccagaagcctgagttcctactgcccaaactggttctgtggaagaattaaatgaaatgaatattgatgggccagaaccttctagtagacctgcgaactcataaaaatggtatatattatgctaaaaatagtttagcagtagtgtagctcagtc

SEQ ID NO: 78260 - DNA, 1048 bp, Homo sapiens
tttgtctgtttccagtgggaggtaattagcacagccagctacttctctgctgacttcctttgagaaactccccaaggtgagaaatgtctcctgtgtcccgtccttgttggtgtctgctgtgctgcctcaaggggttgcagcaaggagatgccttcacgaagccctggtcctagcctctgctgtggatgaaagtcatggacacggggaacctgtgctcaccttcagagtcggggcagcagctcagcccagaggtggagctgggctgtgaagcctcctggcagggactctaatcccttgctgttggctgtcctggttctgtgtcacacagatggccacagtaaacccagagtgaccagctcatggacagtgtcagacctcgacgtcgggcctaattatggctcctcgcggccctctgcaagcccatttgtaaaccgtatgttggctgacaagcttagtgggaagctgcgtcctctttaatatgtacaaaatcacctgtcacttgtttttccaaactgacaaaggtctgctcatcacatctagatttgaaaaagatgccacacaaacgtaatttgtccctttcttcaacagacaggtatggagtctgggtggggccacgtgtaccctcccatccttagaaagagtgtgacaccaagggacagatgctggcgtagcgcgggttttgttttggagggttttttgtttgtttttacaaaattaagatatttctgagtttattatgaggcttttagttttacaatcatactaaaagataattgttcctctataaaatgattttccttctgtacctcttgccttcttctgaagaaaggagaaaattgctttttagtccccactatggctgatttccataaaacttcctgttgttgctgggtggtttctgaagcacctggacagccacattccctgtgaccctgagaccacaggccctgtccttggggaggctgcaggtttctggccacacatcctccaggccacgtggagcaagatggcagttggtccaggggccttggaatgcctcgccaggacc

SEQ ID NO: 78261 - DNA, 1032 bp, Homo sapiens
catttttctttttgagtatataaaagtaatcataagtttcaatttttttttttttttttttttttttgagactgagtctcactctggcacccaggctggagtgcagtggcacgatctcagctcactgcaacctccatctcctggtttcaagcgattcttctgcctcagcctcccaagtagctgggactacaggcgcacaccacgcccagttactttgtgtatttttagtagagacagggtttcaccatgttggccaggctggtctcgaactcctgacctcaggtgatccacctacctcagcctctcaaagtgctggaattacagatgtgagccaccgcgcccagccttcaattttcaaagttacatttttctttcttttgttaggaacagcgtttacattttctaaagcaacaggagcgccgtcagcagcagtctatttctgaaaatgaaaagcttcagaaattgaaagaacgagttgaagcccaggagaacaagctgaagaaaattcgtgcaatgagaggacaagtcgactacagcaaaatcatgaacggcaatctgtgtacgtgcctgcaacaccccctcgacaccactctcaccaggcccagatccagtgaaacatagtctaactgcctgacaattcagtcacaaattcacaggactaaatagcaagcgtgctcaagttttgctctgttatttgcatctaaaaggatgggtgggttaggttaagtgatcttaaaattgtgtagtcccagctacttgagaggctgaggtgggaggattgcttgagcctgggaggtcaaggctgcagtaagccacgatccggccagtgctccccagcctgaatgacaatgagaccctgtctcaaaaaaaaataaaaagatctcttgcggccctcagacgcagtagaaaaatcctcttgttacgttggtaccagcggccctttggattagggtggggcgctccaagacttactcattcagagggtctgtttttcttgaataacttaacttgtatccgtgcattaagataagt

SEQ ID NO: 78262 - DNA, 1113 bp, Homo sapiens
ggattggaagcatcacatcaaagatgttactgtattttatggcttacacatctaccttttaagcttaataatacgttaccttctaaaacactttattgtctacagagcggttttacgtgcattttaagatatgaaaaacatcttcccccaaaatgtttctgtgtataccttggttatagaataatgacatgctaataagccttctaacttctgggctgagacatctaaggatagattaaggagagctgtgaagaaaggggggagtgtgggttggaagagaagggcaggatgctgagttggtgtgattgatgtccatcagcagctgctgaactaagaagccggggaagttctgctctctgaaaattgtaggccagcaagtcaggttaatactactgtgctggtttgtcattatgctataaaggcaaattgatttgttctcattatatatgcctgtgttgaagcttccaagatgtccccaggttccgtggtttgctaggaccactcaggactaagcatagagttctcttgagttgctacagtgaaaggattcagagccagatcagcaaagaggaaagacacattcgacttaggtgtcctggaagaactttttcctgtcttctcagccaagcagttttaaaatctgagtcagtttttgctttattctaggatatccagtaagttgccaagaccaattgatcctaccctcctgtgttttcttctaagagctttatagttttagctcttacatgtagttctatgatcaattttaagttaatttttgtgtatagtgtgagttaaaggattcaaattaattcttttccatgtaaatatccagttatcccagcaccatttggtgaaaagactattctctctcccactgaattgcctgacacctttgtcagatcaattgaccataaatgtgatgtttatttccagaagcattcattgctaatgtaatcacccaggcaccgttttccatatggtgcccaagactcaactgtgcctatcatctcctaggccagataacatttcaactgtctagagaaaaacttttagacttatgccaggagaggatagaggcagtcacctaggagcatggagttggggagtaga

SEQ ID NO: 78263 - DNA, 1047 bp, Homo sapiens
agggttgttgattgtatacctctttgttctttttgatttttgaaccatgggaatatactatatatttttgaattaaaatttaaagaaaataaggaaatttttttgaacacgtatacactgtacagttaaaagacctttggccgggcgcggtggctcatgcctgtaatcccagcactgtgggaggccaaggaggttggatcacgaggtcaggagatcgagaccatcctggctaacatgatgaaatcccgtctctactaaaaataccaaaaaattagccgagtgtggtggcaggcgcctgtagtcccagctactcaggaggctgaggcaggagaatggtgtgaacccgggaggcagagcttgcagcgagctgagatcgcgccactacactccagcctgggcgacagagcgagactgtgtttcaaaaacaacaacaaaaacaaaacaaaacaaaaaaacctttaacttgttaattaacagtgattatggattacttctaatatttaaaaaaatgaactcaagcaaataaaaggacaatcctttgtaaaaataatacttctttattgcaagttatcccctttatctgtattttatagtaaaggaaaatttgcccttgaatgagctactatctactttaaaatcatctttccgtagcataaggctgtcttttagaatacaccattacatctggagccaggacaccaaggctccgggctcaactcttcatctacttttaccttagaccagggtccgtcctctctgggaacatccacctgaagaggaggattagactggctgacagttgaagtgctgctttagtgctaaggatttattttaactctctacctgagttcttcagacacctataccctccctcacttatctatacttaaataaaaagtcttgccttttacttattaatatgtacataatccttaatgtcctgaggagagtggttatttttttctcactttataaagtttggaaacgggctgagtatggtggctcatgcctgtaatcccagcactttgggaggctgaggtgagagga

SEQ ID NO: 78264 - DNA, 1099 bp, Homo sapiens
aagaacttaaaatatcactgggttattgtattgaagttatataactggttgtcaacatgcgtttgtatgtgtttgcacagatggagaatactttctcagcaaaagtgtggtgggattttggtgccttgaaatgctgttgtcatagttatttcacaaactgtggttctagggctaaacagaggaatggtggtaatcagattctattgtgacactttcttggcttgattgctttgctttatttcactgcagagatagctatatgactgttgttcagactaattggtaagcaaaagctgctgttactggattttgtaaaataagaatctttggtgatatcatatagaacaatataaaactggaaaatttaggtagtttttattaaaatttatgacatttgaaatattagtgtacagttcagtacaagatcttgttagtggcattattgatgtgtttagagaaaatgttaactgaggttttagcagaatcatgatttatgccacatgttgtgattgtaattatcatagctcaagaaaatgcaaacgccatgtggtaggagcatgcccagcatgctggagaaacaaaagtaggcctgtgtggctggagcagagtgagtaagggggaaagtggaggaggtgaagtcaggtgatggagagagtagtgtaggattgatcttgtagggccttagaggctattgtaatgacaaaggagatagaaagattttttttttttttttgaggcagagttttgctcttgttgcccaggttggagtgcagtggcatgatcttgggtcaccacaacctccacctcccaggttcaaggggttcttctgactcagcctctcgagtagctgggattacaggcatgcaccaccacgcccggctaattttgtatttttagtggagatggggtttctccatgttggtcaggctggtctcaaactcccaacgtcaggtgatctgcctgcctcaaccccccaaagtgctggggttaacaggcgtgagccactgtgcccggcgagagatttcttttatcagaaatgaaacacagtgggctgggtgctgtggctcacgcctgtaatcccagcactttgggaggctga

SEQ ID NO: 78265 - DNA, 1021 bp, Homo sapiens
ttaaatgaataattgtcttgtaatggaaagagaattggatgagcatcagaagatctggggtgaaacgctggttcttccactttttagctatgtgaccttgaagaagtcaaggtctttgagcctggaattacctctaaagtagggataaaaatgtaccaatatctgagcgctgtcctgaggatcaaataggatgatgtatccaaaagtgatggttgaacagaatgtcatacaaatatttattattcttaatatggctttgaattttcaatttctaactttataagataaggcatttggaaacttccctccctaattctcactagctagattttgatgaaaggcattatggtgtttcagaattttgaaagtagttttagttaaatcctgtaatagttgattgatgcattcatactgtggtggcattgaaggatatctagaaaaattttggctggcttcgtcgttgtataatgtttaattataaatatcctgctaagaaacttggcttacattttccatatgattcattcagacatcttacctctattccacgggagtagagttttgagttcctaccttcacaggtttcctttttaagaggtttgtttagctgggaattggggcatttcttcggatttctcaaaacaataaaatactgttttttaaaaaaacaggtctattacctgtttaaaacaccgcttttgtttaaaaatgccttttagaaacagatggtatttctcttagactctcatgtatggcttttacttttgtatttcctttttgatccctaaaaatactacttgtaggactgagtccttcctctattaacacagttggagttggttgtaaatttagtaggagttttcagaaatgccattcttacttggtaatattttaaactatccaaaaatgtaaataagatttttctcgatttattgtatatttggtattcatcatgatgatgatgaatcaaaggaacgttgggtcatattttgcagtttgtgtagagcagtactgtccaata

SEQ ID NO: 78266 - DNA, 2422 bp, Homo sapiens
agaattgtgagttttcttaggtgtgaaagtggtattacattcgttttaagagatgaaggctaaaatatttaaggtatgggttcatggtatgtggtatttcattgcaccttttcaactgttctgaatatttgaaatttgtttgtaaaaaaatttggaggggaggaataaccacttggttctcagtagagcagagcagtgtggcccaatcacatgttactaagccattgattacaaagagaaaagagaaaactttatgctgcaagactaaagtttaggacattgtagaaggtaaggagccctgcaaatttgaaagggctgttagctgttcatagaacatctttggtaggaattttaccatttcttggctataagacattttctgaaagcttcctgaattgctttacctaagctacaatgccttcagctaaatgttaattttgacaaaggcatttttgtaaagcattgatatgactgcttttttttccttccttttattttagataaaagaagtaaggctttgaaaggtaagatttttgcttctgaaaatggttgggaatggaaaacagcatcatgtcttttcaggacaaggtatatcgttgttctcaattgaaatcgaaacacagttcagtatatatgtaaggtgcagttgaaatgcttcacagcttgaagtttgctatgcctgctgggaaagagaattctgaatttctgctttttatagtcaagtggatcaagtaaaacttccaggagtaatagaggaatggattaattagaggtagtcgatatcatcaccaatagggaagcacaagtgagctgtgcaagcatgctgtcctagaagttccctaatgatgtcgttttattttgtttattgttttttgagacggagcctcgctctgtcgcccaggctggactgcagtgctgcgatctcagctcactgcaagctccgcctcccaggttcatgccgttctcctgcctcagccttctgagtagctgggactacaggcacctgccgccacgcctggctaatgttttgtatttttagtagagatagggtttcacatagccaggatggtctggatctcctgaccttgtgatccacccgcctcagcctacccgtaatgatgtgtttttaatggtttggttttgttttttgggtttttttttttttgagacagagtctcgctgtgttgcccaggctggagtgcagtggcacaatcttggctcactgcaacctccgccttccaggttcaagcaattctcctgccttagcctcccaagtagctgggattacaggtgcccgccaccatacccggctaattttttgtatttttagtagagatggggttggccggctggtttcaaactcctacctcaggtgatccacctgccttggcctcccaaagtgttgggattacaggcgtgagccactgcgcctggcctttaatgtattttgaaagaaagcgccttataaatttatgccagagtgacaatgaaactgtagccatttgaatgttacacaaacccaggactggctacatgagtttgaggaggaggtgtttccctgcctctctctttgcgctgtgggtgaccactgcctgtctgctgtcattacatgaacccttaagcactctgggtgtttcatatagaaataatcctacttttcaatagtattgaaaggtgtcatttatctttttggactgttgatcaacttcttttgatacttgtttaataaattacatccaacttgttccttccttcttaaatcatatttatatatgcatctctttcaaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagcccctccggcgtgtcaggcatactctgagtagataatttgtcatgcagcgcatgcaatcagaatctcactgagccacccatcattgtgaaataattacctcagttgtacaggacttggtgatcaggatccaggcactcacttgtattctactgctcaataaacgtttattaaacttgatcctgctacttatcttgtggcctctctgagcctcttgttttcttatttggaaaatggagatgttaattatgtaagctctaacttacagttattatgaggataaataagagaaagatttaaactatgaagtcctttagaaataaggtagcattcaatgacatagtagttgaaattataagctgtaggagaatattgcatcaggaaataatcacaaggcaaagtacataataagccaat

SEQ ID NO: 78267 - DNA, 1005 bp, Homo sapiens
aggagttcgagaccagcctggccaacatggcaaaaccctctctctactaaaaatacaaaaattagccaggcgtggtggcacgcatctgtagtcccagctactcgggaggctgaggcaggagaatcacttgaacctgggagtcagaggttgcagtgagccaagattgtgccactgcactccagcctgggtgacagagtgagactccaccttaaaaaaaaaagaggtgtgagtcccctgtgagtgcagaacgggtctgacatctgacacaggcgaggctccctagcagtcatgggaaatggggttgaacttaacaaattaaaatcttttaccagttaggtttaaagcaatcatcattctaatttttaatcactgtgttcattttcagatgcttcaaagtattattaaaaacatatggatccccatgaagccctactacaccaaagtttaccaggagatttggataggaatggggctgatgggcttcatcgtttataaaatccgggctgctggtacgtttccttatgtttgatttttctgaggtcaggaagaaaattattttcaaaaagaatcacaattcacattgtaaaggaactatgggttctaactaggtatgaacattagagctacctacagtccttcgtaaaaaatacagggagcacatgtcagctataaaagacatttggggacagtggggaattttttttttcttttcttttcttttttttttttttttttttggagacagtctctcactctgacgcccaggctggagtgcaatggcacgatcatggttcactgcagcctccacctcctaggctcaggtgatttcaggtgattctcccacctcagcctgccaagtagctaggaccacaggtgcccgtcactatgcccaacaccaccacacctagctaattttttttttgtactttttttttttgtagagatggggttttgccatgttacccaggctggtcttgaactcctgggctcaagcagtcctccaat

SEQ ID NO: 78268 - DNA, 1029 bp, Homo sapiens
gccaggcgtggtggcgggcacctgtagtcccagctactcgggaggctgaggcaggagaatggtgtgaacccgggaggcggagcttgcaatgagccgagatccgccactgcactccagcctgggtgacagagcgagactccgtctcaaaaaagagaaaaaaaaaaacctctgaaacaacagctaaagggacttgcccacagttgagagctgaccaggcagagctggtgttggagcccaggattcccaggcttccaaacccatcggtcctgtagaatgcttccttcccagtcgttgctgagagacaagggattcactccatgcctctgaactcctagtctggggcttccagaaacctcctctgggtcttgtttggatcatctgtgacatattcccaaagcagggctgttcgtttcttggaacctcacactgtcagagcattcgagtagcttgaggacaggaaatttgagggcggactatctgcaaggtgttccaggagaaggacacagtcgcatcctgcaaggtcagacctcaggccaccctcacgaccatccttgcctaaataagtcctctcatagggaagagcaggaaagcaggtgttggaggtaggttctcgtcatcaggagcatgacgtacagatttggtgtgagtgcagtcctgctaacctgctgcgggatccgagtacccgctttataggagctttctccaagtacccactttataggagtgggaagcagtgtaggaagtaagtacgaaaagcacttttaaaatgctgttaaagggctagagacagaactaaccacaatcagggcagtccctgctgtagctccggcctggcctccccattcttgcctgactcaagacactaacttagttcctggttcggtgccctgttggtgctcctctgtccagtagcttagctcccacggtgggggaggaatcgaaggggctctgcagcccccaccagctgccctcgaatcccatccaggccagttccagattctaaactgaattttcttcatattgtcaaaa

SEQ ID NO: 78269 - DNA, 1020 bp, Homo sapiens
ttgatttgccttaaattatccgtgatggatttccttcttattctgttgctgatgcaaaggtgcgagagccacacagctgggaacatttctgctgtttggtttcctgtctgccctttggcagtgtacgcggaggcaggacttgatttgtgctgggtctgcttcagccagtgacctaaaaatgtcagcttgtgttttgcgttacatggagaaggggctatggtatagacagtaccgttaggacttctggcattttttcttgtaaaatttctgtctttaagtagcagtcttcaaaatgcatgtaatcaagtaatgtaagccaatattgtctaagtaacagggcttgtttagcggcatgtgagccagggcttgaagtcttttagcaaaacgaacgtggctgcagcctttttcgtctttctaaaagaatctttgtcaccttctttcccctttgagtagctcttcctcagcttcttactcccaccctgttcctcactagaatacttgcctctccctttgtctgcatgctgtgtctgggctcagggccttctttctctcagtccagttcacaagggccatggggattctcttccccttctttcattatgttcaagaaggcctaggtatattaactgggaaaacaagaaggcatcagtaattaccatagcactgagaagaggaatggaaggaaagtgagacgtgataatggaaagaaaatccctgttttagtaaacttggcaatcactagttaggctgattagaagattaaaaagccataggtcaggcgtggtggctcatgcctgtaatctcagcaatttgagaggccgagatcaggagttcaagaccagcctgaccaacatggtgaaaccccatctctactaaaaatacaaaaattagccgggtgtggtggtgggcacctgtaatcccagctactcaggaggctgagggaggagaatcgcttgaacccaggaggcagaggttgcagtgagccgagatcgcgccactgcactccagcctgggggacag

SEQ ID NO: 78270 - DNA, 1160 bp, Homo sapiens
atgctacttctctagacatctccttcagtgggaagttcagaagatagtagggcctggaatagaattacttacagaataaatccttacacctcttacactgaggaaaggagaactccctctttgaaacttagtaattatctctccacttcggctgagaaatgtcccagaatagaatcttaccgtccccttgtacattgatgtttcctaagttctagagtaactggcttctttagaacagtagcaggctgcctagcccttgggtgctagctggttctggggtggggcggggtgggggggctgtgggtcctggggtggctctgactgtgaggtctctgtctgaggagggctgcaaggtctgtctgaggtgctgcctccctgactgctgtccccgagtgtcagtgctactgacctcgggtcctaaccttgctctggtttacctgtttgtgactgacccagcttttccaggaccagcccttgcccacccttgtgagctgcagttatgcacatcatggaatgtgtcctgtaggggtcacatggctcccggtcagtgttagactggcacatcttcttccctgtgcttgcttgctcagatgacagtgtacctgcaggcctggcaggggttgtggcaaggaggggccatgggaggctggcccagtggttctctgtgcttgaggtaggtggagaggtttctggttgtcacagtgaccttgggcacagttggcagtaaatgagcaggggcgagggtgcagaacattactctgccgtctctcagggggccctaaggagaaacactgggggccgtgactgagtgggtggtctgtggtctgttggccgatgctctttgcttcctcttaaccaggagtgatactagccccctgaggaactgcatttagcagagagaactggtttagtccccagtcccccagtggtgcctttctgtcagcagtgtcatgtgtgttgcctgatgccatgtggggggtgcccccttttttattttgtaggtacacgaacgaacagaagaaatggatttcctgctattggtagtccgcaaactcttaagaacaaattcacgttttgtgaaggtaaatttgatttcatgagtaacagacatatttaggattaagattcattgtttagttttgtttctctctatagtctgt

SEQ ID NO: 78271 - DNA, 1306 bp, Homo sapiens
gcctgtcgccaacctcgtgactttctgttatgtactgtgcattttcaagaagggtgtacttggtttctgttgcatattgggccaaggttgttttcttcagaaatatgcattggattttataatattggtcactgaatagaagtcagcatttagtcttgttctatttattctaattttttaggatagtcattcttatttagaataatgtttaaaataataacttattaagaatacactaatgtattctaaagtttttactgacatagtctggtggaagatacttaaggctttgcttaattaatatttaatgactgtttaaaaagataccttcatgctgatgttaaagtaattaatgccaaacactgtttgcacatctctcctttgaaggccgtgctggacgagtgtctagagggtactgttaccggctggtacacaaggatttctgggacaactccatccctgatcatgttgttcctgagatgttggtaattcactttggtcattgtcaaagtttatttatttatttatttatttatttatttatttatgagacggagtcttgcactgttgtctggactggagtgcactggcatgatcttggctcactgcaatctgcctcccgggtttacgcgattctgctgcctcagcctcccaagtagctgggattacaggcacacaccaccacgcccagctaattttttgtatttttagtagagacagggtttcactgtgttggccagactgatctcgaactcctgacctcgtgatccgcccgccttggcctcccaaagtgtcaaagttaattttttgtagatagttttgccaaatagtctaagtgatataatttctagtgtcatctaattttgattccagaaaaatccttgtcttgccacattccccctcactcacaatctgggctcactattgattacacatcaggctactgtctagggcgttacccacattttacagttttaatgagaggatgttttctggtatctatgggctctataataggattgtctttaaatgctgctgttttctatgtccctttataatgagtaattgtgggatcagctttttttccttcctcttttctgtgtctctccccttcctttgtcctccttcttttttttcttctttccctctccctgctttcttgctctcccacttttcagtccctcttttccttctcttttttcttccttctctctccccatctttttatttttccatctctttctctcctgttctttcttcttctctctcccttctcttctctccctccctcaatcctctccatttt

SEQ ID NO: 78272 - DNA, 1020 bp, Homo sapiens
ttttggagacagaatcttactctgccacccaggctgtagtacagtgacacaatcttggctcactgcaaccgctgccctccagtctcaggtgatcctcccatctcagcctcccaagtagctgggactacaggtctgcgccaccacgcccagctaactttgtattttttttgtagagactgggtttcgccatgttgcccgggctggtttcaaactcctgagttcaagtgatctcccaaccttggcctcccaaagtgctgggattagaggtgtgagtcaccgtgcacagccaaaagatgattcttaattagctgcagtgtttcattctgtagctgtgtttatactttacccgttgtgcacttattttctagtgttttcactgctctgatgacatatgtacctttgagacatcagatttcaatgtatttttcttaggtggctgaattatatgaagaattgaagactagaatctcacagttcaacatgcatgttgattctcggcgacctgtcatggaccaagagtatatatataagcagcgattcatcctacaggtgtgctgaagtttcctggatattttttttcctgattctttctgcttacaaggtcttgtggtcgagaaactgcttattcctgctttctgatacaaaccaaacctcaaaggagattttaggtccatagtgttcatactgcgtttgggaaccaggaaacattcttctttcatagtttgcattatttgttgagttgatgattcacctagagagtatttattgtttatttattaatatttaatggattcagacccatttctaatttccaggggagtgtttctatagagtacctgtgttatcactgcttcaggagagatccttttgttttagcttttaagaaagtgaagtgctctttatatcgttcagtgtatatagctattcccctacactgaaaatattattttaactttggaggccatggattcaaattactagtagttagctggaatgtagcgagtgagaagtgtgtcctgg

SEQ ID NO: 78273 - DNA, 1066 bp, Homo sapiens
aatggggagtgtgggtggggcttggagtgtgggcggggctgtggagtgtgggtggggctgtggagagtgggtgaggctgtggagtgtgggtggggctgtgggtgtggggtgggctgtgttgtgtgggcagggctgtgttttgtgggtggggctgtgttgtgagtggggctgtagggtgtgggtggggctatgagtgtgggcggggctgtgggtatgggcggggctggtggatgggcagtggccggcagaaacactctgggacgggtgaggagctgcagggtctggggtggagtcggcctgcccagcctggggcctgggagcatctgggaatggcagcttcaggaaagggcagggtccacgtgtcagagctgcgggcaaggctctgagttcctctcccccatgcaagctgggggtgggcgtatagggccaagtcgacttcccagatgaggacacaacgggaacagttgtcttagcctgtcccagttagtatctggggcgcggtgtgtggtgtgtgatgctacctcgagggccagcaagctccttgtgcgtggctggtgacctgctcactgccctctgtccgtccccgcccagttggagtcttagtggatttagtggagtcttggttggagtcttagtggaccacagcacctctcaaagactcttgtggtttacagcgacctgtgtgctccccctgcaggcagaaccaccccccgccccatcagcttttcttctcccttctcccccatcacaacacgctcccatgttaccggagctgcctcccctagtagggggcctcctgcccgctccagtcccaattctcacctgcttcccttacgaaccccctgctcccctgagtgggaacatctaggcttccccttcccagcagcagggtggcaggcagcaccacccaggacaggaccctccatttgtagccggcagccctcaccgggcaaggcgtgactgctttttgaggcccacgaagctgccctgcggtccttgctgcagggagcagccctgggcagcctcacaaaggccttctcggctcaggtggcccagcctgccgtct

SEQ ID NO: 78274 - DNA, 1018 bp, Homo sapiens
gggccagcctttgagcacgtcccctgcacaactgaggtgcccagacctaggaaggggggctttcgaggcctggggtctgcagggggatggggcctccctggaccccgcaacatgcccccttggctgctgggccaaacatccaggcctgacatggggcctggcaggccagacagccttgctccccactgtgtggggtcctgccccggcctcagtgcctcggtttccccctacagggatggacctgtcttgtgagccatgtgctggaactgccacttgctggggcgggtgatgggcagatggaaaggactggcgtgcatggcctgttattagggtggctgcatagggcctgaatgctgtagggaggcaggccagaggcagcagccttgtcaccaggccacgttgtacccgctgggtgtggtggcacctgtggggcctctgccaggaccgctgggtgtggtggcccctgtggggcctctgccaggaccgcggccttttggcgtcttggggagctcctggtgcccggtgctgggggcaggtggctcttctgggaaggtgcagccgtgggaacagggccttccttccaggggaggggtctggctctgcttcccacgctctccttatgtgggtgaccattccgtcccgacggcggtgggagcagacgggggagtctgggagggtgggtagcaggtactggccacacacccgttggggacagggctggatggtggtctcgtggcctggccttagctccaggggaaggggtcctaggtgggcctggatggggtggggtggtgaggctcaaccccaggccttccgatgtggcagctcaggttccttctcacccacgccctgggatctgcgggcccttgtgtgggggctggcaggggtcatacagcaccggggactgccagttccaccagatgccaaagggaggcgtgggtcccagggtgccgccttccccacctaggaggcagatgccctgcggaatgccctggtgcccagcctggcctgtgctgct

SEQ ID NO: 78275 - DNA, 1023 bp, Homo sapiens
tgggtggtctggcctctggaagtcctggcccaggaatgggcagccctcgtcagcctctgagctctgcacccacgctgctcccttcctgctggggtgaacactgtgcttggtgagactttctcagggcaggctctggaggctgccacccccaccacggtgtgtccttgtcctgcggggcctcagtttcccgcctgtgaacagtccttgggctgcgtcgtcactgttgcttcttccggcgctcagggtcacttttccttccagtgtcacagtgtctccgtttcgttcacgggcgtgccctggccatagctgcctctccaggatggagtcttctaggcaggacccgtgggctggggtggcccgaggccctccgcagggctgcactgtgctccgtggagactccccagcccacctgtccccgaccccagcagcatcccaggcctcagctgtagggctggggatgggtgggtggcccagcccggtgcccggggctgatggcaatgtgtagtcccgcctggcccggcgccaggtcactcagctcagcgcgctgcattggacctgggatggtcgtgcttgcgtccctcctgcgctggcctctgaccccatgtgatgggtgttgcctgagctttggcctctgtttctggcggaggtgccgcatgctggcccttgcctggtgccctcagggagctcttcctaaatgtcctgtccccatcttccctccccagctcatagcttcggttcacggctgtagcccggctctgccctcaaaaccctcacccctgccgccaacgtggcctccacaaagccctcgtcctccagccgcttgacctagcctgtgggggctgccctgagcaaggctgaaaggcccctcctgctctcgtccctagggccccctctccccgacccccgcaaatttgccttcaccaggaagaagtgtcaggcgacctggctccaagctttatcttccacgcctggctctccatctttttctcctgagggtgggactggggccaccccatcagccca

SEQ ID NO: 78276 - DNA, 1704 bp, Homo sapiens
gcaaaggagtttaggcttttgatagggagcacatacattaagtgataaaatagaattcacacttgaggtgagggagtggctgggagaaggagagggctggccgggctgggttcagagggatgtacaggagttcctggcctgcaggctgctggtggggtgtggtgtgctggcgcaatgtccagtgagctgttccaggtcccaggttcgcccttttctgctactgggcattccttctggaagccccggaggagtggctggtgcctagggcccagggggcacccagcttccatccagcctaagtcttggggctccctgtgaacttcctttcgcagacatggttctgttccaggtcccgggaggggcctggaagctggtaccggccatgggttgggcagggtgagccggccatgggttgggcagggtgagccctccatggtggtgaggagggatactgtctgggatggcagggcctctgtctggagtgtccctcctgggtcccggggcggcttgttctgctgacgtgccgtgcctggcctctggcctgtgccacttgggacaccctgaggacgctgggccttccagaccagcccacgtcccctcagcacggggaccccagtcctctgctagcctgggtacaaaggacgcctcgggcagtggttatcgactggacacttggggccgaatgacgcttggcacctgggtgaccgtgacctgaccaggccacggtgcccaagggggtccttggagagcttggggcactgggcccttggggaaggggccggggcgaggggtggccaggctgaagcaggctgccttccctgccttgcctggggttgcatccccccacgccgcccaggaccaggtttggcctgagggttcggggtcccacgtgtctgggaatggaacgtgcggaggtggagctcacgtttgctgggctgtcccgggcgtttaattacgtttgtgcttcattatgaggaggcctccctttctgggatttatttgagctaatgagttggaaatgccagggtagtatttcagatgagggagcgccacacatcaccgtacgtggggcaattagtgttcctgccaaatagttatcgtggtttcttctctaattacgccgctgggtgctcccaggaggctcaggggtgagagggtggggggtctgtgtccatcggtcttgaccagtgtggtcgctgcgattctggagtttgatgggggagaggcggaaagtctggcttctggaccaccatctgcctccctctctgcctccaaggagtcctgctggggcagaccgcccacacaccccgagctgggaacgtgacctcacggcccaggcaggccttccccactggcctctctgccagccctgatttctggggccttcccggcttcacaggctgggccctgggggtgcagagcccccaggaatgtgctgggctctggggtgcccaggcctgtctctcccactccgggtgccagggggcagtggtgtctctgcccttgcgttccttatacgcactctctccttccctccaggccgaggcagcggtggcggccgtggcggtggcagacacggtccgagaatgcccccccgtggccggccctgatggcttgtcgaaggcctggggccgtggtggagtctgcacgtcagccctggtcacccccaccccgggctcggtggggggctccacaggcccctca

SEQ ID NO: 78277 - DNA, 1004 bp, Homo sapiens
gggagttggcatggaggggcgtggtgtgggagcctccactgggcccttcccggcagggcctttggtcctgggacccgtggcagagcctcctctcatcctgatggtgtaaggatgcggattacaggatgtaattgccataatgcctggtaatggcaggcccagccgcgggtcagtgtcccattagcagccccacgcgggtgctgataagcttgaacatgcatcacacccagcggccagagacgagggcgtcttatcagcgccggccctggggaccgtgtggtctgattgcagagtgacggggcatatgattagggcattgtcgcacgccgtgtgccgggctgagggctgatgagcacaccatcgcgttggagcacagccagaccgcgcacgtgaccagtgtggcctcagcgccaccccaattaggtgccgagagcacggctggctgggaccctggtgggagcagatgggggtcttgcccatcctgctctggggtcccccgtgtgtgggacagcccaccccgtcacaaccggcctagtcctgaattaaagggcctgtgcggctgttctgggcacagccctgtggccgtgctcctttgggtcctgtttggcaggaggatttgaaacgtggagacttccagaaaagaaagaatagctccagtgctcagagctcccccggtccctgatgctaagccccctggtgccaaggagggttcctgacactgggaagtaagggtagggtgtcggcccccaggccggtgcgttggtgacctggagcccagcagagcggccctggctgccttttgtttgggagccgaggccggtgccgcttgccagccgcgctgcctgctgaccttgggaagttaccatagaaaccagcgcatcgggctggggacccagaggcggttctcccaaggcgggggcgctgccggctgccattacttccagcctgttaggcaccctgggtctcagcggcttctgcgaggccactgcaggtggcaggtcgtg

SEQ ID NO: 78278 - DNA, 1025 bp, Homo sapiens
gaggccgcagccgcctgcacctcatcgacctgggcagctgtgaggcggcggctggcagggccggggaggctgctgggggtcccctgtgtctgtccctgtcggccctgggcagcgtcatcttggccctggtcaacggagccaagcatgtgccgtatcggtgagtgtagggcctgggcaggtgccgaccagggtggccccttggtgacctggtaaatccgtgtctggtgtgcccggtgctgctgtggcccccagctcctcagggctttgctcctccaccacctgacaggcctcgctgcccgtgggctgcctggggccccacgctgggctggtgccggagctgggtgggaaccagactgatcccagggctgcccttggccagcctgtccccgaagctcccttcccaaggccttggcatctgaaccgcctcgacccgcagggaccacaggctcaccatgctgctgcgtgaatccctggccaccgctggctgccgcaccaccatgatcgcccacgtgtcggatgcgccagcccagcacgcagagacactcagcaccgtgcagctcgccgcccgcatccaccgcctgcgcaggaagaaggccaaggtgctccccacctcctgcccgccccatctcggggccgtctcggctcctgtgtccactgcaggcctctgctggcctggttggggtgggggtcagcaggtggcctggagcctgggtagatgtcctatgtgttctgatgtcatgaggctatgcccatgtggccctccctggggggtggggagcccagcctgaggtccctggctgcagtgggcagaatcggggcttgctgtatgtggcttgtggtggcctcactccagcctgctgcccccgcacaggccctggggtgctcaggagagccgcaccacctctgcaggggcttcctagggacccctctctggggctggagggtggagtttggggcactctggggttacacggcccttggtgtgagtcctggccactggcctgggcacacatgcttgtcttttg

SEQ ID NO: 78279 - DNA, 1026 bp, Homo sapiens
gagcgccagcctgaggattcctggactggatcccgaaggcctccctgtcaggactcgggccggctccgcagcgtccccgcaggggctgtgcttgggctgggccccgcctctgttcaccctgtgcccggctctccgttccaggtctgcagcggcggcgcctgattcccgccccactgcccgacaccactgccctgggccgtaagcccagcctccccgggcagtgggtggacctgcccccgcccctggctggctccctgaaggagccgttcgagatcaaggtgtacgagatcgatgacgtggagcgccttcagcggccccgccccaccccgagggaggcccccacccaggtagggcctttggtgggctggggtctatgacccctggtggggagcctgccgcggatggcagagtgagccatttgatgggctcgccaggcctctgggggtgtggctgggcagcccctgacctcactttctgtccacgttcctcccaggacgcaaaggtaggagcggccctgcccagcccaagcctgttgcagctccgacactccccttgggcagtgggtgggtggctggggggtcctgaggccactgctgctgtccgctggaattctcccctgtcgtggggagggtggtcctagagccgagccaggacccagacgggcatgggtgggctgccccaggtccgccccctgcccgcccttggagccccactgtgtgcctgccaaggcctggcaggtgaagggaggcgggggccacatcagggctgcttgggggtctctggggagagggtcccatgcctgagcccccgcccgccctgcctcccagggtctggcgtgcgtcagtacaaggctgcggctggcggagcgcaggcagcagcggctgcgggaggtgcaggccaagcacaagcacctgtgtgaggagctggccgagacccagggccggctgatgctggagcctggccgctggctggagcagtgtgagtcccgcccgcccacggacccagcccggcccaccgtgtgccctg

SEQ ID NO: 78280 - DNA, 1026 bp, Homo sapiens
acccgacagcaacgcaagtgcctttgaccttgatttggacttttctcccttttgcatttggtgctacagacttgagacaccagcagaagttgtgttcagcccggccccgctgcgcctgtccgggccggggctggcgccggttgtgtttgtgtccaccttgccttctttgcagccaagcagtttttgtggagtggagtgggacttacctgcacgccccaggggtctttcaggattcaggatgacttttcttttacaatggtttcctctcggcagagcccgggttgtgggggatctgtgtggggttctcaacgcagatccatcctggggtctcccgggcagggatggctgacctcgagtcccctcccttcccgagaacccgctctgtcccgagggcagctaacaagggctgagccccaggtacaggttgcctcttccacggcaggaatttttaccaaaaccacaagcaaaaaacaaaacagaccaccacgaccaacaacaaagatggggggtagggttttgtaaaggttctgttaggttcatatttttatatcattttgcccataaatgcggaatttgccgtgggaatttgaagacaaatgatctatgtttttatggttttctagggaaggtgttctgggggccgggctctctccagctgtgggaggcctgctccctctggggggcaccctgggcagggtgggggggccttgggaggcgcttcttgccaaatgcagacgaggggtgagcctgccagcgtttgcgacgtccccgcacgacaggctcatactttctgaggatcgtgcatagcataggacgtctgaacctttgtacaaatgtgtagatgacatcttgctacagcttttatttgtgaattaaagatgcatcgatggttcccacggctgccgagttcactgggcgtcggcagactcctcacgccctggtgtgccgccctctgagggtccctggggtgacgggcagtaagcgtgggaaggacacatccacggggacccagggcttcgggtgctg

SEQ ID NO: 78281 - DNA, 1097 bp, Homo sapiens
acctggcgggggcggcctgggggtggggagggctgagactgctgccacttccttgccattcctggggggccgcagggtcaccatttgctcccactgctgacctggaggaaggcagcctctctcctcggtgggctcctggttatctcagccctttggggaaacacttggtccaggttcgggaaacggctctgctgccctcaaggggaagcccatgtgcctcaccgaggaaactcccaggcggggccgttggtaacactggaaccctgaagggaccttgcatagctgggcaggaagggaccaggggcttgaggggcgcaggggtggggcctggccggccactgcacttcaggtcctgggcaggcgcctcctttctgtgccttgatttcccctcctgtagcaggagcagctgtctgctgcgtctgagctggctgatttggaataaatctctgccgtttctccagccccaggggcggcgggccatatttctcgcagcctcagcggctgtcccgcaaagctaatctgcctggcagaggggtgacactctaaatcctgtgcccaggctgatttgtgggcctgcctgtgctggtgcagggctcgctggcatctttatgaggcaggatgagcctcgctgagagccagggcaggctgggtgtgatctacagcctgggcggcccccgcctgccagcagccgccgctcacgcccactgggcagggtgctctggcccaggctgagggcagccaggtgtctgactcctgttgttcctgctccgggagccttggaattcacctgcaggaaggaggtttcacagcacacagctatccagggggcgcttcctgagcatcgtggcctgggctctgggccgggctgagctgagagggccagatgagggagacccaggtcctgcctgtagggaacccaggcttcctgggccatgggcaggcgacacctctctgccaaggcaggagggatcagtccattctggcctggaggtggctgagccaggagggcatctgcctctgagacagcctgcaaagcatcggtgctggaaatcgcctgggttccaaccccagctctgccacttcccacctgggctgcc

SEQ ID NO: 78282 - DNA, 1052 bp, Homo sapiens
gtgctgctccccagggaaggatttcacacttgtccctggaaaggcctgttgatgatggtgtgaccactggaaactgtccctaaatagctgtccgggaaatgctgctggtcgtgatgatccgtcagtcacatactttctatgtgttaggggaaataccttaaaatcttttttaaattgtcatttatttagacatttttaaaagaaaatctaagggaaaagtgctttgtttaaaatgcagggaggccatttgtttccagttataggcacattattataccactgacaaggagagaagtagcttagcattttccctccgcttctttaagaactattggggacttttggctttaaaacgggatcacttaggtcgaggcattctttgaagccaaaccgcttagaaaccagtattttgtgccaagggaagaaatctcacggaacagcaaagcacttaaatgttccactttaagaatctgaaggcacagatcgttcacatcggttccgattttacgttccatgaacgtcaaatggataaagcctccttgttgcagctgtaccaaaccagggctaacgactggttggatttcacgcttctttcaaaagctcctgtggttacaccatccttcacgtggcctttaatatccccacgtgccgcggctgcattggaacccagcgccacgctccccagtctctcgtgggttccgggcagtgagtggcagccggagggcccagggcaggtgctgcctgtcaggacctcagcctgtatgtgccgggggatgttcgtgcccaacagaggccacttgtctctgggccggggaggcaccgggtggccgtgcctgtcagggcctccttagacagtgccctctcgggccagccggcggctgcccaggtcgggaacagatatgtcgccggcgacaccattatctcccgggcgaacggcgacgtctccgcagccaggcagagcccaggctgccgtgtaattggaccattcagaagtaaattatctgcagctggaaacaagacactgccttttaactcgggcattataaggtcaa

SEQ ID NO: 78283 - DNA, 1114 bp, Homo sapiens
cccacctgcttcctgtgacctggacacagtctgagcaccccaaggtccaaagtgggagaggtggggtgggggagagggagtggggtggattggagggctgtcctactgttacagggctctgccccgggcccacctcacagtgaaggcagaggcccccaggcagcccttggtgggccagaactcaaccaggagccacactgggggcggagggcaggctgtctgcttcccattttgcagacgagggctagtgtcaaagcctagctttgaggctaacccagggcacagttgaggagggagggagagggaagcagtggccgctgagcacaccagccccgggtagtggcttttctgtatcatctccaagcccccattcagctgctgtgggcagaggccagccccagcccctcgctctgcccagcgagtggccagctgcccaacacgcatggagtcccagtgggcatggccagtggtgcaggggtttgttcgtgcctgagctgtcctggccctcgccgggtcgggggtggacgtggccagctgtgcgaggagggccagcatcccactggcctccatctccccatctgtacctgggtccttgcaggccctgggacatggcctcggtgtacagcctgcctgccccaccctctgtgcccccgggtccctgttcctgctccaggcacagctcagactgtcgcctgcacccagcctacgctgggaggaggacacagggtgggggtgagggagtagccacctgtccccacctgcctctgcttccaccttgtgcacagacatgagtggcctgagaacgggagccccttggggacacccagggcccctgcctatgcttccatgtgcagagggcccccccggctgccccttccctgggccaggccaggctgtggaggtgcaggcccaacagtgaggggctgcctgcaggagctggcagagccatgggccggacccaggaggggccacacgggcggtgctggcacagccaacccaggtcagagctacggggccctggagaacatcctggccattttacagatgagaaaactgagtccagaatgggcctggctgtcccaggcccctggcaccctcgtgtcccagcaagcat

SEQ ID NO: 78284 - DNA, 1079 bp, Homo sapiens
ccagatcttggggactgcaggtggcatgagggctggagtgcttcttgggtgtgagacgggccaggtgacagtgaggacacagccagccctcaccaaggcccagtgcgccccatgcccctggacacgtggcagtgggtggacccccatcctcacctgccttgaggccccctgtgcacagaccctccctgggccttgccggcagttggtgagccaccaggtcagtagaggtccctcaaggggctgttggcctggtggggaaggtgacacatgctggaggctcaaaggagctgggagtctgagtgtgagggaggggaatgggggtcatggtagggcaggttcagctccaggtgcctccaccgccctgcagggcctgggctgcccagaaccccggggtgctgccaggaacgcgtgcagtcctggagatccatgggttgccaagcagtggaaaaattggggctctcggaggagctaaaaatacagtgtggcagcccctgcctcctagttccggaatcctctcctgccgttctgcccacccaccccgtggaagacaagctccctccctgcacccccaccaccaacgctggctcagggcccagaagcacccagccctgtgccagtgccagaagggcgacaccacagctgcctgcccactcccaggcagcagccccccacaggtgctcatgtgcccagccagtgcctgccctacccccgccactgcttcagggtccccagagccccttggtcccaggcacagtaggcagtacctgccaccccagggctgccaggctcagggcttggcctgttcctcgtggggagcctggacccaggcagacctctcccttccctaccagtggggacttcacaggggagggggctgtcccaggcagactcagaacatgtcacagcgggggcctccaggcccattggtgctggccgagggcataggagctcccacactgtgctgtggaaggccctcctcgcctggctcctgggaggcaagtgagggagccgaggcctgggggcttcagtggctggctcaggtccctcgcgtgctgggattcaagtctgggtaccctaac

SEQ ID NO: 78285 - DNA, 1052 bp, Homo sapiens
ccaccctctgggctctctgccctcgtccacacctcggcggcaggagtcactgagtcagagatgcgaatccacccgagtggctccctacatacacctgcctagctccaagcccttcagcctcagcccagacagagcccttgaggtctggcccacacctactgatggtgtcaccctccacctcccagcgccttccctagcgcctccctccccgccctgtcccctactccagcacccaggggactcgttcccggcaggcaggcaggcccttggtctctgcctctgctcgtgttttctgcctttgcgtcctccaaggtcctgcgccgctaagcctttaagccccagctcactttcctgtcctccaggaagtctccccaggctgtgcccaaagttagtcccggtcccttgagagaaacccttgctgtgccactccatggctgctgccaggtcctaccgatgcttggggacgagctagggtgggcagtgatgggcggggctgggcccatgggggcggcagttacctgtgcaggcaagcaagccagaggcgcctcgtttctgtcggacccaggggacagaggcaggtgtaggggccagccattctcagcccgtctccccagcctgggcctggcagggcccctctatggagtcttttgtgaattgttctcagcagggtcagatgagagacacccccagaactttcacagctccagatggggtgggaggcaggggttcataggaatgaggttgtgtctgccataaacacagtaagtgctgcattgggagaaaagctgggcccagagccagtgacaggatggggcagctgcctccaagcccttccctgcagggtctggccctgtggtccaggagcagggccaggacaccgaggagtggggcacctcgttgggtcccagcccactgctgtgggccacagacaagtgcccggcaccccctggcgtctgcctgccaggcccagagccccagccctgagcccagctgcacaggcatgggaaggggtgcattggccctgctgagcctgcccactccaccctggcagc

SEQ ID NO: 78286 - DNA, 1035 bp, Homo sapiens
gcacaggacagtcccacatgtcaccagtaccacagtcgctgaaactctcatctctagggatccgtgggaatagagggggtgatggggctggacaccctggcagacaggccacagtccttagtccaccagggaggggccggctgctgacctgcaccccacactcgcccgtccaggtgagctgctccccggtgtctgcccagctcctgtcggtgctgcagggcctcctgcacctggagcccaccctccgctccagccagctgctctgggaggccctggagagcctcgtgaaccgggccgtgctcctggccagcgatggtgagggggcggggcaggggcgtaggcacagcctggtgggcagacactgaggtcttagaccatgggggggggagcctgcccttggccccaacccatcctctgcccaggggaggtggccgctttttcctgcctcttcctcaagcccccatccctccctctccggctcccttctcccttgaccctggacatcccctactgcagcccaggaatgcaccctggaggaagtggttgagcggctcctgtctgtcaaggggcgacccagaccgagccccctggtcaaggcccataaaagcgtccaggccaacctagaccagagccagaggggcagctccccgcaaaacactacaacccccaagcccagcgtggagggccagcagccagcagcagctgctgcctgcgagcccgtggaccacgcccagagtgagagcatcctgaaagtttcgcagcccagagccctggagcagcaggcgtccaccccacccccacccccacccccacccctgctccctggttccagtgccgagccccctccccctcccccaccaccccccctgcccagtgtgggggctaaggccctcccaacagcacccccgcccccacccctgccaggcctgggggccatggcccccccagcacctcctctaccaccacccctgccaggctcctgtgagttcctgcccccaccacctccaccactcccgggcttgggatgcccgcccc

SEQ ID NO: 78287 - DNA, 2048 bp, Homo sapiens
cctgcagcactggctcccctgcacgagccttgtccctccccaggatacctgtccctgatctgggggacagtccctaggaaaagcagaaacatcacaaagtcatagccaggcccaagggaaagatttgagggtctggagtactgggggttttctggaccttaattgctaagggttagagctgggggagtgggaacagggtcatccccaggtggagagtatgaccacagtggatctcactggacgtgtcccattgcaggaagcggaaaagagccaccccgacctcctgcagctgccccgggacctggaacagccctcgcaagcagcagggtaggtagctcctgccagcccgcccacctcagccaggtgggggcctgacttctgtccccaggcagtgaggtggctgcccgccagggctgggtctcacagctgcagcgcagccccggcgccacggagccctgcccaatagaacacttcccttttgggacaggaccgggtctgccgtggcctatccccttctgacttaagcgaggaaacaggcctagagtgggcaagggctggccaggtcagggtcacaccacgggcaggtctaatacagccccttcacaaggtggaccttcacgacagccgtgagcaggctcgggcctccctcattgtatagatgaggaaacggaggcccaggaaagcagtgtcacctcctgggtcacacaacccaggcaggagggcagcctgggccaccccactacacagtccgggcccctagcacggagttcttcccgggctccacctgccctggaaggttctctggctcaggagctgctcagccttggggagaactaggcaagcaggacaggctgaccgttagggtccccgcccagatgctcacagggggctgagggtcagctggaacaggcactcaaccccaacactgcacgtgcagcctcagagtacagcctgcagggtgcacagtggggtgccggggggtgcaggggaggggctcccctgtcccagcgaggctgacgtcagccgttgctgtctctgcccggccctcctcacctttcaggatcaacctggagatcatccgctcagaggccagctccaacctgaagaagcttctggagaccgagcggaaggtgtctgcctccgtggccgaggtccaggagcagtacaccgagcgcctccaggcaagtgggcacctgggcctggggctggcgggagaggctgccctgatagagtgagctgggcgagtggctgtgctgtctcctggctccagggtggatcctggggcccgagtttccccaggtgtgcatggtcagggcacaggcccctgctccttgtcagagaccaccgtcctcagggcctgtccctgtggccgtcaccctcccgcaactcagggcctcaccccgggtggtgcccgcgcggggctctcacgggactgtcacgtgcccttgcccccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggtggggcagcccggcgggacacagcctgtctggctagagtggggtcccgaggcccctggccttcctccggcaggatgggcagaggcacctttcgtcgggccgacacagccatgtgggccctgcgctgctgcggctcagggagggggacgcccaggcccatggagcccctgagggatgccacgctggggtgacggggccacatctgccagtgcaggagaacaaggaccggaaggagcaggcggcgaaggcagagaggaggaagcagcagctggcggaggaggaggcgcggcggcctcggggagaggacgggaagcctggtgaggctgggccggctgggcggggagggggtgactctgggatccttgtctgtgctccagcctccccaccacccccagccctctaggtgggctccagggtcccatgccgct

SEQ ID NO: 78288 - DNA, 2715 bp, Homo sapiens
tcagggtgctgggaatggcatggcccagtgtcccccaccctgccacagtgtagacagaccaaggacgctgaggccgggtcctgctctgagacatcagaggaggctttctggggaggaggttttgcagggcgttcaggtagacagcggaatggaggaggctgcacctgggctggctcgggggcagggtgcctgcccttcactggtgtgtccctccatccagtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaaggtaactcagggaggggccccgggcaccgtcccacgccagggcgctggcacccagccggtccctccccttccccattgggcactgcaagttccagcggcacccaggagaggtgacttgggtgcggcacgggagaggaggcggcagtgcgtccaccgcagggcggctatgtgggctgccgcggcccgtgcaactattcctccaacctactaattccgaccttcacgccacctccgttagggagtagggggcggacaccgggcaccaggtcccaggcaagtggctgccatgtggcttagtggccagagaaccgggcagccctcagagggtgttggcatggctgtcccgggccccccagccccacccactccgagtcagggttgcttctgtgtgataagccgttgagtgcgtttcttttatttggaagcagaggttccccctgattctgatgataataaaacaaagaaactgtgtgtgatccagtaaggtatgtacgcagccggcgctccgtgggggctaacagcagctgcagggcagtggggctggagcttgctgcccacacccctccgggacactaacctggcttctctccagcccgcgtggtgcgtcagtgtggccttgccgctcccgcagccctggtggtgggcttcccgccccatcccctccctctccgcaggttacctgctcaactggtgcctcctgcaggcaggacgcaacctcagtgctggccccgggcatgcgggcctcgagagggcaggtggcagggccagccggactcccttagcaagcaggatccgggccctggggcgtgggcgggacctcctggctggcaggacaggctgaggttgctcctgtctggtgtcctggcgctaactgcagttccagtaaccctgtggctttcctgctctgtctgttggtggagggctatcttcactctaagtgtgtcaatggcgtggggccttctggggcatgtccccaggaagtctgtgaggagaccgggacagtcgcaagggcagatgctgccagggacaagtacactgcaacccccctcctgttggacagtgtcctcccaccccgaggccatgggtgggtctatggagaagcagattaccccccgcacaccgagtcttctggggggcgaccagccaaaggtcaatcagccaggtccgtccacagggctggagaggccaatgcatccagctagacaggaccagcctgcactgggtggaggaggggctagagcagagaaccagaaggtccagcccggccgatcatgagctctgtgagcccaggtcgtggcgtcttccagcacctccagccttgctcagagccagcccggtgtcggtgcatcacaaatatgctgaccgctgggcctggggcttaggctcaaggtgcacacctgaggtctgctggtgcccatcagaggcaagagcagtcgtgaccccggagaagcttctccggacagcttgtcctcgctgttggggcacggccttcaccctgggttccagcttttgcttccagggtcatcttccgagtgtggctctctggtgtgaagcacccacgtgtactttttagaaaggtgctggcatctcccttagaggctggaacttggacttgctggccctgagtgtgaggaacagtggagcatgcaggtctggggcgggcggccacatctgacaatggtccagtgaaagatggacgtgtccagtgccagctccacgctccacctggttccctcctgaacctgctacacgtgcttagcctccacccgccccagctcctgccacgcacgtggctgagggcaagaggaagaagtcctcttctctccccaactttttattttt

SEQ ID NO: 78289 - DNA, 1055 bp, Homo sapiens
atggcacaacctgctggacagtggcgatgaggggttcagggacctgggcacccagaagcgggcacctgatattgtacccagcaaaactgctcctaataatgtcattttttctctctcttacaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctagcccggtgtgcgactgtcgtgttcagaggctgcgggagtgggcggtggacgtgggctcccacaaacatggtgagcgctggacaggccccgtgtgaacactcactgttgaggggcccccaggc

SEQ ID NO: 78290 - DNA, 1066 bp, Homo sapiens
caagctccgccctcgttgcaccgtcctgaccctcggcctcgcccccgccccctggctcttcccgcgcagccgaatgccgcgacctggctcccacccttcgtcgcttcgcgccgcataggaaccccgcccctagtctctcctcccgcctatcctgagcggcgcgcgcacaaatctctcccacggacccgcccaccctgatcctcaacctggcccctggcctttcccgcggcgtcgagtccagtacaccgacgcacgagtcccacccccgatctctccctcggcctatcccgcgccgctccgcgcaggagtcccgcctcccacttcgcccgcagcctatgacgcgccgcgtcgctccctctcctcaaacccgctctcgcccgcggatgggcgcgcagctgtgacgtcacggcgtcgttggtaaggggctggcggccggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcggtgagtgtcgggcgggctgccgagggtccgctgcgtcggggcctggaacgggccgggcctcagcgtcccctctgaggcctgagcggggggctggagggccctgctttctggccccgcgttcccggaagctgggaggccgcggggacacaagctggccacgcccagggctggggtcagtgagggggatgtgaggaccccagcgttcgcccaccctgtccaacagcctgaaagaaaagggtccctgcccctagcccccgcgccctcttccacgatcccggttagtcgccgccctgcagtgagcggcacccgcctggtgctttctcaggactgtcccgtgcaggatgtcctgggagaggttggggagcggggcgtcctgcatggagtcaacccgaagagtgcccctcctgtcccaagaggtattcatggagcgcgcggccctgccaggcacggcggctttctcgggagaccaaaggcaggcaagac

SEQ ID NO: 78291 - DNA, 1936 bp, Homo sapiens
gacaagcttagtgaggcgaggccagccgtgaattgcagaaaatgagccgagtgataggagagggaacccttgcatcagacacaggtggggctgcagggccagagccttcctggaggagatgacagctaagccaggtaaggaaaggacgcacaagcattctcagcatagaggcagagcaggacccagctcgccagggcacaacacaggctggggttactgggagacagagggcacacaggaggacgatggggttcatgtgaggctagaaagactcaatggccatgcaggggcttcgttggtacacagtgaaggacgtgagaatgatttatcttcccccagagaagaccaagcgactcctgttcctcggggcccaggcctacctggaccacgtgtgggatgaaggctgtgccgtcgttcacctgccagagtccccaaagcctggccctacaggggccccgagggctgcacgtgggcagatgctgattggaccagacggccgcctgatcaggagccttgggcaggcctccgaagctggtgagtggcaccagcagccctttgtggctgtggcactgagggcaggtggtggcacgagcatttttcttgatttgcaaggtcaggcttttcctccctgggtaagcaggactctgacccagagcttggccttctggctcagaaggctcctgttatcaggaggtctcacattcaagactggaagttgttaaacagcttctaagtactgggccaaaaaagcagcagagactccccgggtatcccgtctgctttccgcctgcagccccctcagatagtcccacaaggctggaaacatgccagtcccatccctatgcagtgtggggtctcagagcatcacctgtgttgctggttagaaatgcaatccccgactctacctcaagtctggttggtgtgtctaggaggagcccaggcacctctttgttaaccagtaaggcagtgggccacactgagacccagatgggacacatggagttctgacaagcaacaggggaagaatggtccttccagcactagcctccaggtagcagagggacctggtaagggaaagagcactgaacttggagtcaactacaggcatatctcaccttggatctctgtagtaaaacgggggtcctgtgcactgtaccaggctcacgggttgtcagaaggatccagtgtaggtggggatggggtaggcaggtcagagccctctgccctcaggtatgcatggaggcaggtagcccggcagtcccggaaactccagtctccttgcagcctgacggcttggcgtttcttcctcacagacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggagtaagtacttcagtccctggagctgctgagatcccatagccccagcaagccgtgatgggggacgggtgggtcacccatgtgggcccagaacacacacgtgtggcccctgatgcagtgccatctggcattgcctaacgggacatggtggcaatagatgcttggcccaactttagtggttagtaatcctctctaagggaaagctgaacctcacagatgacctgctctgtatccggctctagtccctgtcttcagccacttcctgttctgatctttgagcacccccacctcctcctcctctggtctttgagccccccctccccccgtccgaggagcccctggttggtgacacaggtgcacaccgcagcttcaccacagtcatgcgtgccgtttggttgtagaccctctcaggcaggaagtggagtgtttgtgtagtctcccatttgtgggtgggtttgctgcagctggc

SEQ ID NO: 78292 - DNA, 1293 bp, Homo sapiens
gcgtggtgtcgggcagcgtggtgcggggctgccgtcctgcctgtggggccgcagttccagctccccttccttgcaggccctgaagtactctttccagacccacgaccgcctctgctttgtcatggagtacgccaacgggggcgaggtaggggctggggctgcgggggatggacttcgcggcctgtgggccgcccatggtggggccggtccttcccggagcctcggctactctccatggcaccagacggtgctccctgctgggtgggtggtgtgatgcctgcccaggcagctgcctgctgtggggtgacttgttcctgctgagttagggcttctgagactttccaggcccccgtgccctctggtggctggtcccttccctgtgcaatgccgagacccggtctgagaaaccccagccctgcaggccatgggggcagaggcccgagccacggctgtgcctcaggttgcgcctcccgcagctgttcttccacctgtcccgggagcgtgtgttctccgaggaccgggcccgcttctatggcgctgagattgtgtcagccctggactacctgcactcggagaagaacgtggtgtaccgggacctcaaggtgcgctggcgggcaggcaggggggcagggccctgggggcctggcggcactgacctgaggccacctttcccctagctggagaacctcatgctggacaaggacgggcacattaagatcacagacttcgggctgtgcaaggaggggatcaaggacggtgccaccatgaagaccttttgcggcacacctgagtacctggcccccgaggtgtgcgccccacctgcgtgcatacgcgttgctgcgtccccacgtcctgagcacacgcaatgctgtgtcctctctgtgccccaagcacgtcacacctcccccggcagtgtcccggacaccccttgatgccgagtcctgcccatctgccacccgtgcaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggtgagggccgcccatcccagctacaggctacacctccatcccctcatccccaggctgcacctgcccctgcgccaggcggtcctggcacctcccagactacactgatagccaaag

SEQ ID NO: 78293 - DNA, 2399 bp, Homo sapiens
ggggctcagagactgaaggaaggactgtaggagtggacgatggtgggggtttgacctgacgccgggccagatgccctgtgtggctgcctcagcctggagtagagtgtctgagctggaacaggggtcctagccccactctgtgaggcgagaaactgaggcttggagagaggaagagatggggcttcccaggacctggtgggtggtatgcaaggggagctggctggtgcagcgggggctgtggtgagggccctgggaggggcagggggatgcacgcagacagaggctctgcctgcccgcagagtgccagctgatgaagacggagcggccccggcccaacaccttcatcatccgctgcctgcagtggaccactgtcatcgaacgcaccttccatgtggagactcctgaggagcggtacgtgggctgtggcggccaggccaggcacttgggcagccccagcgcttaggagggacacggggatggcggggtgctggcacctctgcctgtagccatcctcactccccagtgctcccaggccctcctcagagcccagtttggaaactggcccagtcctgcctgtggggtttgggtggggaaactgaggctggagataaaaactggctagggaccgggtgcagtggctcacgtctataatctcggcactttgggaggccgaggtgcgcagatcacttgagaccaggagtttgagactagcctgccaacatggtgaaacccccgtctctactaaaaatataaaacttagctgggtgtggtggtgcacacctgtaatcccggctacttgggaggctgaggcacaagaatcgcttgaacccgagaggcagaggctgcaggagccgagattttaccactgcactccagccagggcgatagagcaagactccgtctcaaaaaaagaaaaacccggtggagagggccagtcctccttggggggcggagtcctgcttgggaggcggagtcctgcttggggggggcggagtcctgctggggggcggagtcctgctgggggttggagtccggttgtggggacagagtcctgctggggggctaagcctgggtgtcccccacgtccaagagggcttcgtgaccctgagtgtatgtggccagaccaggtcaagtggtggcctcctcagggctgtctctgggaaccccgacagctgtggaaccacgcttgtgaggctggcgggtgggtgaaagacgtggggtggagctcctgatctggtacaggcctgcagcctcacctgacctcctgcagggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtggtgaggcctgtccccacttctgcctgtgcctggggctgccttggactgtggagggctgggtgggtcatggggtcccagctcggcccaggagacactcagcactccacggcatctccacctaggccggttttccatgtagggcgcagctgcttcccaggtgggtcctcttccccatgtcagaggaaaactggggttgctgagccctgccaggcttgggcaatgttaccccacccttccctgaaccccatgctctgagctggggccgcagccatgtgttccctgtaagcctggactccccgctgagcccagtaggccaccaggtgtgaagtggacgcctctcctggctctgcctccgactctggggcccctcatgccaccccacgcatgccgaccagctgggcactgttggcagcgccgcttgctgaccctggtgcctgcccatagaccatgaacgagtttgagtacctgaagctgctgggcaagggcactttcggcaaggtgatcctggtgaaggagaaggccacaggccgctactacgccatgaagatcctcaagaaggaagtcatcgtggccaaggtggggccggggcggtggggcagggtggagatgagggtgcggggtggcagctcacccagccctgctttacaggacgaggtggcccacacactcaccgagaaccgcgtcctgcagaactccaggcaccccttcctcacagtgagtgggagcccagatggggctgaagggctggggccaggtagcgactcctggggctgtctctaggggacgatgtcctgtcttcttgggcacgtgagggctttacacaccgtggactccgccgctggtgagacaggcctgccctggagggtcaggctgtggaggtgcccagtgtgggctaggggctgtgctcgctgctcccgtgtgcgggcaggtgggtggggcaggtggccctggtcttccttgcactctgccgaggctccagga

SEQ ID NO: 78294 - DNA, 1051 bp, Homo sapiens
agatgaagacaaggaggctgcagacgcctgtggtccttggggagcttctggctctgcttccccccaaggcctcctgccgcatcctgccttctccatcccctccccgtgtgctgtcccctgcttgttccccaggagtcctgccacctgtgcctggaggtcctctcctcacctcacagccctctttggtgtcagggaccccctgccccgaccctggccctgttcctctctgtgtcacatagtctgctgcctggggccgctgcttctttatccttggcaaatgtgtgtttgttgatagactgttggatctcgggctgacccaggagatgccagggccttgactgcccaggggcccaggccccagttactggggcacccatcagccagctgggcctaggcaggagtgctcccccgaggccaggtgattttcaggctgctgctgatgtcgtgccttcaggaggggcctggcagggacaggacatcaggcccagtggggcgtccagagagctgagtttgaaccctggttagccactctatcgccatgaccctttccaagagcaaggtcattgagctccttgggcctcagtttccccatctacaccagggagcggtggtgggagagagacctggtggagtggagaatggcttgtgggcggccctgagttggggtccggccagcctcagcagcctctgggctctgtcatctggcccctagcctcaggccaggagagagggtcctgtacctctacccccggctcttcctcctccatccccagtgtagtgggcgctgaggatgggaggtggcgtggatatgacatatgcccttggcaggcatagcccctcttgttgccgagagcaggtggcgtccacccgcatggccggccgctccttgcggaggaaagcctgtcctccggggcctgccgcatttcgccactcccgtccctggggtcccctgtgtgtcttgcagatgtgctgtgccaccctcctggcagggccagccccacccgcaacactggttagaggtactagctgccttcctgtccctagcagggct

SEQ ID NO: 78295 - DNA, 1139 bp, Homo sapiens
atttgttattttgcttcttttgaaaaaattatagccatcccaatgggtgtgacatggtatttcattgtggttttattttgcatctccctagtgactgatgatgttgaacattttttgtgtgtgcttgttgaccatttatctgtcttctttggggaaaggtccattcaagtactttgtttatttgtaaattaggttgtttagggagtttttgtttcggagttacagcaattctaatatgctgcatattaatatcctatcagatataggatttgcaaatatctcattttgtgagttgccattctactctttttttttttttcaggcttaattcactttacttctcttgtataaaaaccctatgttgtagccacagcaggagcctgggtccactgcacggagactctggtgtgggtcttgacgaggtggtcagtgaattcctgatagggagacttggtgaatacagtctccttccagaggttgggggtcaggtagctgtaggtcttagagatggcatcaaaggtggccttggcgaagttgcccagggtggcagtgcagccccgggctgaggtgtagcagtcatcgataccagccatcatgagcagcttcttgggcacaggtgcggagacgatgccagtgcccccgtgtgcagggatgaggcgcgccggcacagagccgcagcggcctgtcaccttgcaagggacggtgtggggcttgccgatcttgttcccccagtagcctctgtgcacagggacaatggagagcttggccaggatgatggccccacggatggcggtggccacctccttggagcacttaacacccagaccgacgtggccattgtagtctccgatagcaaagaacgccttgaacctggtgcgctggccggcacgggtctgcttctgcaccagcataatcttcaaaacctcatccttgagagaggcccccaggaaaacgtcaatgatctcagattccttaatgggcagggaaaagagatagatctcctccagggacttgatcttcatctccttgaccaagcggcccagcttggtgacaggcatccactccttatcctcagccttgcctccgcgagctccgcagccttggccctggccccgtccacggccgcgaccccggccccg

SEQ ID NO: 78296 - DNA, 1274 bp, Homo sapiens
gggcgtgaggagtgtgagctcatgctacaggtttgcagggagcgcttggggccaggagggtagggggtagacagtctgtccctgtggaggccaggaaggtgcccaccccacttgctgcaggccaccctggcgaggaggccgccatgcagcccaggctgggcctcttaacttgggtcccggatgcaccgagggctctggggctcccgtgggtgcgtgcaggggtgtgtgtgtgctcacaggctcgggtccctgccccgtacgtatccctgtctctgacaggagggggcttaggcttttgtcaggttctcaaagttgttggggtccctagaagcgtgagttggcgtccttttgcagagagggagctgaggctgggctttggaaggtcctggaaagccggtctgtccatattcttgttgtctgggggccccgtctatgctgtgagtgctgcctgagcgggggtcccagtatcttggtcccagctgcaccctggtgaaggctagtgccttttggcggcctccaggcatgaggggttcttctcagggcatgagagcctgccgagcaccggcactgacaatcggaagtttctctggccctggtttgaggtctgagtttggctttgtggggcttgcgatctggctgtttgagaacaaagagcaggggtggtgagctaaccccataggcccatcctggcctgatgtccttcctctaccccgtgtgcctgtgaacgagttgggctccctgtcctggctcatcccccagcgtggcacgtgggcccctgacccaggtggatggcactgtccagtctagccgaggggcctgcaggtgcagggagctgccctgcccactcagacgttgcctcctggatgcaacgtgctactgccgcacatgcccgggccatgccaggctctgacgaggtgggcaggcctcaggctgtggtgaggggtcctggccatgtgcacattccctggggcagacagtgtttgtctgcctctacccagggcagccccacccgatattgctgcatgtgtcctgctgtggcgggaaggtttgtgtcccctgcaattcggaggttgaagcttcatttccagcgtggtagcttcaagagatggggcctttgggaggtgagcagggcgtgaggctttgcccttgggaatgggatcagggaccttaaaaagaggccagaggaagctggctcaccccttctgcccagtggggacgcagcattcaagataccatccttgaagcagagacagggccctctccagacaccaaat

SEQ ID NO: 78297 - DNA, 2456 bp, Homo sapiens
gggccaggccggggcgggcctcaggccactgaccacggacacaggctgcctcttcctgagcgtggagggcctgcagaccagcggccctctaaccggctgcctttgtgctccacagaggatggcctgggacgtagaggcggggagccggaggggtccctgcctgtgcgcatgcggcgacggctccctcagctgcccagtgagagggctgacagccctgcgggcccagagagcagcaggaggagtgggcctgggccaccggagctggacagtgagcagcccagccgcctcttcggccaggaggagttggatcctgacagcctcagcgatgccagtgggtcggacgggggccgaggccccgagccaggggtggagccacaggacagcagacgcaggagcccccaggaggggcccacgtggagcaggggtcggcgctcaccaagggcccccggggagccaactcccgcctctttcttcattggggaccagaatggggacgctgtgttatctaggaaaccgcttgcggctccaggggatggggagggcctagggcagacagcccagcccagccccccagcacgggatggcgtctatgtcagtgccaatgggagaatggtcatccagctacggcctggacggtccccagaacccgacggccctgccccagcctttctccggcaagagagcttcactaaggagccagccagtggtcccccagcgcccggcaagcccccccacatctccagccacccgcttctacaggacctggccgctacccgggccgcacgcatggacttccactcccaggacacccacctgatcttgaaggagacggagacggccctggcggccctggaggcccgactcctctctaattctgtggatgccgagtgtgaggggggcagcaccccgaggccgccggaggacgccctgtctggggactcggacgtggacacagccagcaccgtcagcctgcgtagtggcaagagcgggcccagccccacaaccccccagcctctgcgggcacagaaggagatgtcgccatccccgccagctgcacaggacccgggaggcaccgccctggtcagtgcccgtgagcagtcctcagagaggcagcatcacccacttggcccgacggacatgggccgtggagagccggtacggcgctcagccataaggcgtggccacaggccccgagggtccctggattggcccagtgaggagcgtggccctgtcctcgcccacctacccagctcagatgtgatggcctccaaccacgaaacccctgaggccaccggggcaggacggctaggttctcgccggaaaccagcggccccaccgccatccccagctgcccgggaggagcagagccgtagctcagccagctcccagaaggggccgcaggccttgacccgctccaacagcctgtccacccctcgccccacacgggcctcccggctgaggcgggcccggctgggggacgcttcagacactgaggctgcggatggtgagcgggggtccctgggcaaccctgagcccgtgggccggccagctgctgagcaggccaagaagctgtcacgcctggacatcctggccatgccccggaagcgggccggctccttcacagggactagtgaccccgaggcagcccctgcccgcaccagcttctctggccgcagtgtggagttgtgctgtgccagccgcaagcccaccatggccgaagcacgggctgtctccaggaaggctgccaacacagccaccaccacgggtccccgccagcccttcagcagggcccgctcaggcagtgcccgatacacctccagtgagtgccagggcgggtgggaggccagggccaagacagggctgccagtgggtctgcagcatcttggatgccagctgagtgctggccgtgggcccctggtcctggcacgagaggagcctctgttcccaaagctggggtagatgtgttgctggactcacgtgcacacacacacgtgcatgggccgagggcagggcccgcagtcccctggtgtgggtagaacaccctgaccatctctggcgtggagagggccttccatcccccagggtgtgcctcagggccccgaagcccaggctggccctccccactcttcctgtactcctggctcaggcccctggtgcctttgggtccccacgccatctgcccatgggcctgaggccctaggcctggggagggctgtcccatggatctctgccgcagtactgtggctcagtgaagggtgccaagtacacctgtgccctccgctggtagctgctctaacacccttctgagcccgcaggccccatgaccagggagggagggagggctgtgagcagagtcctgccctgccccccagatgtccatgggcacagcaagcggggatggtcctctgtggccaccagagctggcctcctacctggggtggccggacatccgcgtc

SEQ ID NO: 78298 - DNA, 1185 bp, Homo sapiens
gatggatgggtgagtgggtgggtggatggatggatggatgagtggtgggtggatggatggatggatgaatggatgagtgagtgggtggatggatggatgagtgggtagatggatggatggatggatggatgagtgggtgggtggatggatggatggatggatgaatggatgaatgagtgggtgggtgggtggatggatgaatggatgagtgggtgggtggatggagggatggatggatggatggatggatgagtgggtggatggatgggtgggtgggtggatggatgggtgggtgggtgtgtggatggatgggtgggtgggtgtggatggatggatgagtgggtgggtggatggatggatggatggatggatgagtgggtgggtggatggatggatggatggatggagagtgagtgggtggatggaggggtgggtggatgcagatcttcccaggaggtgagaccgccagtacaaggagggcctcctcaaaggttttcattagaaatgaactccctcacatggtcattcagtaacagggccctctccaggccaggcgctggggaggatggggtagggagttgggtgggagtgagagtggtctttgccaagcagtggtcagtactgcaaaggcagtccctgaaaggctgtggggcaggcagggggggtcccaggaccagggtggatggcaagtgtttgttgtggaggatgctgagcttgaagcccatgagggacctggaaggaggtggccaggagcaggcggcccttagagagtggcccacactggggtggaggcgcaggcacctgaggctgtgagcagcatgaagttggtggggaggacctggggggcttggaaggatggggactggggacagggctcttgggatgcttgaggtattgggggagcatagggaagaaggctgccatcagcggaggaggctagcacagggctagggctctggacagagacactgcacctggctgagaagggggtgggtgcttccaggcctgagagcagaaggggatgtggggggcccatgtgggtttctggagttctctgccttccatggtgggtgagctggagcatgccatatgacgggggcaggaggccagggagtgctgggcgggggcctgagggccaggggcatgtgccagttggtgtcacccagaggtggagggagggcttcc

SEQ ID NO: 78299 - DNA, 1248 bp, Homo sapiens
gcctctgcctggggcccacggtgccggccctccctcttgcagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggcacggtgcccactaccgccacggagctgggtgtggggggagcaggggcggggctcctcgagggcggggccatgctgaggccgggctcttgcaggtgatcttcgataacctgatgctgaacccggtgtcccagctgtcgcaggccatccgtgagaacacagagcaccttgccgagaagatgaagtgagtcggcttcctggctgaggtggacgcccagacaccagcacagctgcatgagctgagactcagcctggctgaatccctcaagggcagcggtttcatgggtactcgtgtgcacctgtggagcagccctcccgtgtgcacgtgtatgtggctcccagcaggcagaccctgaactcagaggagccagcgcctccagggcggcccttcctccccttctcccctagccctcatcccgggcccagccctccccaccgccgagtgtcaggcacagatgggactttggtgcccttcatgcatcaggcctcagtttcccccttaggcccaggtgggctgggatgaacttcaccatggcagaggaggtctgggagaattgtgcctcagctctgtcatctctgtccttgtccccccatttctgcctccccctacctcggacaggatcctctttcagaacacagggagagcttgggaggacctggaagccaggatcaacgccgagaacgaggtgcccatcctgaagacatctaacaaggtgagcgctggggccccgtgccccttggcctgcccccagccagcctgcctttgcctggctggccccaaaccttgtcccagctcctgcacacagagccccggggcagggctgcagcccgtcagaagttgactccacctcccttcctgccacgtttccaggaaatcagctccatcctgaaggaactgaggcgggtgcagaaacagctggaaggtgagtgtggcccaagcctggggcagcaagggaggctggcagggccttgtggggaaccctgactcacagggtgggagcaggtgaactggatccgcagcctgaccctccctccccacctccagttatcaatgccatcgtgg

SEQ ID NO: 78300 - DNA, 1342 bp, Homo sapiens
gaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagcctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcacatggcagcacgctggagcctgtcaccttggccttgtttctctatccttggtgtttggggtgggtggggccctgcacataggacagaccaggggtggctgcaattcagagatgctgccaccaggaggcggcctgggctagaaagcagcatttccagatgtttactcctaaaaaacagaagagttaatttatgaaaactgttcagtgagacagcatccgagagcgctgtttttgtttgtttgtttgtttttgagacggagtctcactctgtcgcccaggctggagtgcagtggcgcgatctcggctcactgcaagctctgcctcctgggttcacgccattctcctgcctcagcctcccgagtagctgggactacagtcgcccgccaccacgcccggctaattttttgtatttttagtagagacggggtttcactgtgttagccaagatggtctcgatc

SEQ ID NO: 78301 - DNA, 1048 bp, Homo sapiens
caatggctgagttccagcagccactgtgaggccatgaaggcagggatcctagggactgggatctgagagcctggctcccaatggcagtggagcaatgccatcatctctagcaaggccgtctctagcctgccagcccctggacctgcttagtgttcgagagtaatgaacaaccttgctgaagccactgttccttaggtgtctgtggcctgcagctgaacttgactccgattcgtaggcccgcaactggagggcctctacctcgagggagtggggtgtagatttttcctggaggtgaaggttctcagccctaccctctagcccgcccacccagctccagccgtctgtttctgtctcagatgagagggggcctctcaggacaaagaggaagtagctggaaggggaaggagccagctgcagagaggaggaggtgagctgcagagaagaggaggttggtgtggagcacaggcagcaccgagcctgccccgtgagctgagggcctgcagtctgcggctggaatcaggatagacaccaaggcaggacccccagaggtatgtgccaatgaggccagggcagctgagaaaagccaggcatggggaaagggctgctgtctgcctccctatggcctcagcctcccagcaaccccaggtccagagagtcacacagcctccagctagtcctgtagatgactcgctccgtccccagtccgtgcagctgggataagctgggccctggctctccagccaggtgacagctgggccctctacctcagcctgggactggcagccatgcctaatgccctgcagggcaggaaatctggcaccttcagccatgacctctgatgtctgcagggtcttacgctatctaccatgggaccagggggctacagccctactctgcaggggtctctcagcttgagccaacctggctggcggtcctcccaggttccattgcaggaggaggtggtgaggcgctctggggtctgtagtcctgggaggggacttggacaggctccaagtctgagatggggcctgcaagaggcagcgcctct

SEQ ID NO: 78302 - DNA, 1050 bp, Homo sapiens
aggcagcctacataggtgagcgcgatcagatcacggcgggcgggccccagggtggccaggcacgggcgagggaggcactggctttgtgaccggcgtggacacctcaggagggaggggctgctgctgaagggggacggggtctccatggagttccggggaccaggccacccgcctgtcacctggccccacagggccccagaacactgagtcaggacgcctgtccccaagtgatgaaggtggagttctaccgcgaccagctgtccctcccgcacctaagcgaggggcttccccggctggagtctgatgacagtggaggggccagctgccaaccgtccccaaacccgtagccgggcctggcgctgagcgggctgcagaggggcctgtgggagccggcgccccagtgtctcctccatcctccccgcaggcacctccaactggtcggaggattacttcagcagcacggcgggggtgggcttggtggtcacccagagccctggcgcgcagcccgcgggggccacggtgcaggagcagctgcggcagctctttgagcgggactggagttcgcgctacgccgtcggcctggacggacaggctccgggccaggactgcgtttggcagggctgaggggggcctctttttctctcggcgaccccgccccgcacgcgccctcccctctgaccccggcctgggcttcagccgcttcctcccgcaagcagcccgggtccgcactgcgccaggagccgcctgcgaccgcccgggcgtcgcaaaccgcccgcctgctctctgatttccgagtccagccccccctgagccccacctcctccagggagccctccaggaagccccttccctgactcctggcccacaggccaggcctaaaaaaaactcgtggcttcccggtgcctctgtgtgagtcccgcgcgggcggcccttcatcctcttgccaagggcccgcctctatgcgcccgcccctgcgaaactgcgccgcgcgaccgccgtggcagcgcctcagctagccccgggtccgcgagaacctggggcggggcgggg

SEQ ID NO: 78303 - DNA, 1054 bp, Homo sapiens
gatggggcagagctggaagaacaaaaacttcaagaagaaacaatcacgttttttgatgcccgagaaagtttctcccctgaagagaaggaagagggtgaactgatcgggcctgtgggcactgggctggactccagagtgatggtgacatccgcggcaagaacagagttaatcctgcccgagcaggacagaaaagctgacgatgaaagcaaagggtcaggcctgggaccaaatgaaggctgagaggtatggctcatcagtacaagagagatgcaaaaaactaagttggaaagtaaaggctacacacacatatggagcaccccatcccacagcacattacatccacctcacttcacagaacggagaacagagcagaaatgaccagaacacctttgtcaccatcacacagccctcctaaaatggaaccaaagcttcccagctccctcaaagctttggatgcaaagaaggcaccctgacttccacaagacaccagaattcacacggtactcagaggcactgctggggaagtttgttggtctttattagataaatttccagagacctgtccataatacccaacagaacatgactgtttctttgaggaaagggttataatgtctgtggtgtacaagtcgtttttggtataacttctttcctgctgctgctgcttcccggcaaacatagttttcctatttcaggcagagtgcggtatattccaggaaacactgtttcctactcacttagcttacttctttgttgaatgcctcactaatggcaagtttcaagatgttttgggtgacaatgcacacatgctgggcaaaagggtgatggccagtggctggcagctgggccagcagaagctaggacatctgtgagttgtcattctcatctatccatgtccactggcctgccagcatccgccagtgccttgccagtgtgcacggtcccacactgtggcccctgagtcccctaatgtacacgctgcagccagaatgcagatggagctggcttggctgttccctggatgggcaataaagaaagtgctgcatcccatgct

SEQ ID NO: 78304 - DNA, 1313 bp, Homo sapiens
ctcaagctgagagtcactctggcccactgaattccatgattcctgtttctcttggtcaggtatcttttcctaaattctataaaccaaagtttgtgttttcagtcccccaaatggcagttcctgagggagacctacatgcagcagtgggtgccccagtcatgtctcctcttagccctggagaaagagtgcagtgccccttgccaagcacccagctgccatccccaggcacctgtgtgtctcagggcccagaagagcttgtggcctccttgcagacatcagtagtggcccctggagaagccccttctgaagatgctgaccacgaagggaaagggagtcccttgaaaatgcctaagattaagcttccatcatttaggtggtccccgaagaaggaaacagggccaaaggtggacccagaatgcagcgtggaggactcaaaactcagcctggttttagacaaggatgaagtggccccgcagtctgccatccacatggatctgcctcctgagagggatggagagaaggggaggagcacaaagcctggctttgccatgccaaaacttgcacttcccaaaatgaaggcttctaagagtggggtcagcctgccacagagagacgtggatccttccctttctagtgccacagcagggggtagctttcaagacacagaaaaggccagcagtgacggtggtaggggaggacttggtgcaacagcaagtgccacaggaagtgagggtgtgaacctccaccggccacaggtccacattcccagtttgggctttgccaaacctgatctcagatcctccaaggccaaggtggaggtgagccagcctgaagctgacctgcctcttcccaaacatgatctgtctaccgaaggtgacagcagaggatgtgggctcggggatgtcccagtgagccagccttgtggggaggggatagcccccacacctgaagatcccctccagccatcctgtagaaaaccagatgctgaagtcctcacagtggaaagcccagaggaggaagccatgaccaagtactcgcaggaaagctggtttaaaatgcccaagttccgcatgcccagccttaggcgctctttcagggacagaggcggggctggaaagctggaagtggctcagacacaggcaccggcagcaacagggggtgaagcagcagctaaagtcaaagagttccttgtttctgggtcaaacgtggaggcagctatgtccctacagctcccagaggcagatgcagaagtgacagcttctgagagcaaatcatccacagatattctaaggtgtgatcttgacagcacaggc

SEQ ID NO: 78305 - DNA, 1575 bp, Homo sapiens
ttctttgaaaacataaaatatgaagatgctctcaaaatccttcaatattcagagccgtacaaggttcagttcaaaatcagacggcagctccctgccccacaggatgaagagtgggcttccagcgatgcccagcacggcccacagggcaaggagaaggaggtgagaccactatgcccggggggcagggccccagctggcttcactaccctgctggctgagcctgggaggggatagcactcccactccatctgtccctgggccagggccccaggcttcttggactggcaccaacagattccctctccctatgtttcaggacacggatgttgctgatgggtgcagagagacccccacgaaaactctggaaggagatggggaccaagagagactcatctccaaaccaagggtggggagaggcaggcagagccagagggagaggctctcttggccaaaatttcaatccataaagagcaagcgggggccgggaccccagaggtcacacagctcgtcagaggcctacgaacctagggacgcacatgacgtgtcccctacaagcacagacacagaggcccagctcacggtggagcgccaagagcagaaggcagggccgggcagccagaggaggcggaagttcctcaacctcagattcaggacaggctcgggacagggcccttcatcgacaggacagccaggcagggggttccagagtggggtgggccgtgctggggtcctggaagagttggggccctggggtgatagcctcgaggagactggggctgccacaggcagcaggagagaggagagggcagaacaggatcgagaagtgatgcctgctcagagcatgccattgcccacagagctcggtgaccctagactttgcgagggaacccctcaggaagggggactcagggcagccaggctccatggaaagaccctggaggggcaggcacaggagacagcagtggcccagaggaagcccagggcccagccaactcctggaatgagccgggagggtgaaggcgagggactgcagagcctggaaatcgggatcgccagactgtccttgagagacacaaccgaaggaggcacacagattggcccaccagaaattagggtgcgagtacacgatttaaagacaccaaaatttgcattttccacagaaaaagagccagaaagagaaaggcgccttagtaccccacagcgagggaagagacaggatgcgtcctcaaaagcgggtactggcctgaagggtgaggaggtggaaggagccgggtggatgccgggcagggaaccaaccacacatgcagaagcacagggggatgaaggagatggagaggaaggactacagaggacaaggatcactgaggaacaggacaagggcagggaagacacagaaggacagataagaatgcccaagttcaagataccctccttaggatggtcgccaagcaagcacacaaagacaggcagagaaaaagccacagaagacacagagcagggaagggaaggagaggccacagcaacagctgatagaagagaacagagacgcacagaggaaggattaaaagacaaaga

SEQ ID NO: 78306 - DNA, 1046 bp, Homo sapiens
gtgccctgcagctcttgtgagcatgcgtatgggctgatggggacaggcctcatgttactgtgtttgtgtttcaggggcacagggtgtgtgcatccctgcacctgtgtaacacactcatgctgtctttggggacagggccccatggctacctctggagacaaggactcggggaagggatcagaggaggcatgtctatgaaaggattcatttttgtacaatttgaatttcttatctccctccatacaaaactccagttgctgtggggcttccctatgggcgctgtgggctgtagggtgggtgctgtgggctgtaggctgggccctgtcgggaagcaggaaggccgagagttgccttttctctgtggatgtgcctggaggaactcggctgcctctgcacacagctgtgtgttggaagttctgggcccctctgaagggagggctcctggtctggcaccagcctacctgtgcccctccctgtccctgagctggggcaggtgcctaactcccaacacttgtggctgcaggaagacgcccccggcaggcaaggttctgctgggagacggagatcctggtggaagcgagattcaggggactcacggacatttttcaggatgagtcgtccagaggtgggtacagcaggagctgagggtcacagaggtgtgtcggtcctcaagggatccagccagagagtccgaggtcagagcaggcaggggaggagcaaagaggctggcagtgtgccccgtgccctggggaggaggggtgttcttgtcccccttgtcaggcctggggaagggcaggggctccagaaggctacatctggtcctggccctctccacccctccctggggtggagtctgatgcatagccaagctcctggccaggtagacctggctgtacagacctcgattttctcctccgtgcaatggggcagtgctggtgtctgttgcatattcaagctgtggggctgaaaaggccagtcagcacccaggccatggaactatggaaggtgctagactctgctagcacccaatgatgagggcactctgc

SEQ ID NO: 78307 - DNA, 1046 bp, Homo sapiens
gctgggcctctgggtacggcgctgactcagccagccctgccctgcctggctgagtgtgggtgtcaggtggtaaacagtaaacagcgttcccaggtgagagctgtctgggagtgtccctggagcagacgtggccagctttcctgcctccgtgtaaatagagtcgttttctatctttgtgaccgttaggtttttgtgtcagcctttttagggtattgcaatggggggaggcccagaaggggcctggaatcaggtccccacctttcaggcctgaggagcccctgaggcctctcccaccccatttgccggcaagtgcccctgccctggggctgggacagagccttccctgcccttgaagtcctctggcctacttgaggaccccttctctgtgtgcccacctcaggccaccctggcatcccgtggcgggggcagccctctcagctgcaccttcccacctcttcccatgccgttggggcctggtgcaggtgcaagccgttccatcgctgacctcccaggctgggtctgacccctcgctgcccctaaggcctgggctgggcctcggctgtgtgggcctgctccagactgcctgttggaggcacgtccacacccaggctatgggcacagggctggcacactgggatcccaggggggctacacgtagcacagctggttgagtcctgctggagcctcctggctgcccagagcaaagaggagtgggggctaagggcccagggtgcagcagggtgaggtgaccaggaggtgggccaggcagctggagctctggatagtgggggacttggggtcatgggactcaggtgtttctcagccaccacttgtattgaaatgacggggaaggatgggaggcttgttaaaaaaaaaagctaggccagtgcggaggctcacacctgtaatcccagcagtttgggaggctgaggcagaaggatcacttgagcctaggagtttgagactagccagggcaacacagggagaccttgtctctacaaaaaatttaaaaattagccaggcgtgctggtgtgtgcctgcagccc

SEQ ID NO: 78308 - DNA, 1712 bp, Homo sapiens
caccgcctggccgccgcgatgtgcgactgcttccacatggtgctgcccacctggcccggaacccccggcagcggtgcgcccctccccgcctgcagcccgctcccctggggcgggtgggctacgcgcgagggcgcgcgccggggcgtgtccaggggcgcgcagtgcgggccttgggggcgggggactcggagacgcctgcgggactcgcgcgtggttctgggccttcccggccgctggagtctcttctcccatgcctcgcgttctacctgtccgtggctgtaggttcctgctcctctcccggcctctgagactgtctctgtcgctcactttgtttctcggtggctgactcgtctctgtcgctcactccctctgtcactcgcggtccctgtctgtctctccttctcgctcctgccccgctcctgggacgctgtctggtcgagaggcggcctcctgggaggtgctaccgcactctggagcagggctggtgtctgcaaggggcgtgaaagccggggccgccgggacccggggcacctgcaccaggcttgccctctcacctgctttgcgggagagcagccaggctggtccaggagtctgggctctccactttggtccggggcttccaggcagggctgggctgcgtctactgtgtggctgtgtggtggggtcgctggctaggtggaggctgtggcagggctaggcctgaggtctggggcctggtgaggggcctgaatggggtcaaagtcaggccacagggtcccgcagtgctgggcaagggaaagtgggtgctacctactggcatgcccccagggatggtcagtagcctccctctgagccgcaggctacggcatgtgtacctgctgctctttgtgtgtctgtccctgcactgggcctggttccggggcctgggtgtctcagcatcttggagggcagggctgaggggggcagggcagtcccttgggcgctgggtctatgctgctgcagctgaccacacccagggcattggcagccactggccagggggttgggctggccggcactggtgcaggctggaccccactccttggggaaaacaggtcaatgctaatggtgccgacaatgctgcaggtgagaggggtgcccctggcctgggcatgccccccagctgcagcaggcactaccaaggcccctcctgtggcctgtctgtctggtgcgcacttagggtgggaggcttgtctggggggctccagagcagggaggcccctacagcacctgcttcacggtgtcgcagatgggagcccaaggtgtttgggcacagcagcgggaggatgatggctccggtgggctggaggcccctggccccctcctctttcactatgactggccctgcccacatggctgcaggtcgacctcctcagagggagaagggcagggcccccaggcatgggaccactaccctgcccccagcttccctgcacagcctttctgctctgcttcctcctcactcacgggcacccagagactcccaagctgcagggtccaggaccatctcatccaccccctgcctccacagaggcttgtgctggcttcatggttcccagcccgtctggggcagtccctccctgtgtccagcctacggaaccatccgctcttagggaataaggtcagtggctctcgctggagctttggtaggagacttgcaagatcagagaccttgggagttctgtccagcacac

SEQ ID NO: 78309 - DNA, 1147 bp, Homo sapiens
atagtaacactaatggtatgatcaattacaaatttcatttctatcacaattatttctttggaataaggtaacgttatgtatgtctttctcctaactttggtatgcttttcttcttttcttttcagcccattctcagctatgagaacattttaaagtgtgcttttcaagaaataacagtccagcaggcagctgaagacgtttccaccatagaccatttcctagaaataagcagtgaagaaaaacctggcgttgaacgtgtacataaattgtggtaatgaactgaagaaatatttcttacagcaactgcttttgtacttttgtttgataaaagtaggtgtgtgaggctttgtttttgcctttatggagagtagcatctctcctgaggtccctgccatctgtgggtcataggggtcctatgagaaggggcagcacgattggcgctccagctgtggccttccactctgagccctattcatcctcctccccagccagctcacctggagcagctggacccaagcccagctccccttgggtctcagtgccagtgctggtggagtgggtgggggcctcgcattcagtgcgagtggctggtgggcctgggcagtgggcacaggggccttctgggggacttggctgagtgggcaccggctgcctcatggttctcagccacagagttctagaaaacgttccacactctggagccccattgtcagccccaggcccagccccaggggtgctcccggtgctgcctgcagggccacaggctcctaggggaaagtgcacccgcagtcactcgcagatggccattttccagggacacactttcaactgagcattgaaagacagacagcgctcgagtggattaggccgcagtggttgagaagctcgaggtaagttggcccaaggccccagagggaggagggaagtgaaggttggggtgagctagcttccctgtccctcggtgtggtctgcggagtgggtctcccagcagccaggggagagccaggtcagcctgctgatttttgtgtctctgagcaggcctggactttcagagagctctgcagacaggccattctgggctccagccctggcccaccgtgtcctctgctggggtccaaccagcacctgccccagggtaccctctaca

SEQ ID NO: 78310 - DNA, 1094 bp, Homo sapiens
gcccatcactgtgcacatcgcactgataccacagtgacatggaggctatggtcccctgtgtggccttggcaggaaaagagacagccagggtggctgcttgcttaagacttcaggcctcccctggggacaggatttcaggtatcagtccccccagctgatgaaccagtgacaacaggcttatccaggtggttttatttagtaaaattttacaaaagtcagggctgacttcttggctctgcccttcgaagagcacagttttccttagcagataactgggggaagccacgggcccaccagaggctctcgcaggccagtggtgcgacctcctgtccacaaccgtgagggacaaaggcctgtccttgaggctgctgggcaggggcccaggcagtaagtgagggcacctgcgaggctctgaggacacagcacatctgtacaccctcatggtgccctgaccacacagcagccagggcagagtgtgacagacagagggtttctgagcggtctcaacagctgtctctctggtgacgtttcagtgccttccccttttcctctgaactcatggatttggccacaagttgctccccctggactaagcagcccagaagccatgcccagggtccatccctgggcaaccccccaccaggtgccagcagcattcacatggggcagggggcccatgagtgccacctggaccccgacagcctgtcatggcatccagaaacctctgtctccccttggctctgccaaggacacatcctccatctcctggtcagacccgagacaagcccagaacacaggacaggtcctgttggagagatcccaggaatgggcctggggtctggaaaacagctccacagacagctctggtttccacatcaacccagccaggaagaaaatgaaaaattcctcataaaggtacaaagtcctcctgattttagcaaacgtcgctattaaagagtgtcagtttgagcttgcgtggagtgaacatccttttccttggaatagtgatgtgctggccacctccgcatgagggggtcttcaggaagcggctgcatgtcatcagcctcccctgtttgctgccaggcggccccgag

SEQ ID NO: 78311 - DNA, 1056 bp, Homo sapiens
ttcaacatcccctgacccttttctcatttggggtaattgagtccctgggcttggccagcgtgcccctcgctcagctgccagggacctgcccttgctgggtggaagaaaagctggtgacagtgtgtgccattgcagcacacatcgccgactccgcgcccccttcctgattaggagaacacccagcatcagctggcgcagtgacatcaaagactacgtttcctagcctccctcgctgccagatgtggtcacaagactacgttgggcccaggaaagagggaagatggagcaggcgaactgggtgggaattccgggaattctccacacaggggacgggccgtgccctgctctccttcgctccttcctcattcctggaacacagatgtgaaggctggagatcaagttgccatctgggaccatgaggtaaggctgggggcttcccatggctgtggaggctgtcgtgccagccctgagaaagaggaaactctgtggattaggtgggttaggcatggtcgtctgggttttctggggtcacaggcagcctctccctggcctcactaggacacactatgactgttgaaaccatgactcatgattcacattgggggtatgccctggtcaaaggaacatgcgctggcaacaaggagtttcagaatgatccagttcttgggttgacacttctcaaaagcccctatcttcccctgcctcttctgtctcggggaggctgtcttcaaaatttccctaaaaaccccttccctggctgagacctggggcctcttgccttcttaccagagcagctgtcccccaacagaaacctcaggacacttccgcctttcctcttcccacttggcctgtcatccggtccccaccccctgcttgcatcactaacacccaggggtgggagaggccaggacagagccctcctccaagggagcgaacaaggagtcagaaaaggctgggaagacttcttccgagggatggaatcaccatctgagcagaggggcccggcgagacgtgaatacacagacacacctgatggagggagggatggaatcacca

SEQ ID NO: 78312 - DNA, 1929 bp, Homo sapiens
caaccagtgggccccgctcaaccccatccgcaaccccattgagcggccggggggccacaaggacgtgctctaccagtgcaagaacttcacgccgccgccgcgcagggcggacgaggcgctgcccgggccggccggccacgcggccgtcagggaggatgaggaggacgaggatctgggccgcggtgaggaggactccctggaggcggagaagttcctctcacacaaattcaccaaagatcctggccgctcgccggggaggccggcccactgggcctcaggccccaaagtggacaaccgcgcggtcaggagcatcaatgaggcccgctacgccggcaaggagtaggggcggctgccagctgggccgggacccagggccctcggtgggagccatgccgtctgccggacccggaggccgaggccatgtgcatagtttctttattttgtgtaaaaaaaccaccaaaaacaaaaaccaaatgtttattttctacgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggctggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccaccattccggcctcccttgttctttcggtgctgtcccttttgtattgagagtgaggttgggggagagccacgccggcagagaggcttggggcagtggggcgcgtgctgggtattggcccacgtggctgtggtggctgtagagggcgagacggttctgttgagtcggggcctgccagggcctcgaatgcgttggcatgccaaggtggtggatgcaggtttggccaaaaccttcctgggaatggggaggggggtgtctaggtgcctggcacccgaccctgactaaaacagctgaaaacagttttataaaatagtataaaattgcttacccacgaatacgtatcaaggtcttaaggaattaacaggtcaaaatttttattcattcatttattcctttgttttgcttggtcattcagaggcaaggtcagcatttgatggaggcaggagagaagcagcccttccacctggccctggagctggttttgcccctcactgcttgagccaactggaacgtggcatggtggcctcagggctgggcatggaaggccgactccaaggctgactccgagccgcctgtcagtgatgtgcaagtctttaccctgctgtgaggggtaggaggtcaactgagtcaaggagc

SEQ ID NO: 78313 - DNA, 1017 bp, Homo sapiens
gaaggtaggccccgtgtgattgccctgggttggggcgggttggggggcatgggtgacacccagccccgagggccagatgcccactgctgaccctcgagccccttctccccacagtgatcgggttcgggagatcctgctggtcccggggcactccgttcccacacggaagctcctgggtggaagactgcaacagctgccgctgcctggatggccgccgtgactgcagcaaggtgagggcagcccgtgagccgccctgccctacccgaggctggtgcacgctgaccctggccactctgtgagatcaggaggcgggtgctggggtccggatggactgagagccgtctgccctcagggacacccagggaggcgagagctcagccaggccccatgcttcgatgtgcagttgggaaaacaggcctggtctgggtcctgccttgctccgcctgccctttctgatgtcgagcttggcctgcctccctgggagccctgggtagggggtgggctgggccctggggctcacagacttgggcggtgtccctccttggcatggggcccgtgcctgcctgtgggttctcatctgtgtgcctgcatctgaccctcctgtgcgcctgcgcctgaccctcctgtgcgtgcctgcccaggtgtggtgcggatggaagccttgtctgctggccggccagcccgaggccctgagcgcccagtgcccactggggcaaaggtgcctggagaaggccccaggccagtgtctgcgaccaccctgtgaggcctggggggagtgcggcgcagaagagccaccgagcaccccctgcctgccacgctccggccacctggacaataactgtgcccgcctcaccttgcatttcaaccgtgaccacgtgccccaggtgaggggcctggtggcatctgagcttgcagaggccacacgccggcatctgctcgtggcatggcgaaagcctagccccgcagggcagggaggccctggttggctgagcagagtcactcttggtcacagagagt

SEQ ID NO: 78314 - DNA, 1048 bp, Homo sapiens
acttggccaccccgtgcacttggtggaggccgccagcgtggtgatggggccccacgttctcccccgtggtcacccccagtgaggcaccaaggggcgttccacaggaaacgctcgggtcccggctgcccatggggcccctgtctgtggccactccagccaggctgccctttgcccacctctccccccggtcgctcttcctgtgctccgtgctgacttgagccagctcagggcaggctgggcctctggcaccccaacggtagggagcccaggcccctgagcccgcgtggcctggaggggcagtctccctcccttgagctgggtcatttttgggtctgcagaggatgtggcctgaggatgaggagggtggtgggtccctggctggggaggaagggccagagcctggcagacccaggggcagcgtctgagccctgggccttgtcccaccctgaacgaggcaggcaggtgtggcctcaggtacctgacccgcctccccatgtctgcagcgctcctttaccctcatcgtggaggcctgggactgggacaacgataccaccccgaatggtgagtgagccctgggccaggtggcagctcctctcagcttcagcgtgcctgtggcagggcccagctcctctgtctgcttgggacaaagccttgctttaccctgaggatcatgtgtgctgtttccctttttgctttggctgccaggaagctctgccacgtttgggacttgcagagctgtgcatgcactctcttccccagtcctggctttgcctatgttgttctcctcttgggtgtgctcttttggggcccatggcagtgacttagtggaggggacacccttgagtgtgtctctggctttgtggccccctctgcttgtctgtactggagcatggagccttggtggccctctccctgaggcaggggctctgcagggccctgcaggggtaacgggatgacttccatgggtgaatgcagaagcacccacaggccaagggagcagctcgtgtgaaggtctgggcaggagcgggctggctgtgcagggggagca

SEQ ID NO: 78315 - DNA, 1099 bp, Homo sapiens
agtgccctgagctttggggtgccctggactgtgggtacactgggccatggggtgcacaaggctgtggggtgtactggatctagggtgccctgggcaggagggtactctgtactttgggtgccttggacctgaggtgtcctgggctttaaggtgccctggaccttggggtgtgctgggccatgcagtgctttggggctctggggtaccctgggctttggggtgccctggaactggggtgccctgggtcttggagtatgctgggccatgcagtgccctgggctgtgggatactctgggctttggggtgccctggacctggggtaccctgggctttgaggtgccctggcctggggtggaacatctattgtcttgtctgcctgtcctctggcttgtgccactgctgttgcccctgcctggggacaggaggaggggtttagacttagccttgagggttcgggctggggaggaggcaatcagatggtgggagatgaagttgggctgcgggtctgcttgtgcggtgggggtgggtcaggccgggcttgtagggagaggcttagctgggcctgcaggggtgaagcccttcccccttggcctccagagactgggcaggggcatagccctgctaggctggccttgagggagggcctgggttcctctccctgcttgccggggaacctgggcaggtgatgggtctctcacctgtccccagacccccagcccacacatcgcctattgcccctgccagcgccaggcccacatccccacatgtcccagccccgttcctagaagggcaacatgcccgccaacccccgcccaatccaggccctatagtccctcctgtgttctaggggtttggtgttgacaaaaccctgtcccagatcgtggcccgccaggcaggaaggacaggggtgagaggttgctattcgcagaggaggcaactgagtcctggaaggacaggggtgagaggttgctattcgcagaggaggcaactgagtcctggaaggacagggatgagaggttgctattcgcagaggaggcaactgagtcctggaaggacgggggtgagaggttgttattcacagaagaggcaaataagtcct

SEQ ID NO: 78316 - DNA, 1035 bp, Homo sapiens
caccccgggtgctctgtaggcatggcaggtggtgatggaggtttggggaggagtagtgtcatgctgggggcagcagggagctttgctctggggcctggtaggtggcaggcccaggggacacctgctggctgagggaggagcagggtggtggcagttggccgtgacctgggcagccagggccccaccctcagaggtgcagctggaagtcgtgcctgcctggctggcccatctctggagccaggagcccaggagcctgcctgccagcgagggtctttcttgttctgtcttggcatgtgtgtgctgggctccagggcagctgtgcggggtggtgtggctggagcatggtccccgtgacagatctgggcttatgaggagaacgggatgggtgaaggccctgtagatacaggaggtgggcctggggctgaccctgcgtctatcagctcaggaggcctgaggtcctgggccatcagaagggctgagcttttctcacctgtgaaaggggcacactgccgctttttcattgcaggtctcacgaagtcagatggggctgctggactcccagctcgggctctgcttgtgcccccagcccggctcccagacctgtccagttcctccccttcccagccttccctaccctctcctttgccccctagggaggaaggtttttacagagcccaccccctgcatccagccgccctagggctcaaggtgggccaggctgaggtctgtgcctggagctacctaagctgctcgtggcaggtgtgaggttcagcaccactctgcttcctgttttttctgagcttgggctggggatgacagggccctggcctccccaccctaccttcaggggatcctgtctgcacactggggaccacccccctccttcccacaccttcccagtagggaccaggagagctggctggtctggtatggaatgtgggcatctgggttcctgtgttgggtgggcatcggtctgttcctcctgccatggccctggggcccagagccctggggagaactcagggcatgtccgcc

SEQ ID NO: 78317 - DNA, 1016 bp, Homo sapiens
ggagccaaggagggctctgggaagtaggcatcctgcttagactcgcatcgggaagagcaggccgtggcttcagggatgcaggactggagatgctgctgactaggggtcagggtgtccgtctctgagggcctgatggggggctggactgacagcaaagttcacccaccctgtggcagggcccgtggctccctgtctctgattctggaggtgagccaggcctcttacctgccgctgcaaaggacaaggcccagggaggcagtcagcttggggcgtgatggagtgaagttggaacgtgccctggggtgggggaggcgttgcccagcctggctggcagattcctctcagcccgggccaagggccgggcctgtctccttcacaagccggcggaaaccggggctggaaaccccagacccgccacttccctcagaggcgcagccgcggccgccgccggaaatgggccatcaggaaggggtctgcgggaggtgaggggctagagggcaaggaagcagctgggtaaggtcggtctggggtgagtccccccggaggtggggaggccttgggggtggggcatggaagcccccagttctgtccctgcccctgtatgttgggtacatctcagagggcggcctctaccctgcaggcctccggctggccttggttcatggcacccgacagcccctcctgcggcgagccagggctcccccaccccctggtcatcttcccagatgcccctcagtcccgtttctccccagatccacacctggccctccccctcctgttccagaatgcagcccagcccctctgccatcctgtcctcctagcccgtggtctccctccacacacgccagtccaggctccttcccttggtgcctgacccctcctggctgccagcagcccccttctggccactgcccactgagggagggggcttcctcttacccctccccagcctgggccactgggcctggtactgaggacctcgctgccaccccaccccactctgccatgctacgggg

SEQ ID NO: 78318 - DNA, 1086 bp, Homo sapiens
aaataaaggcatcagctactgcccctcatgatccctgaacttgggcctgttagcttcaaactaaatttctgtttctccctggaaagaaatttgaactaagacattttgtaaattggtcatgtcgattgtgaggttggaggcagccagggtcagagaggctagggacggtgaggtacccaccacgagggccgcccagccagcagcacgaggttcccggatctgcacaccaccacggacctgcacacccagggagggaggctgagggagcccacactgctctcaggtgccctcgacgaggagcaaggccctgctctgggtgcatgccagtcccgggaggtggagaggagcccaagatggctcctggcggggcgcggggggctggggctggggctggagcctgagtcttctaggggggcaccaggaacagggcgggttggggggtctgggctcctgggtcccacagagaccctgggcttcatgactgtgctcttctgcagactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaa

SEQ ID NO: 78319 - DNA, 1090 bp, Homo sapiens
acggagacctggcggaagtcaaatctgaaattcacattccagacgtggagcccgcagcctttctgatcctcttaaagtaagtccactctactggggagggacgggtgggtccgttttaggcggcctccggaggcttctgaagggaagcacacaggagctgatggactcctctcccaggcccagccccgcgatgggtgcttgggagccagcccctgacgcgggccctgcctcgcctaggtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcagacggatccagtaacaccttcccggtctggtttgaacacccggtccaggttgaacaa

SEQ ID NO: 78320 - DNA, 2166 bp, Homo sapiens
ttgggtagagaagcaccaggtggggctgggtcaccaacaggactgagcaacacgggctgcagcagcagaggggcaccggctgaggctatacactcggcccatgccctctcccaggtgccaagaggggccatccctcttttcgggggtcatacaggttttccagaaaacaactgcctacagggtatgcagagtgggaggagagagacaaggggtgggagagcctgtttcaccctatagtccactcctgcaacaggctgtcccgcagcagtgtcacagctagtgacagtccccagggtccagaacgctgggcccagcagaatgctcccccgacagtctgttcatagggtaggactctgaggtgctagtgatgcattaggacatagagacaaccaggcacctggtgtttcctagggtggcccagaagccagccagcaacccaggggacagatgggcttcactggggcgcagtttgctcctaaccacatagcatgttcagcatgacaggttttctcctcgggatgggagggagctgttctgttgcatgagaaagagaataccccactgtacaactgctgtagtcatttactgacacgtgggtgttattttaggcaacctttattacagaagtccactattttaagtgactttttgccaattttagatttgaagggaaggtctcaagttaagcttggaaccacttagaatccaagagggtagcaggaagatccaacccctcaaagcaggtggcatgggtgccactgggaggggatctggggcctgtcttgagccgtaaatcttcctccacctgagacgtgcaccccactgtaccagagatgcctaagactccaatccctgggttctggctgtgtggaaaatgtctctacacagtcaagcttcagctgactacatgtcaaagagagacaaagttaagagcagcctttcatggtgtcaagaagcagttagcatcttgacttcccctccactcactcgctgacctgctgcagcctccccgggcacctcaggcatagaaaatgagctcagggatctgcccaccctggaccccagtcccgttggtgctgtccgaggagcactggaactggaaggccacctttccacactgcacttccgtcatcccctcctgcccaaagtagctgagttcgctgccgtccaggacggcactggccgtgtagaaggtgtcttgttcaacctggaccgggtgttcaaaccagaccgggaaggtgttactggatccgtctgacatgaacttggtcaagttctgagccagaaccaccccgagccgcttgagctcaatcttcacgctgtactcagccttcccagagctggagccatacaggcccagccctgcaataaatacccttctgtccactgcaaactggatgctgtcgcagcgcccgcggtaccgccactggttgctgcggtaggcagaagactggaatcggtggcacctctgcggggcgaggcccttcctcttggtcaggggaaagtccaggcggggcttgttggtggccgtgtaccacaggaagatgctgtgggtctcctccagagtcaggatgtctgactgggcagcgccgttggcaaactcctctagggtcatggttggaattcggaccagatagagggctcgccccagaacatgcctcttgtttcgtggggtgattggcagcccctgcctcttgcactccgcctcggcccagttcaggacggcctcgaagaccaccgcctctttggtgttgagggcctcccgagtgacaatgatctccagcgtctgccggtctatctcacagaagccttcggaccgtagggccatctcggcctgtgcgtcaatgacctcccagcagcgctgcgtcagctcgggctcctcaaacagccggctctgggacagcaggacgcaggcgttcttggcttccaaacttgtctccagaaagttgacacaggcttttgccaatgctgggacgatgtacttcttagcagcgtacagagtggccagcaccgtgtcggcttccagatcgatctcatcactgtacatgtacctaggcgaggcagggcccgcgtcaggggctggctcccaagcacccatcgcggggctgggcctgggagaggagtccatcagctcctgtgtgcttcccttcagaagcctccggaggc

SEQ ID NO: 78321 - DNA, 1234 bp, Homo sapiens
acttaggagggtgagacaggagaatcgcttgaacccttgaggtggaggttgcagtgagtcacgattgcgccattgcactccagcctgggcaacaagagtgaaactctgtctcaagaaaacaaacaaaaaactgcggccaggtgcggtggctcactcctgtaatcccagcactttgggaggccgaggcgggcagatcaggaggtctggagatcgagaccatcctgtctaacgcggtgaaactccatctctactaaaaacacaaaaaaattagctgggcgtggtggtgggcgcctgtagtcctgactactcaggaggctgaggcaggagaatgacgtgaacccgggaggcagagcttgcagtgagcagagattgcaccactgcactccagcctgggcgacagagcaagactccgtctcaaaaacaaacaaactaaaacaaaaaaactgcacgcgttttgcacacatggctttttaaacgtgagtttccatgtaaaggccctttggagattcctcacttgcagtgttcaggtctcattgatccctgtgtctctgggacacaaggttggggggtgtggagtttgaggtgggcaggcagaggccagcagcagatcatggttctgctgtggcttaaagagagatggtgggatcaggacgatcaagatgcaggggcctggcaggaacccagcacaggggctggggcactcatacatgacatgcgtgagtcacacctagacacactgtatgcgtgtgtacacacatgcatgtctgcacactgcatgcggatgcacacacacactacatgtgctgacacgccccccagtttggtgagcagaccccagggatccctggaacccccagaaactgtgaggaggggaaattccttcagaaggcacactctgtgagccaccagcccttgtgatggagccctcggatataatggagaagatggaagctgcgccccactggggtggatggtgaccaggaggagctgctgtgggggcccagccctcccagcgggcagggtccctgatcagaggcatcccccacaagcgctgcctctggctcttgcctctgtctcttgcctctagcgcagacaggaccctttgtgtgcggtcccttaggtctcccagtaccctggagtcagcaagcacctggaagtgccactggcgggccaggacaaggggacttgtctaagggcccacgagccgggcttggtcaggcgagggaattctttg

SEQ ID NO: 78322 - DNA, 1062 bp, Homo sapiens
ggaatgcagtggcaccatctctgctcactgcaagctccgcctcccaggttcatgccattctcctgcctcagtctcccaagtagctgggactataggtgcccgccaccacatccggctgattttttgtatttttagtagagacagggtttcgccgtgttagccaggatggtctcgatctcctgacctcgtggtccgcccatctcacccttccaaagtgttgggattacaggcgtgagccatcgcgcccggccgggaatttaacttttcttgagcaagcagagagcacgcaggtagctcactctgatccagttgctgctggtccgtcttggttcccggctgaaggatcgtggcaggacccaggtgtcccttcctggcacctcgggactgcagaacttcctgctcggctcttttgcctttcagagctgacttctgggcttggcgggcctcagcctggtgcctgtggctccaggggcggcagctgccgtaaagggactaagtgcactgtgccctgctcgcttgttgaagttgcttcctcttctcttggcagcttggcccctcgtgtctggctggctcggaagccactgaactgtaaactctatcttcccttgccaagcgagactgtgagcactaggctcctactttttttttttttttttttttgatggagtcttactctgttgcccaggctggagtgcagtggtgccatctcggctcactgcaacctctgcctcccgggttcaagcgattctcctgcctcagcctcccgagtagctgggattataggtgcccaccaccatgcctggctaacttgtatttttagtagagatagggtttcaccatattggccaggctggtctcggactcttgacgttgtcatctgcccgcctcggcctcccaaagtgttgggattacaggcgtgagccaccgtgtccagccactttttttttttttaaatggagatggggtcttgctatgttgtccaggctggtcttgaactcctgtcctcaggcaatcctggcctggcactgccagactatgacagcttattagaattggcgagaa

SEQ ID NO: 78323 - DNA, 1093 bp, Homo sapiens
gccagcccaaaccaagcccttgccagacacgccgcacctcagagccctggagagaggcacattcagccacaccgcacacgccactcagagcctaaagaagggaaacaggtagaacaggatctcatggcacatggagatcacagaaaattcacatttcagtgtccttaaataaaaagtgattggaacccacatataaaaagtgagctcagaaacttacaaggaaaagcacaaatctatattcttaaagttgctgctgtggccgtgtgatacttttcatgttctgtgggaacatttggctaagagctgcctcgtgctgtgtcctagggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcgtatcctttggtttgagagcctcccagagggccccatcttgatgcttagttggctcccctcgaatattgggacttggtagttgcagtaacttggtgtttgtctttaatagaaaaacaccttactggaagaactgtttcagttgatccagggctttctgaatttggggtctccttttactggatcgaagaactggggagctgggcacctgccttcctcgcacagcccttgggcatgcagagcgagggttctgtcggtgcctgagaatcatgccctggattctccccacttgtggacctactgcgccttgggtgctgtctccacgtcccctgtggttcaggccgccctctggcctgagcaggtggggtgctgttgctgagtgggctgcagccaggcgtacaccgagtgcctgcagctgtggacaccgtgactgtgggcgatgggtggggaggccgccgaccctcagcggtgtgcagctcggccttgtgcgtggataccgtgactgcaggccgtgggtggggaggccgccgaccctcagcggtgtgcagcttggccttgtgtgtggacaccgtgaccgcaggcggtgggcgaggaggc

SEQ ID NO: 78324 - DNA, 1074 bp, Homo sapiens
aagctcagagccagcgctgtcaggtggccccaagacgcctctgagcccaggcacactctctggagggaggcgcaggcccagcaaccaactgtggtggtcctgggggaagtgctgcgaggcggcgggttcttagcccctggggaccggcgcaggtggtgcctgggccgagagtggggaggagagaggggatctgttgctctgggcagcccctctgtctcccaggcaggctctctaggtgcccacttggcatccttcctccctcgtcacagtggtgatcacagggggctggaaaccttggtggcttctcagtttccctggcacacaagtaggccccagccgccccttcctccagcttcatcttgaaagctgagctttctctctgagctgtcgttttctagtcccaaggccactgtctttcctaggtgttttgcctattaattgagaactaagcctgatacagcttcgcagtttactctggaatatttaactaaggcatcagggcaggtgaccagaggcctcaggagagtccccagagggtcctgaccttggaagccaggccccacgggggaaaccacactggtgctccagcgtcccggggcacccgagcagagactgtgcagagagaagggtgggtgaggactgaggctcagcgtggctggaggggccaggcagacggtggagttgggggccgttggcagtgccctgaggaggccgtctgctccactgaggcaaggcggggcttccctgtgagcccacatcagtgtcctgcactgtgtgtgccctgaggcttccctctgccagcaggtgatggtgatggcgcccacacaccagacatcctgggctcctgcttgcaggggtccctcctcgtcctgtgcaaggagcagcacacctcagtgtcaccagaacttgtgggggtggggagcgtttcccgtaatcacaactttcagtggcttcacagttagaacttcgaagctggggtgtccgtgagtgctgctgttttccgtttggggtcacgatgcagccggacctaatttgtgacatggctgcatgtcacctggcgctggccctggaggg

SEQ ID NO: 78325 - DNA, 1015 bp, Homo sapiens
gcttccctgagtctcctgctcagtttgaaacttttgtaatttcttcgtgacttggtagttcctgctcaggaagctcccaggctaaggaggagagagacacgctctccggaaaagttctggttctagaatagacagcaggcgagaagaggaggcggttgggggtagtgagagttctccctggggagatgggagggtgagcggaccttccaggcactggaagtggccagtatgcctggaggggaccccacgtggcattgagttgttccacccctagtcagctgcaggtgggcctctccgtgctttcctgtggctcccacagcctgcatctctgagcgtggtgttggagttgcagagccgctggacagtggggcttgccctcctggagcgcagggttgggacctcggggctttggttttgctgagtggacaggaaggatgcccacccggcacgactcttgcacctggcggggcctcccgaaggacccagtgtccatatgagacctaagggtcagcatttgcccaaggtctggggccgagcactgcagatgtgcctgcttgcctctcttctgggaagtctctggggcctcaaagccaaagccaggagcatctccccaggcctggctgcttctccattccaggtcttggcgattgccccaatgtcaggtcccacagccccacagcccttctcctgtctgcccctctgagtcactgcctcacccacagccccagaaccttcatgcgggctgttggcgctcccctgctccagcactgcagcacatagcctgcccttgctgaacctctgcagcagcttcctggggccctccgaatgagcagcaaagtctttaacccaagggaggtgggggcgtgtggcaggaggggccgggggccttatcagcccccctgtggagctgtgctctattctccaggggtctagaaagcccactctggtgtctgtggggagggtatgggtagggcgggtttcgagaagcctggttaggacaggcgggggtagatgg

SEQ ID NO: 78326 - DNA, 1050 bp, Homo sapiens
cagtgggcggcggctggctggggcagtagcctgtctccagcccttccccctgcctctgtccacgtgcaggggcgtctcctcaggacgcatgttgcctactgaccgctgccagcctgcacgagactctcacggcgggaccctgtctgccttgctcggtgctgcccagagcctgcacagtgtagctccttggcggacgttcctgtaatggaaccaggatgtcatgccaaggagtgtggtttcattttgagtggtggggaagtcgctggactatttcaagtgtgtgtatttgggagagcagtgctgctggagtggtggaccacactggaggtggagattgcctcagggtgtgcaggtggagatgggtgggaggtgtcgtgcagggcttgggacagggctttcggaggtggtctgcagtgatccagggaagatgggctgctctgagggaggggctgaggaagctgacctgggcagccagtggcctgtaggctgggcagcactcgagctggggccaaggggcagcaggacggtgcccgtagccctggaggccttggggattcggaggacctggcccatcgccgtggcctgcacggtgcgtgcacaccgctctgtccgcgcaggctgtgccctgctttcaagatgcctggaaacctctggcagctctgtcctgctgtcaacactggagtcacatgtcagtgggtctcctgctggggactggcttttgtgcaggagatggagggcagggggctacagtgcccttggactaaaggatgctttccttggatctgggcactagaaccagccctttccctctctctgcccagcattctcagcatgcgtctcaggaaggtttgatggagtgggcagctgcggtgctgtggcggggtcggggggctgctgcagagagcgggtctgcggtcagtcacagtgacgggggtctctttggaccctgtgacttgtgtgtggtggtggcaggcagtggcgttgccgagacagggtgctcaggtgcaggtgggaaggggtggcaggatggaggttgtacagtgctttccc

SEQ ID NO: 78327 - DNA, 1045 bp, Homo sapiens
gaacagaaggaaggttgggggaaagcgtatcccagctatgggcagggggtcctggggtgggcaggatttggggcggctgggcctggggctggatagggccgcgggagaggggaggcctgtgctctcacagctgggagctggctcaggactctcagatcttctctttgtggcctgtcatccctcctacctgcctgtccacaggcccacactgagtgagttccatgggagggaggctcaccctcaggggccttcaggagatgggacctctggcccggcagccaacggatgctgaggggtgcccaccatgtgcagggacagctggggtgatgtcttggagccctgtgaggtcctggggccgcccaggcagtcacaccccgccctgcaccccagggtgcaggctcccggggtgacacagtgctgggacggcacagggccgcgtcctgaggagagggcggagccccgaggctgagctgtgccttgcctcacaggttgtgcagcctgactctgaagaagctggtggtcttcaaggagctggagaaggagctgatctccgtggtgatcgctgtcaagatgcaggtgaggccgcttgtgaccccggctgtggctgggtgctgtgtaggctttccatgtgcctgggagacgagtcaggcggtgcgctactgtggggccttgtgccaaaacagcgggcagcccatgccatctccgggagcccggggggctgggaatgacaggatgctcctgggtccagtcctgtcccgcacaagggaggcaggcccggccttctgggatgtggaggtcacatgcatggggccttcccagggcagagctgccctcgagtcacctcacagtgatggacgggccccaagcacctggagccagggcttccctgctgcactcagcacccacttcctgcccactttttgtggggtggagggcgtcggtgggagaggggagcagggcactctgggaggcgagggcctagccagaactcccagcccctggtgccagggcctctctcctgaccctagtgggtcctgtgacctct

SEQ ID NO: 78328 - DNA, 1278 bp, Homo sapiens
cactgtgggaggccgaggagggtggattgcttgaactcaggagttggagaccagtctgggcaacatgactaatccttgtctcttaacaaaatacaaaaattattgtatatttttttgtggtggtacatgcctgtagtcccaggtgctagggaggctgaggctggaggattgcctgagcctaggaggtcaaggctgtagtgagttgagatcgagccactgccccacagcctgggtgacagagaccctgtctcaaaaaataaaaacaaaaaataaaaaaatgctttaagccaagcatggaggcacatgcctgtaaggctgagctacttaggaggctgaggcaggaggattgcttgagcccgggagctcaagtccagcctgagcaacacagcgagacctgtctctcaaaaccaaaaccagaagaggcttggtgcctccagatttgttctgccagacagacttgggcagcgcagtcaggtgctgctgcacctggccgtggaatctgttttgtgatcgcgttaacttcagcaggagccgctcctggtttctctctcatgtcttagggcagattcctggaggtggaacctgtgggccgaagggtctccatgtttttaaggttcttgggaaagatgccagggcacctctgagaattaccccagcctgtgcctaccacccccagactgcagggctgcaatcctgccagttttagagtgcaggagtcacggtgtctttgcctggtttcctgctgatatgcagtcctttgagctagaacaggtcttgcttaatcacagggctccaaacgaatcctgcggtcccatgagattgtgctgccccccagtggacaagtggagacagacctggccctgaccttctccttgcaggtgagtctttcaccagtggtgacgacaccctcatcactgtcccctggggagacgggcccccctcatcactgtcccctggggagacgggcccccctcatcactgtcccctggggtgatgggcccccctcatcagtgtcccctggggagacgggcacgcctcatcaccgtcccctggggagacgggcacccctcatcaccgtcccctggggcgacgggccccgtcatccctgtcccctggggtgacgggcccccccatcactatcccctggggtgacgggcacccccatcactgtaccctggggagacaggccctccccatcactgttccctggggagacgggcccccccatcactgtcccctggggagacgggcccccccatcagtgtcccctggggagac

SEQ ID NO: 78329 - DNA, 1079 bp, Homo sapiens
cacccacggggctcaggctcttggagcacgccccaccccacactcgcccacctgcccaccccacgtgggtgcccagcaccttccttctggggtcggccagggcctttcctgggagggggtgctgagggaagggccccgtgagcctgggaagggctgcagaggcttctggaagaaccatggagtccgcacacgcctccccgggtcccccttggccaggaatggaactgtcagacctcaggcctgttgggaagcctctgggagccacgagcgaatccatcagcgtggctggtgctgaggccttgctgctctcccacggcgggcctgggtgcggcctgggcctgaggaaggggctccagcggcgggtctgcagctctggcggcggctctgactctgcaccgcctgtcttgcagcaacagaacttcaagcagaaagtggtagcgctgctgcggaggttcaaagtgtccgacgaggtgagtgcgccgcgccttctgctcgcggcccccacgcctgcaacagcacctggtcgggaggaggcctctggggtctgtctccgggccacctctggttctgccgctcaccgtctgcacggccccgccagcatcgcacagtctgcgaggcgcagtgacagtggcactgcctcccgggctccaggtcacccgctgggtctctgctgaagtagaagtcgtgaataccctggaagtcggaaagtcattttcagggggatgtaaccattagtttgtgtgtttttttttttataaatagactttagtttttagagcagttttaggtttacagcaaaattgagcagaaagttcagagttcccatggacccctccccacctgacagccccccactattgacatgggccccccctccccacctgacagccccccactactgacattccatggatttttaatgttcatcttttagcttttctctaatctctgaattttctacaatgagcttgtataattttcataccgaaaagaaaaacatggctgggctcagtggctcatgcctgtaatcccagcactttgggaggccaaggcaggcagatcacttgggcccaggagtt

SEQ ID NO: 78330 - DNA, 1038 bp, Homo sapiens
cacatgattccttttgggtagcactcgggaaagggcagaatgtacaggaacagagtgagattcgcagggcctggggctgagggaggggacgcactagaggaaggcaaaggggagcctcctgggtgtggggagcactttctgtcttggttttggtggtggctgcacagtggcccacacccgtcagagctcacctgcctgcacccaggccctccgtgcaccctggcagcccagatgactgcaccagcccaggggaggtggaggaatgccacacgcaccggtacctggggaccgggggtcctcggtgatcatcccgagctccaagacagaagctggactacagccgtgctgagtggaggggtttggtggctgggtgcccgcctcctattgctcctgcagactctggggtctcgggcgcccccagtggggcaatgtgggctgctgcagggaactcacgcgtgcctggcacccgtgcaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggtgagccctacagggcggggcggggaggaacagccatttcagatgccccggccactctgcgaccactctggcagacccatgtccagccctggagacggggtgggcagggccagctgcctcgaagcctgggaaggctctggtggctggaaggaggggtgtgcggctgcctggcaggcccaggctacggctgcactgagccaggcagctttcctttcataggccagggggtgcaagctctgggctggggaggaccgagaggggtcccccagggtgctggctgggctgggtgtggcaccccgttgtaggggatccgtctctgggggatgccctgggaactgcaggggacctccgttcactcaggtggggagtagagctcccatgctgggtgcccctccctgaggaggag

SEQ ID NO: 78331 - DNA, 1167 bp, Homo sapiens
cagagcatggatgggaggccagcctgccatggctggctcggtgggggggtctggctcggcagagggcaggtggccctgggaattggagccacccatgccctggggaccagcagccaccacctgtcttctgtgccttcgcgtgcctgggaggacacagatgtcacagatttccaaacactggtctgctcaacaaggatagtgggatgtcaaaggccacgtccaggcactcctgcctgacagctgtggacacagccagggtgctggggggccaggaggccgccctgaggcagaggtgggcctcaacacaggatttgcatcgctttatgttatttgaaatggacaagaagaggggaaagtttcaactcttctccttagaaatggaactaggcctggggcatctttaatgggatgggaggaatctgtaggtggtttcatccagaggcatttgccaggtcttctgcagagggtgggccaggagccgtccaggttggcgtctggggagggtgggtcttgccagccgccgtctcctcacactggcgctgcgaagacagggaaggcacctgctgggaccagccgcagaggctgcctcctgggagtgtgctctggaccggctgccgggcagaggctgttttacttgtgggcacactttgtggggagcactgggatcaagcctctgccctgcagggctcttgaggagatagcgctgctggtcctgggagctggtgctccaggcagacggctgggctgggcctgtggcatcctccgctgggcctgtttcctgcaagggattctctctgaatgaccctgtgctggacgacaacccaagggagggccggggccactgtgcgagcccatgttctgcacctggtgccgggctgtccctgagggccaccctgctggcctggccattctcgtcctgcccccggcgctccaggggcaacaggtgctcctctgcactgtgtgtgcacagtctccgcctgtaagacagccacttgccggcatcagactctgcagtttggggaaatgagacagaagaaacagctgagggagctgcccagagagaaggcaccagttgctgatgcggtctggctgaggaagctgggcggggaggcacctctgtccctacgtgcaggccacggggggccttgaggccaggggagaggagga

SEQ ID NO: 78332 - DNA, 1052 bp, Homo sapiens
acgttacccagatagtctggagaaaacttctgcaccctggctttggtgctgctgattaccagagagggcccaggctcttcctgggagtcccagggcactggcagctgccctaaccccagcagagcaggggtgcccagcttggtggggaagtggaaatgcaagccggacagggctgagctggctgtgtgggcgtcgggcacctaggatggcagagtgaatccctccgtggagctgtgccctctggcctgtcctcctgaccatgggtgcacagagacccctttgtccttccagcatgtcagcatgtcagaaggggcccaggcgttggtcctgggggccaggccagggctggcagtggttggagatgggtggggccgggacacacagggcagggctgtccggcagggccatccggcagggccgcggccccagggctgcgccaggttctcaggccaagagggagctgtgcccaccaggcggggctgtgccctgaggagagcttaactgtctgtttccttgctcttagccctgacgaagagtcctcccaaaagttcattccctttgtcggggtgagtactggccagctttatgtgatgggaaaccgcacacctgccaacttgtcgtttacagtcagaacgtttggggattgactcgatatattccagaaccttcccacagatacgagctggggatttgccttcccatctggcctgtctcaaagctcgcttccttccctgctggagtggggtgtggggccagaggttgttagttccccttagctctgccttgggggctgataaatggaagcagagacaggtcggtggggcgaggcctcagaacacccaggaggcttggccccacgtctcaggagaggagagactgcctgcccgggttggggagggcgcctctgtcctttaggagcccaaggccccgggagcttcccagtgctcacttgggctgcagcctgcagtgtgtgggtttcacttcctgccctgcccagggttagggctgcttctgccagccaggccatctccctgccagccctgggtctccac

SEQ ID NO: 78333 - DNA, 3883 bp, Homo sapiens
cccagtaagcctgcactgtggggtctccataggaggagctggggaagctggggccctcccaggggtcctgatcgaccctgggggctcttggcctggtttcgtaagatggagcactgcaaaaggccatgctcagaaagcaaacgcagggcagggtgggcctcgagccggggctggaggggtctccacccttgctggcctgagagatggcccacatttcttacttgtgaccgccctgctcttcctggccgccccccccaggtggctgaacagggtgattttgttgtggtgaggggccaggatgtggcctggtgtgcagcctcagctccctgggttcaggcctcagaggtagcctgtgtgcaggaggcagagccccagcccctcccagccagagcccctccacaccagggactcctccttcacctgggaccaggagcctggggcacaccccagggtgggggagagggtaggaaggtctcccattgaatcctggcttcaggctctgccccgagaagtgtctgcggtgagggtgtgagccccgggctgatggcctctgaccccggcaacaggtgggaccctgactgactcgttcagctgcccccaagctgggctgcagagcatctgtttttctgctctccagtttcttttctttttttttttttttttttttgagatggagtcttgctctgttgcccaggctggagtgcagtggcatgatctcagctcactgcagcctccgtctcccaggttcaagcagttctcctgcctcagcctcccgagtagctgggattacaggcgtgtgccaccacacctggctattttttttgtatttttagtagagatggggttttgccatgttggccaggctggtcttgaactcctgacctcaagtgatccacccgcctcggcctcccaaagtgctgggattacaggcgtgagtcaccgcgtcctgcctgctcttcctgtttctttcccaagggtcacactcagtagggagatgaaggtggaaacatccttgctgtggctttctggcctcagagcaggttttagaggaaggggccacaggctgcctagtgcatcctggctgtgggcagcccctttcctggagccctcctgcctaccccgtacctcccatctggctgcacagctccatccttagccacgcaaggggagaacatgggcagagtctccatccagcagctgggggttctggtggcactccctgtgcccctgctgctgctgggctgtgggtctgccctgcacccaggagccccacggtccatcccccacaccatgcccagcaccagggaggttgggcagacaagacctgggccatgccagccctctgtgcctcggttttcccactggttacacaggatggtcgcattttccctgcctacctcacagagctgttctgagggtgcatggaggagcactctgtcccaccaaggacaactagaaaccaaagccatctgacagccagtgcggtaagggcgggggatgtgtgtgtgaggtgtgcacaccccccgagaacctggccctggactggcctcacaggacaggaggcagccccttgtagagctagggctcagccccatcagtctcaaaggttaagccaccagtcaccaccgaggcacccctcaggcctggtggccactgtccactattacgtagacagaccccaccctcacccaggccagctgtgggccagtcccgccctgcaatctggtctgctgccttcctcttccatgttggtccccttggccactgtctctgggcatgcaagccagtgtcctggttcagtgcctcggccagagctggggcaggagaggggcctctgggtgagagctgggggtgtctctgcagggtactggcagccttgccacactgtcctcattcccagatggaaagacctgagtgcctctcgccttcctccgggaatgaattcctcatgaaaatgaccaggccacttcttccgagggccaggccgccccctccccgagacctgtcctgccgtccgcgggtgtgtggcctgtaggggactgagagctgggcttgctgggcacctctggaatctgaccctgtgggccaaagaagcaccactgtagtttctgcagacccccatgcggttcattgtgcattgtttggtttctaggatgtatgtgttgctagttttttttaatgaaaccctggattaatgtaaatagctttttggggaacggattctaatgtcacgtatgtgaccgtgtggactatttcaaggtgctgatgcaacactaataaacctggaggggccggcccccgcctgcagtgtgattctctcggccgtccaccccttgggagcacgcggcggagcagcgcctccctcccgcccgcgcgccccgtcctgggtcgccccgccccagccctgcggccccgcgcgcgcggaggtggcccggggctcagcggcatcgcgccgcttgaagggcgcagggccgaaaggggctctggccgacaaaccccaagttcaggtctgtgcttcgggagaccccggaggccgacgcccggaagggcccgtggggcggtagcggccatagacccggatatgcgccggggacccccagaccgcgcccatcccccacccgccgcaacggagcccagaacgcaggcgcggcgcagaccggaagcggaaccggtgggggcggggcttgccgtagcggacgttctggagcgaggcgccggccccttgggccccctcaagccgcggtgtactccagcggccccctgtggcctctccatccgcggcgggtctgtccctccttctgtctccgggtgcccacgtaccccccacctccgaccgccgttcccgtgtaccccgcccccccgccgaaccccagagtgcccacggcctccagcgtgtgtcctgagccttcttcccccgtccctccgcggaccccggccgcgcagaccccgcctccccaccggagagggcgggcacgtaagggctccgggctgggcctggggcgaggcctgggccgcgtggaggggaggtctcagggtcggaagcggggctgtggcaagagctctgggcctttccttcgccccgggcgtagcaaggccgggccctgagagcgtgcccgcagtgctggctgagggctgatgcccctggaacgtttgagaaggctggcagaggcgtggagtccgtgcagcaggctgccgaaggctttccaggctcccggggtggggtcggcaggggcagagaggacagttcgggaggctggtgtggagaagagctgcggcgggagctgggggatccactccacccagaggggtcagtgatgcctgacctttggctggaaggtgaccctagcagaccgcgatactgccaccatctgcccccagggactcaggtattggtgggcacgtgggtggccttgtgggccccgccccacctccccctgctcctacccccagatctcagaggtgtggacaagcagcctactagggctagagatggacagcaggaaactgtccccccgggggaagaagctggagtcgcacctctcccaagagcacaggcggcccccactgggcctgatagcagcctggggccagcccagtatccagagcagcgttcagcagggactgcagactcaggactgggtaagcggaaggaaaccctggccgaggctactctcctgtccccagcccgcctgaggccgctgtctctgaaaactccaggctggtcgtgatgagcagcctcaggggagggctgagtggggactgatgagaaacagatggctggactcaggaggctctcttccccatggccctggacgagcaccaaggtggacctgcacccttcttgcttccagaaccgtgggccgctgggctctgtagagaggtc

SEQ ID NO: 78334 - DNA, 1650 bp, Homo sapiens
gagctacggcaggactcacctgtggggcacagggagggatcaccagggaaatggcccttgtggaggatctcccctctacccccagggcaccaggggaggatctaccagggggttctggtggaagggcccacccgggaagcggcgcgcggggaggactcgggggcgccgagaggaactgtccgggaaggggcgcgcgggccgcgggcggcgcggggtcggtaacggcccgtgcggtgggcggcggcgcccgaggcccctccccgccgcccgcggccgctcctcctcttcctctcccgcccgcgccgcggccctcccgtccctgcgcggcctcggcggcctcggcggcggcggcggcggcggcggcggcagcagcgcggcccctttaaacgcctgcggcgccccccgcccccgccatcgcgcctccattttcccggccgcccgcgccgagcgccgcgcccgccccgggcccctccgccgccgccggcccggacatggccgccaacatgtacagggtcggaggtaaggccgcaccgcctttatgcccggccccgacccgcccgcagcccccacccgccgccgctgccgcctcccccgcccctctgccccgcaggccccgcgccccccgcccgccctcgcggcccccggctccttcccgaaccgccccccgccgtgctcaccccaacccaaaatggccccgcgggtcggccccatcgggggcgggcggggctcggcggcccgggggtggggggcggcccacctgttggggccgagggggcggccgcgggggtggcgggggggcgcggggcctgcgggacatccgggggtccggggccgggagcccccagcgggagcacgtggccttgggaggcgccggctgccggtctgggagcaggagttttggggctgtggggtctcccccggcccgcggccctgtgctgggactccggtgcatcccctctggggatggggagccccggtgaggggccacgttcctccctagagccctcctgcagcctggccccggggcttcccccagcagggatccctcagggggtcttcagcagggagcgagcatcccgagcacgcctctaagtccccccaaacttttccctgcctctcgctcacctcagcccattcgggaggcgctttgcaagggttggggagaggccggagggcctcctgggcaggggcttcctccgtgggcccagcctcctgttgctcgggccccccgggcctgcagctttgagccttgccctccttcgtgtgcctgggactccgtggggtctttcacaggaaggtggggggtcgtgtgcattccatcattccatcagcgcctccctccccaggactctgagacccctccctgcctgtgaccctctcgggcaggtgctcattacctttcccacctgcagcctgcgctgctggagggagctggggtcactcccgctctggcttgatccccatgcccctgaccccgagtgcccagaacactctgtgtctctcgagcgtggcttctgctgccttggacgccgtgtggtctggccggccagtcctgtgaccttggggacggtgggagccccctacatcccgtctgtgagatgggcggtcagtccgcatcagcagctctgggcctcccctgtcctctcagag

SEQ ID NO: 78335 - DNA, 1592 bp, Homo sapiens
gtgctggtcttgctgtattttgctgaatcccaggcctgtgcgggcctctgggctgattccagctgagacaggcctcctgctcagtcccccctgcggagctgatgcagggtgggctggcgagggtgctcgtggtgctggttcgtgaggacatggcctcagtgcctcccaagctgagcccctgcggtggccccaggaggcctggagcatcggggtgtcagcaccaccagcctggacttccctgggccttccagggtaagcctctgggctccggaaggttccgtggctctctgtctgtggagctggtgagaaggctggagggccagatggtttcatcgctgagggaagcgctgtactcacctgatggccgatcttggggcactcccagtgcctgctgcctgttgctgtccctgagctctggtgagctctggtattcctgtcattcctggagcaactctgtcctgtttttgagcctgcctgggcccaggaagccccaactgtgttctctgtgtagtcactgctgttggttttggagggaaagatgggggccgctgtgggcagggctggtggctggtggtggccacgtggctctgggggtgtagcatccaggctggctgctgccagtgggaaggtgtcctggggctcccggcagggtctgggcagtgctggagctgggctttgcctgggaagctgccgcctggcccccacagcttccccaagaagggcctgagcccttgggggcagctggcgtctgtgaggatccgggatgggggctgtctgctcctgctgggaacggcccctccagatgcatctccctgtccctgacccagcctgtcagtccattttggttgcagccacccctccctgatggtgtgggggcttcgcttcctctgtttattcctcgcctgagggagcagaggtgaggggatgacactgccccgcctgagccccgagtccctgggccacgggaggtgggactgggtctggcctttggtgccacaggtggcactctctctgttgctgtttgcagactacgtctactttgagaactcctccagcaacccatacctgatccggagaatcgaggagctcaacaaggtactggggggccctggtgttgctgcaggggggtagtgggtgggggctacgccagctcctgccctgtgggtggccagtgtgggtggccccctttcggggctgatcttggactggccactgcacaggcccttcagtgactccgtccactgtcacctgcaccgtggctcctccttggagatactgagtgaggggcctggtggcctcatgcaggacccagcgcagctgccctgagctgcctgcccactctacacttggtctgtgggtgctgggtcccctgaagatgccagtgtcccctggggagcccgagcggaatggtgtgattctgaaaccaaccaaaggctgcagaaagccatactcggtgcccctgccctgcccgaaccctggcagccagccctgcagggctgtgagctctgcccccacccctgaggtgtctgcatggctggaagcaccctccctggtcactcaggcagccctgcagggctgtgagctctgccccc

SEQ ID NO: 78336 - DNA, 1087 bp, Homo sapiens
gacggacagagggcggctgcccctcgccctcctggcctgggctcttggcagccgccgactcccccgctcctcttgctcttgcctgctgcttctggggctggcccggaccttgttctccctcctccttccatcttcatgccctggggagtctgggcctttagggtgcctggacttaaagggcacgtgggcaccagagtgtctgcaggggtacctgccaaggagccgccgggccgccatagggtggggcagtgggacagtgtccggcagcaggaggaggcacgcctcccaggactgggcctcctgcgtgctggcgccaggtggggctggtggggtgggccttggtctggcagtgtgcgtctgccgcggtgctgacaggggctccttgtccttcaggggaaatagaagaggaaatggagaacccggaaatggtggacctgcccgagaaactaaagcaccagctgcggcatcgggagctgttcctctcccggcagctggagtctctgcccgccacgcacatcaggtagcccccagcagctcccgccctgggcccctcgggctgccctcgcctttccagcctgcccgtccttctcttccaggggcaagtgcagcgtcaccctgctcaacgagaccgagtcgctcaagtcctacctggagcgggaggtgaggcccagcccggcctggtctgccgcagccagtcccgggccactgtttcctctacctatgacctctgctggcctgggcggcggagacgattttccctcctccctctaggcccaggctgttctggggggaagcggggattgcgtcctgactgtcacttccaggtgtcctggtgtgtggccgcccccaccctacgcgtccagagttgtgggccaggagcttggagctctttcctcttgccactgccacccagacagccagcgaggggaggtccccctggggagggtgtggctgaggcaggtgggggcaggggccacctgagtcttcgcaggagtcttggctggtctctcctgggcggtgggcagagtcctggtaggcccaccttgggggtcactgtgattatacggtgttaccaggtgattcttat

SEQ ID NO: 78337 - DNA, 1291 bp, Homo sapiens
ggtccctggcacctggggagcggtgtgcgtgggggaagtccgtgctgcccatggcccctggtccctggcacctggggagctgtgtgcctgggggaagtccgtgctgcccatggcccctggtccctggcacctggggagtggtgtgcctgggggaagtccgtgctgcccatggcccctggtccctggcacctggggagtggtgtgccttgggggagtccgtgctgcccgtggccgctggtccctggcgcctggggagcggtgtgcctgtggggagtccctgcttggccgacactgtggtcagcgcatctcctttccccagctctgtgggcaccttcgcacgggccctggactgcagcagctccgtccgacagcccagcctgcacatgagcgccgcagctgcctcccgagacatcaccctggtaagtgggcccagggcgggacaggtgagacctggggtggcccatggcccagagtggctgcgcccttcttcctaccagggcccagcacctgccccaggtattcaggacccctgcagaggtgctgtcccacctggactggcctttcctatccaccccaaactcggccagactgtgctgagggtgcagggagggttgtgctgctgggcctgcagtaggggatccttgaggtactgagggagggggtaccgtgccacaggtgcaggaaaagccaccttggcccgggtgaccctgctgtctcctgccgcagttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttgtgagtaccgtgggtggcgatgggggagtggctggccatgcccatctccaggtaggctgcgggggtgtgggctccacatcccactctgccctgagggagcctgtcctgcaccctgattccctgtgcggagctgcatgagttctgtctcagctgcgctcggccgccatagtccttcctgtcacactggttcagcagacaggcatgggggcgctggtggggcctgggcatagagagccatgctcctgccaccattgcgtgatgaggataagggttggcccaggtgacggaggccagggtatcctcacggagactttcccttccttgctgccccctccagccccaggcttggttttgctttgtttttgactaagctgaa

SEQ ID NO: 78338 - DNA, 1548 bp, Homo sapiens
aggaggggaaggaagactcctgagtccctggcccggctgtcctctccgtggtgctctcctctccgtagcctccagcctgtctgcactgcagccccaacctgggcctagcctgctgacctctgaccttctcttttgttttaagaaacgcttgaaagcagctgaagctgagagcaagttaaagcaagtttatattcccaactagtaagtgtgccctcacagccgtcgtcctcgtggccccgggggccagggagggtgggcacagggtgctggggccaggcgggtcccaaggaaactcaagctcagaggctgggaaagttggggcagcccccgggagggcggcccagggctggggggttctggctgcagacgcagtggccatgtctctgtcgtcctggcctcctggtcagtaagggggcattgggattccagcccacaccgccagggttcagtccctgagctgggctccatgctagggggagcacgggggcctggagaacggctcagacctcagcagtggctcccaggaactgaaaggggagaaaggaagatccctgccgaggccgaggggtgcgaggacgtggttctggacaaggggtggtcagccgcggtgcctgctgggcacatgggccctcgaggtttgtgctcctgcaactcctctcgtctctcctttccctctttaagtaacaagccaaatccgaaccaaatcagcgtcaacaacgtcaaggccggtgtggtgaacggcacgggggcgccgggccagagccctggggctggccgggcctgcgagagctgttacagtaagtgccctggatggccgggggcacaccgcacgcccgcctgtgggccgtggtgcctgcgttggccctgagggctccagcatggcccagcctgcaaggggcccactgacgatgggggctgcgtcccaggggtgtggttgggagagcctcggggaacgtgtgggggtgcctggcgggtgggggcggccggcgtgggggtggcggggaatactctgacatcgctggttctgcttaagaatccgtctatttccaactttgttgtccgtagccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatggtaaggggggggacacccgccctgcctgccatgagcctgtcggccacgcgggtcctcggcccccggtcatggcgctgtgttggggcggttgcgcccccttccgcagagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgtgagtcaccccaacgccccgcttactctgttcct

SEQ ID NO: 78339 - DNA, 1116 bp, Homo sapiens
cccctgctgggcagaggcaactcgttctgcctgtgtcattcccggcagagacccacccccgcccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggtgagtggcccccccgcccggtgagtgtggccctccccgcccggtgagtccggcccgtccccgcccgggcacccgccgtgcgtgctgacgctgtcttctctccctctctcccaccccggcgctgccaggcaacatgaagaagcgcctcttgatgcccagtaggggtaaggcctggagccgcgggcgggcgctgcgccggccccgcccgtgatgcctgtgctgtgctgctctgtgtccccgcggcgggcggcccagggcccatgcttggggcagtccacgtgagccaggccacagcccagttccccacattcctcccgacatcactggtcccttggtgaagaccccccgagcccaggcatctggccctcggccccctggccccgcctcctgtcagtggactgtcctggcacgtgtggccctggcgcccctgcctgcgctgtctgccatcgcgctgtgactgcccgcatgctgccagcctcagctcgtggggccgcccgtgctgtgcctgcaatccttccgtgcgcctgccaggcgggacagtggggagggtggtcgggggtgtctgtgtgggccgtgggcaactgagcttgtacacatgggtgccttctgtcggaggactggctcaggtgctctgtgccggttgcttggagcaggggctgcgggaccccaggccccttggggaagagcagataggaccaagcctagcatgaggaggccaggtgtgtggggcccgggtgtgcaagtgctgggcctgccagtgtggatgtgcctggagccccttcgccaggcggctttcactgacggtgctggccagggcagcagggccggtttggcgacctggaggtggatatgggtagtggctgcccagcccagccaaccctgtccccttggggcattctctcgaggctgctgggt

SEQ ID NO: 78340 - DNA, 3487 bp, Homo sapiens
ctcctttcctggggcaccctcccagccatctggtattggggctgcccccattgcctagtcctgggcccagggccagcccactctgggctggctttacttgtctgttcctaatggcagggcgtcccaggaacagccccataagagctggtagaaacaggagggagtccttgtcagcaggcatcttcgagctttttgttttgttttgtaaaaagcggttaaccagcaagttacataaaagcttatttgttcccactgaattttccacacctcacacgtgagtcccagccatgcagtgcttgtgagggagcatcaccccttgccgcctggctgggcggggccctgggctcagaggggtcagccacagaggaagcgcctgtcctgacgtgtagcggccaggacctgggcgctggagaggggccagctgggtgaagacggctcccgggggcactggcgcacacgaggtggggtctctgtccagcctgggtaggcatgagctgagctcgagtgagggccctgcctgcccacagcacggggccccagcgctctaacccggccatttgcccgtgcagcctgttgcgctgtccccacctgcggggcctgcagatggctgcgtgtggctcactaacctaaagcatgtgtttcttccctctgctgtccaccgctctggtaggcacttacctgggtaagtagtttttgtgctactggccagccctgggcgctgggccttggcttgtggcaggtgccctgaggtatggctgttcctgcttgggagcgccgcagatcaggcacctgggcccccacctgaccctgcccggcagagctaagcaaactggcagggaaaggctgacccagggctccagggccccagttggcccccaggggagtgccccaagttaggaggcaactgcaggtggggaggggctggacaggctgcttctgttccttaagggatgggcctcagctaagcagcgtttctggagctggcaggttgctccgatgcccctgggccctggcacctgactgagttgagtatgacatcctgtcctctctgagctggtcctgctgggagccgagccatcctgggaccagctcccacatgcacacgcccacacctacacacagggcagtggggaagggcagtgagtgggggagggcagcggcggtcctgggcccagctgggggtgaccaggagcatggaccccgcttcttggcccaactcccgcagtgccccttgggctcctcaccctgcactgtgggaagtcagaggcctctggcaccccatccccaagcacatgccagggtggctggggcccagccagggcagtgggtggtgacctgtttctggccggggctggcggctctctcagagccttaggaaaaagcccggcctcctggtggggcagtgccggccacagcgtggctgccctgcagaggggcttgtgccgctgctggactgacagccttgcgaggctttgcttgtctcggcacggcaggcaagtgggtggacagccccggcccctgtgcagggaggtgactgtcgggtccaaggctcctggcctcctgcctggagcccaagccaatgtgtctcttgctggccagagagctgtggggccaccaggcggcccaggacccggggatgcgaggccccacgtcccccaggcccatcctgggtgtgggctgtggcttggttggcagatggccccggcccattgtcccaaggtggctgaggccgtggtgggcggtgggagtgcaggacgcgctctctcggggcctcatttctctcctccatttctcatcaggtctggcaaaccacggacaggccaggcacatggtaagaggaacaacccatgatggggtacggtgcgctcacccatgagctctctggggtgttgggaagaggcctggccagccctgccaggtgccacgtggaagcttccaggaggcctggcaagaccagaggggctgcagcatgtgggggccatggcccctgtgccaggcccagcggtgtgcggccgaccagccctcagggctgccctgggccaggctgggggtccgtgtaactcactggggtggtggggggttggccaggcacagcacctcccagcgggagccctgcaggttgaggtggagctggcccttggctggctgcccaggaagtgcaccccctctgcagggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggtggggccttcccagggcaggcgggagggctccgcacagcgtcccggccctcaccaccacctctgcccacaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaccggtccttccctgtgtcttttgttcccagtccctctccctgactcaggccctgggccccccacccccatcgggcggccctaggctgtggctctgccgtggagctggaggcccctggaggccacctcagccaggacagccaccccagcctctgggctctgttgctctcccacctgcccacagaccttcccctgctggggcctggcgcggtgccctctgccctccccagggggcagcaagcggttgcagggcccaacccccttccccagcagagctgtgctgaaaccgtctgtgcgtctgtgtctgcggcagcggtgggccggggactgcctcccggcaggcagagctggccctgccgaagaccctgtggcttcccaccagggcagccagtgcagctgggccagcgaggccttggagtgctccagc

SEQ ID NO: 78341 - DNA, 1024 bp, Homo sapiens
agctcccactccgggctccgctgagctgggctgggccaggtttggactctgtcgggattcagtccaagcgggggcgaccttggcctctgcctcctgcttgtcccgacgcattcccttggcgccagttcccccaggagtttcacacgggggtagggtgggggcgggtgtgacacgcgagttcccgcgaacgtgagagggaccttgtgctcaagcagcccaggtgtccaggatccctgcctcctcaaggtcagaacagccctggacaggatgcaggtggtggcgggaagagggatgtctcgcaaggcggccctcggtctagcccctccggcaggcgcgctccccccgtctgggcttactcactctctgggcctgggtgcgcccttcctacccccttcctcctggctgattcgctgcccagctttctccagggtggtaaggtccctgcccacctacccaccagctgctgcacgaaggggggcagacttagtgaagcagagaggagggccgggaccaacagggcgcctgccctggtcgccccatacccagaatgcggccaggctgcagggaaggccgccactgggcttccccggctcacaggctggagggggttgaggggaggttgtattttgcccgtcccagaggggagggaccggatttggcctggagtgcttctggcgtggctgggagccgaggggcttccggctgcctctcctggagcccgctcagccctcagtctctgtcccagcgagggctgtctctgtaaggcttagggtgggagacggtccccagggcccttctgcagtccaactgcccatgactttaccccaggccgggccaggccagcctggggctctccagggtctcggccaacagtcctgtggacagcccggaaaggcctgcctgcctggcccgcccagcctctcagcggaaaacaaaggcgcttcagacccggctggcttctgtcctgcctgggaggcactgtgagggcgagggtccagaatcctgcccaccctcacaccaggct

SEQ ID NO: 78342 - DNA, 1339 bp, Homo sapiens
ctccccctttccagctgagaaggtgacgtctctgggcaaggattggcaccggccctgcctgcgctgcgagcgctgcgggaagacactgacccccggcgggcacgcggaggtgaggggagtgcaacggggcttgggggccgggcaggggcgcggggtcggggggatgagggtgagaggcgcgcctagaggggatggggggtggtgcttctgggagctgcgctgccctctcccccacggcgagccggcctgcacgttctggaagcctccaggtgatgggtcgggggagtctgtggactcctccctcagcacccaccttctgccccagcacgacggccagccctactgccacaagccctgctatggaatcctcttcggacccaagggtgagtgtagccagggtggtccacgatgtcttccctgccctccccttccctccactgttcccccgacccaccccagcggcctccctccacaggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaggattgtctctgcttgtgggatggatgcaaatcccagaccagggtccctttctccggtccatgcgtgctcccagccaacacccctgggcctggctgctagtgggggtgggctcttctcctgggggtcatagtgggaggtggggccctgggatgtttctgagcaggagggagggatgggggcggggagcgtggtctccggtttgggtggtggtgcccacccagatggggaggcagtaagaacgccaggctgtggggaggtaaggaaggtgggaggcattccggggcca

SEQ ID NO: 78343 - DNA, 1070 bp, Homo sapiens
ccgtgtttgtttccaagtcattgtcatggaaaccggggcggttgttgctactgtttgtctggactgcgtcgctaggcggtgttgctggggttggctgggtgcccacggcactaacagggctcgcttggtgtctccagctccaggaagctatgccctcccagccgcctgccagccaggtgctcccttgggtgcccacagacccagatatcccctaaaagggaggggaatctggaatgggctcttctgcctttgggcgtgcctgcttctctgtccctgccttgggggctgctctgccctcaaccttcactctcttctacttggacctatgcctggccagtgaggcggctctgaaatgctatctgctccatccctccccttcagaacccctgggaaccaagtccagggatccacaaggccctggtgccccatggggctaagctcacaccccggcgctctgttgaaccgagctgtgccgctccccgtctgtacccccactgtccagtcttcccgtgtctcctggccaggtccctccaaggtatcccccactccaacctgggctggtggggccctcactggtgcccccagccaggcatctttgtggggccagctcagcctgcagctacccctgtctccacttcttctggcccctgcccgggacccccagcacccttcctccaggccctgcccagccagtgaccgcagcatcggccctgggtacccctgctcccagggtcttccctaattcctggaccccttcggactccacacagctgggactagcgcccctgaccctgaccctccacaggacttggtggggcacacctccctcccggccctgggtccagcttattgggggccggcggtagcctgagaggtggatgtgaggaaatcacccagtgccgtgggcccctagctctggaccgtggagggctgggcacaggcaagggcaggctggaggaccaggacggccaggtatgggcagcacttttcccagcgcctgatgggcttccggtggggatgtggggtccagctgccaggcggggaggctggaattccagcctctggaattc

SEQ ID NO: 78344 - DNA, 1925 bp, Homo sapiens
tgctttgcatctctttgcattttagtgatgtttggtccagtcctggcccgggcagatctggggttcgggcgggtgccggtggggtagggctgggggtgggagcggcgtttcctgctgcgggtgagccttttgcctcggaactggacccgggagacatcacagcgctgggctaggggcgcggcttgaactcgcctaaagagctgcgccctctcagtaagtccccatggccccctgcccccccgcgctccgtcctcagtcaggcccgggtcctgcctgaaggcgggggtggaccagatgatctttcttgggccctgggcctagattcgaggtccccagggtccaagtcctgggttcagagggcggggcgcgaggggcggggtctccaaggggcggggtcccggggtccctgaaaggcgcggaccaggccggatccacccagtctcgcgcctgcagcccgtgccgccccagccgctgccgcctgcaccggacccggagccgtcatgcccaagtgtcccaagtgcaacaaggaggtgtacttcggtgagcgcgcccacaccggccccgcgaggaggcgccgccgacggggcgacgaggctggggaccgctcaggaggaccgggggcgctgggtccctggggcggcgccccagcctgaaaacgcctcagcctggcccgccgcctgccccgggatgagggtggaggcccctgcgtccgagggccctggcgatctctgcctgctagtggtcttgctgtgctcggcgggctacctctggctctgagcctccccgtctctgggtcctacggtctctgccgtttcctctcaggcgcgccctgagtgggggacccgcagggctggaaggaacgcggggctggggccgcgccccccagcgctaagtggaaacagacgcggaaaccgacgcccggggcgcgatcccgggcgcccgcctccctgccccgcgcccgcgcgccccgaggggagggaggaagtgggaagtcacccctgtccccgccgagaagggctgtcgcaggctccacccttgccaccgcagaggcccggggctgaaagcaggcagccaggcccaggccctgctgacctaagccgcgacccctgaccctcggcctcgccctctagccccacccagccttcaggagcaagattcccggccgcacccgaaagtgccccggggaccagcgaccccgcgctttgtttagttgtattggctctggggattggagatgttcccctcatggagggtgctgagaccttagggtgggctgccaggctgggcggatgcgggctaagtgcacagggccttgggcagagctggctgcaagaggcgggtacgccagtggtgggtaggcgccgcgtcctgcagcgtctcaccggggcctgtctgtgcctctgcagccgagagggtgacctctctgggcaaggactggcatcggccctgcctgaagtgcgagaaatgtgggaagacgctgacctctgggggccacgctgaggtaggtgggacccaccctggtggcaggggccaggggtgatggcaccccctcacggcccttctctttgcagcacgaaggcaaaccctactgcaaccacccctgctacgcagccatgtttgggcctaaaggtatgctcccgtcatccccaccccaccccaccccacagcctcctccaccccagcctgttgactttttccaccttctctgcaggctttgggcggggcggagccgagagccacactttcaagtaaaccaggtaggtaggaccccaccccctatcctgcctcctggttccaccctcgggatggggatgccccctcccagggaggcctgaccactcgtgggccccaaaggaggccgtggacgctgcactcacgtctgtgcctgtctctctctgcacaggtggtggagaccccatccttgg

SEQ ID NO: 78345 - DNA, 1051 bp, Homo sapiens
ccaccagcgcgggactccttggagacccccccatcccacccttgcagagggtctgttgctcagctggcctttccagggacctctcaccccgtcgggcctggccttggcaccagctgctccgcttacttatgtgcctacctgtgaccctctgtgccaccttccagcctcccttttttggggagccttccccatttccctagatccaagcagtcgttcatgtccccactgtgagcctggctgaactgctgtgcctgtccagaggctgttcctcccccgatgctgctggggaagccagggcaccccactccaatcttgctgctgcttggaagctgggcggggtggggaggccatcagtgaaattgcctggcgcccccttgcaggagaccccagcggtgctgatggttgttctgcacccagcccagccccgccaacctcaggcaaggagtggctttctctgagccctctttcctcatctgggaggtgggctctgatggccgacctccctggactcatggagactcagcgttgggggaggtgcttgactgccactcagcctggggtctgcactacctgttttagatccacctgtacacacgcggctgccacagcgaccagagccttagccatctgtctgtcactgaagcagagatgctcagggacccagagggaggccagcaggtgagggcgggcaagctgctgcgggggggtgggggtgggctggggggcacagcagggggactgcccagggtgggaggggcctgggggcggggcagctcttgggcctccagcggtgggtgtctctgcatgtctgccactgatcattgccagcctgggtgacagacagcttctctgggcctctcctagcctcatgggccactcacccttcccttccacaaatcaagacgtggcacgggtgggggcccaggacgcaggagcctgggctgggcaggcagctggctaagggcaggctgttggaataaaggaacacagatctcaggtgtgagctggtggtgttggcatctcaagcaggtctcacttggtgtgtcagggg

SEQ ID NO: 78346 - DNA, 1093 bp, Homo sapiens
tcaagcgattttcctatctcaacctcctgagtagctgggactacaggcacctgtcaccacgtccggctaatttttttgtatttttagtagagacggggttttgccacgttggccaggctggtctcgaactcctgacctctggtgatccacctgcctcgacctcccagagtgctgggattacaggcgtgagccaaccacttgggctgggctctgtactgtcctgagtgacgggctggcactgtcctgctccaggtgcatatggccgggcaggagggcagaggctcagggctggtgtgacctcttcttccagacccagtcccccttctctgcctcttccctctccaatcccagagacttggcccctgtacctcatcccaggcctgcccagggggacctaggggtcagaggcggatggcctggctcctggcccctagtcttgtgtctgctggggcttcctgctcgtagcaagggcctgtgggttccagctctgcagcccaagcctgggggattgcatgcctcactcatgggcttacagggcccaacccctgacgcctgcctggcccctggtgccagctggacctgtgtccctggctgaagccgggctggcgcccacccagtcagcctgcactggcgttggcagtgctgaggcagcatccgggcgtcctggtctgcccttgtccctacctgccttgtagaggcggctcagcgaagcccaggcttctggcccctgggacccctgggttggggcagaggagaggctgccctggccccaggctgctcctgcccagtgcctctgtgggaccaccctctgtggtgggctgggggggcctggaagtgaggccccgccctctccccgaagctgtgtgcggcactggccaggtggactggggccatggctggcttccttccaaggtttctggagcgggagctgcccaaaacctggacctggcctacccaaagtgcctgcactccttctgcactcctgggatgggtcccagaaccttctggaatgatctgtggctggtatgtgagcagccaggtctgctgccgggtgactgggcagcacccttggatcctggtggggcctcagcct

SEQ ID NO: 78347 - DNA, 1022 bp, Homo sapiens
gtggatggtgaggaagcccgcgcatccctctcccggcatcccttcccacagcagcccccaggtggggcattcgggatcttcctgttttccagacaggaagaggggcttttagggaggccacagacctagtgtaggctctttctaggacttccactcgccttctggggaggctcactgctgcccccgccctcagctccatggccttctagagtgtggcctttgtgcctccctggacgtcacagttgctgagatggtggcatccagcccgctgtgggacctgggggactaccactgccctctttgccctctgtccctctgtccccttggcttggtgcacgctgtctcacttgggtctctgtaggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggtgagtgccagcctcgctctgggcaccagcccagccccaccttcgggggatggctgacctgagggcactttggacttgctgaatcctacagttgcatttgtcaagcatggcaggggacacacttagaggcacgtaccctgagggagcgggagggcacctggtgaggagccgcagctgctgcgagacagcccccgcccctcctgcgggaggtctgttgtctgattctttgcatgagggagggaagcccgtgctgtgtgggccctgctgctcccatgcgtccgccacacatgcatcacacggtagtagtcactcctccacacctgcctgggacccgtctaacctcctggtggccacctgggcctccaccctagactcagagctgcccgcttaacctgcgcaggttcatggctgtgaacacggggctgtgttggctccatctattttctttttctgaagagttttaacttaaattgcaggcatg

SEQ ID NO: 78348 - DNA, 1243 bp, Homo sapiens
acgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgccgctggccctccccctgccaccctgtcgggtttccctgtttgggggtgggagcgtggaggagcccctgggcagtggtggccagtgtagggctggccaggtgctggaggacatgcataccccagcactggtgagtggcaggaccacggggaggtggcacaggcctccctggagcgggattatctcggccccgccccccttcatttgggctcccgctgtgggcctggccctgggctgtgagcacagctgcccccacctccggccaaggctgtgcctggtgggtgcgccggatgggagcccggggctctgctccttcccgggaggtggtgctccgggtggggaggcacagcatggacagaggggctttgttccagaggctgctcagcaagctcagctcatccctgacaaagagccatctgtgtccgggggacgtgcctcagcctggcggaaggagggtcggcctcatggcaccccccccgccccccaccagcagacacaggtggccctgaggcctccagccctgcctgccttgccgggctcccctctcttctggggctgtcggactctgacctgaggtgggcagacgatggggcttgtggggccacctccaggctcctgccggccctgccccgaggccacgtccattccccctgccagaacatgctctcactggggcatgtgcctgagtgacagcacacacctggggctccagctccagtctcagcctgtctgggcctccttggtcccaggggtggacacgcctagaccgcctgccttcccattccggtgcatgggacccaggagcaccggcaagacctggccgtggccagcaaggcctccctttcaggagcacctctctgaccctctcatgcagctgggcctcctgtgggccaccaggatttgtgcaaatgctccctggcctgcgccaccctccggcccctccgccagctcctcctaagggctcctgccacct

SEQ ID NO: 78349 - DNA, 1027 bp, Homo sapiens
tgtctctttgtatctctgtctctctgtgtgtatctttctatctctgtctctctatatgtctctctatctctgtctctctgtatctctatctctctgtgtgtatctttctatctctgtctctctttcttgatctctctctatctctgtctctgtaactctctttatctcttactgcttctgtttctctcactctgtctctgtctctctttatctctgtcttgctctctctctctgtaactttatctctgtctctctgtttctatctctgtttttctctgtctctgtctgtatctctgtctctctttatctgtctctctgtctctgtgtatctctgtctctctgtaactttatctctgtctttttctgtctctgtgtgtgtctgtctctgtgtctttgtttttctctctgtctctgtcaatgtctctttctgtatctgtttctttctctctgtctctgtctctctatctctgtctctatctctctgtctctctgtaactcctcatctctgtctctgtgtctgcatgtctctttctgtgtctctgtttctctctctgtctctgtctctctgtgactctgtctctgtctctgtctctgtctttctctgttactctgtctctctctctgtctctctgtgactctatctgttactctgtctctgtctctgtctctctctgtctctctttctctgttactctgtctgtgtctctgtgtctctctctcgtctgtctttctctgttactctgtctctgtctctgtgtctctgtctctctgcactgttttcctggtgaaggagaagccatgtaccttcctgcatgatctgtgctcagctcacaaccaccccatgattgaggacacccctccttctagaaggttcccagctaacaggtgcagaaggagtgaagattgaaataggagaccccatcttgagaccctcccggaacagtgcccctgggccgtgtccccacttcgggacgtgggatctcggtgccaggcgtgcgctgcctgaccccgatcccgtcggcgtgtg

SEQ ID NO: 78350 - DNA, 1365 bp, Homo sapiens
ggggctggcgtcaggggcatgtgaaagctgagacgttggtgaaagggtacagagttttggttagatagaaggaattcgtttgaagatctattgcacagcatggtgacttccatgatactaatgtactatatacttgaaaactgataagagagtagattttacacgtttacaccataaaaaataagtatgtgaggtgatggacatgtttatttacttgatttaataatttcacaatgcccgcatatgtcaaaacatcacgtcatatccccataatatatgaaatagaatatgtttttctagtaagtgtgatgcctctgtttctttttctttcttttttttttttgggaacaaaacaataaacacctttattacatgggtgaagacaaaacaaggatttatttgcctttctgggccttgattttcctaagatagaactccaactctttgccctctagcacatagccatctgctcggccacactgtcccggccttgaagccatgcacgcaagaagcttgccctgctggaactgctcccccaggagactgctcattttggcattcttcttcctttcatcatatttcttctgaatttttttagatcgttttttgtttaaaatctcttcttcctcaggagtcagcttggctcccttcttgcggcccaggggcagtgcacagtgggactcgtaccactgtcggtagggcgtgctgtcgatgggcacgatgcaattcttcaccacggtcttggtacgaaccagctcgttattggatgcattgtagacaacatcgatgacccttgtttcaccagcgcagcattctgagccccaggagaaattccccacgtccagcctcggggcacagtatttcttgttacctcctcgcacacggactgtgtggatgcggcacgggtcagtcttgctgttggcagctgggcgccccaactcatacttccgcttcttgtggcagggccttctcttgcccccagctttgcggcccttgtgccagttgtcccgagaggtgcccatcgctcggcgctggctggaaagagggcctctgtttctttaacaatactttctggagattgtttttcccttgagcaatgtttcctctctgctgtatttacacagttttcctttcccatgggttgatttaagacagtgacaatttatttattctatgtctggtaatttcactgagaaacttaatgaatagccacttgaaaccatctggtgccactgagaaaccatctgaaggacacagattttctgagtgtaggccacaaccatattttaacactttttaaattcaaaatcggggtttaaattttgatattttactatggcttctttgattccctcccaagatcta

SEQ ID NO: 78351 - DNA, 1039 bp, Homo sapiens
tggctgatatggaggctgagctacatgtagaaagccaaaggaatttctgcaggacatcatcatgccaagcacagcagtaaactgagtcccagcccttttcacacgctcaatggttagatcttgggaaggaatcaaagaagccattgtaaaatatcaaaatttaaaccctgattttgaatttaaaatgtgttaacatatggttgtggcctacactcagaaaatctgtctccttcagatggtgtctcagtagcaccacatggtttcaagtggctattcattaaatttctccatgaaactaccagatacagaatagataaattgtcactgtcttaaatcaacccttgggaaaggaaaactgtgtaaagacagcagagaggaaacattgttcaagggaaaaacaatctccagaaactgttgttaaagaaacagaggccctctttccagccagtgccgagcgatggacatctcttgggacaactggcacaagtgccacaaaaccagggacaagagaaagccctaccacaagaagcggaagtatgagttggggcacccagctgccaacaccaagactggcccccgccgcatccacacagtccgtgtgtggggaggtaacaagaaatactgtgccctgaggctggacgtgaggaatttctcctggggctcagaatgttgtgctcataaaacaacgatcatcgatgttgtctacaatgcatctaataacgagctggttcgtcccaagaccctggtgaagaattgcattgtgctcattgacagcacactgtaccgacagtggtacgagtcccactatgcgccgcccctgggctgcaagaagggagccaagctgactcctgaggaagaagagattttgaacaaaaagcgatctaaaaaaattcagaagaaatatcatgaaaggaaaaagaatgccaaaatcagcagtctcctgggggagcagttccagcagggcaagcttcttgcatgcattgcttcaaggccaggacagtgtggctgagcagatgggtatgtgctagagggcaaagag

SEQ ID NO: 78352 - DNA, 1039 bp, Homo sapiens; identical to SEQ ID NO: 78351

SEQ ID NO: 78353 - DNA, 1039 bp, Homo sapiens; identical to SEQ ID NO: 78351

SEQ ID NO: 78354 - DNA, 1012 bp, Homo sapiens
cccagcactttaggaggccgaggtgggtggatcacgaggtcaggagatcgagactatcctggctaacacggtgaaacccggtctctactaaaagtacaaaaaattagccgggcgtggtggcaggcgcctgtagtcccagctacttgggaggctgaggcaggagaatggcgcgaacccaggaggcggagcttgcactgagcaagctcacttttctctaactgaaaagtagcatctccttctattatgaatgaaggcagcaaaccatagcagtattagcctacctatgactttatcaccagtagaaatcgcatactgttttcacatcagagttgtagatatttgtaaatgttgtttactgttactttaatggtagttaattggacctactgctaaatcttgttatttaatactttcataaataacatttcttgccatatcttaaacttctttaaatatttgacaactgtatctcagtataatgggattcctttgtatttattttttggctttaaaaatgttattcagagaaggggtccttaggcttcaccgggcctcactatggcataaaaaggttgggaccacctgatgtagaatgtgttcagctggacttaggtacaggggcttatgggaagacagaggagccagaggacaaggttgggagggtcaggaagaacctgtgtgctggagaaaggatgcttgcacagtctcggacacggtgattatttgcctgcctgatggtggaggtaacggaggacaaggtacactccattctggaaatgtgtagctgagtacagagcatatgggggatatggagggccatgagatgagttcacttacctgtgtgacagagttggcataagaattgcattttgtctttaatagatttcatcgtttcttggatgtcaacagccacaaaatagaaaaaacaatcgaagggtaagtcagtgtgtatatatacgcatccagaaatatatgtattttcttatagatctttttaagatagctttataat

SEQ ID NO: 78355 - DNA, 1174 bp, Homo sapiens
tactgtcatgaatatttttctagacttaaagtacactcgtctttttttaatctcatttcaggttactttcaggagtgaaaaagctctttatatttcagttgatagatgggaaggtaactgtgagaaacaatattatagtaactcatttaacacatgtaagttatttgtatttatggtaatttaagaaataggatttatgtaaactagtaatataattttagaacattttacaatattaaaattgctattgaactcgttcttgcttcctcacatgcaaaaaaaagctaacttaaaaatatttaatatccaaaaagaaaaattgagttgtgcatctttatagtacgtagaggattccttaatattgtttggaacatatttaatttcaatttgcattttctgctttttatttgtcattctgtattgtgaaagttatatactgtaattttgttttgctttaagtacatttacttatgtatgtttttaaaaatataagccataattctctagtctgttgaaattattgttcactttttcctttgtgtataaaattataaatattaatcatattattactttgtcttctactaaacatactgtttaaaacaattgcaaaagaagtattttacagcgagagggaaatgaatttgaatgtttacagaagaccacctttgaataattgcagtttgcttgtgttgtagagctgtttacgatctgtgctggaacaaatagcagcatatggccaggttgtgtttcgactccaggagttcattgatgaagtcatgggacacagttctgagagcatgctgcctggaagtgggtctgttcctaagaagtcaactgaagctccctttagaacctaccaggctttcatgtgggccctgtacaaatatttcattagtttcaaagaggaacttgcagaaattgagaagtgcatcatcaataatggtattaaatgttcttcatctttactcatactacacgtaactcataatttgaatgccacttagagtttttattatataagatttgaaagttgcctagcagataagtagttctcgtgaatgcttcttttaaaattattttaaatttatatttttaagccattcatatctctaaaaatcaaaaaactacagaagatttagaatgaaaaatctaaattattcttcctgcacca

SEQ ID NO: 78356 - DNA, 1046 bp, Homo sapiens
catggtttcaccagtgtcgcaggaacttgctttgaacaggggtgggtgtggtatattcatgtatagtttatcacatgtctagctccacatagccacttccatgttcagatcacagctgtgccatcgcctcccaggagcttgcttgtgcagccctttgtaggcacagcctccctcacccctctctgtaacattagcccattgggaggtgttttgttttacctagtgtaattttaatttgcgttcttttattataagtaaggtcaagtgactttctgtatgttttagaatcactcatcattccttttttatgaactgtcagttcctttatacattatttttctgctgagttgtctttttctctgtgacttgcaggagttcttccttagggaaattaggtccttgtggtatgagattaaaatccaccgtcctccattttgccctgcctgtccataagcctgatgatttgccagcatttatgtcacattttagatgcatgtatttttccttgctgttgagtttgatttattgatatttgcagatactacaataactcttgcaatagtggtggacaagttggcacctcgattgtctcagctcaaggttctgcacaaagtgtttagtactggagtagcagaagttccacctgatactcgaaatgtcgtccgggcctctcacctgcttaacaccctgtacaaggccattcttgaatatgacaatgttggagaagcctctgagcaaaccgtaagtgagacttctgcctaaagtgtgtgactccatgctgcacagcagaggagtgatagacagctgatggtagttctttgttgatacttgaatgatgactcgtcagacagttcagagtttttaaattaacttccaaatttaaggctgtaggaaactggcttttcagctctaattgccaagatcctcagaaggatgaggcaaggacaaggcaagctgtgagaagtacctacctgatgtgtatagatatttacaataacgctttcttacataaacactaacatgtaactaacatgacatgagatagc

SEQ ID NO: 78357 - DNA, 1232 bp, Homo sapiens
gtctctactaaaaatacaaaaaattcgccgggcgtggtgccgggcgcctgtagtcccagttactctggaggctggggcaggagaatggcgtgaacccaggaggcagagcttgcagtgagctgagatcgggccactgcactccagcctgggcgacagagcaagactccatctcaaaaaaaaaaaaattatggcaattaaaaagcaggagatataatacggtaggaactaggttttcttaacacatagaagagaagacaggaaagaaacattccagatattaaatattaatgatggaaatccaccataaatgatgggatttggatttttttttgttacatttttgtgactgcccaattttctataatgttatagaagataacctttctgatgatgaaaggaaaacctatgctgtttttattattggaacaagtttaagaggtgttaatatttctaattttagtaaatgtagaatgtaaacttgttccactaaaaacaggttacaaaacctgttgttgatccagaatcctgccttacgaatgccagagatcttagtgtcactcattttctctccattcaggttggtagaatacttgcaagctatgaggaattttttcttaatggaaggaggagataccatgtatgacttctacacgtcaatttttgataaaataagagaaaaggaaacatggcagaatgtgtcttttcttaatgtccaactccaagaagcagtaggacagcgttatcctgaagatagttcacggtaaaatatggacgccacctttatttaaattagtgtaacatgaactatgtgccagtaagtcttctatgaattacacatattattttatcctcactattcctatgagttttactaatattattttacttattagaaaatggaggccaggcacggtggctcacacctgtaatgccagcactttgggaggcagaggcggtggatcacctgaggtcaggagttcgagaccagcctggccaacatggtgaaactctgtctctactaaaaatacaaaaagcatggtggcaggcgcctgtaatcctggctatttgggaggctgaagcaggagaatcgcttgaacctgggaggcagaggttgcagtgagccaagatcatgccactgcactccagcctgggcgacaagaacgagactccatttaaaaaaaaagaaaaaattgaggcagaggctagctatgtgactctcctgctaaacaaca

SEQ ID NO: 78358 - DNA, 1022 bp, Homo sapiens
aaaaaagttgccaccatacgacctgtcagggtctgatggcctccttcacatggctggagtcagtgcttcctctccctgagctcccacacatgaggtttttcagtcctgcctcctagagaatgcccctgacctctcagaactggctcagaactccccaatgacctctgtgtctctcagcctcactcccttccaccaaaacggacttgaccctcaccagggtgacctcagaccaccagcagtgacttccaccactcatccctatgctccccgtgggtgcctcctaaacagatggactaagctttgtcttagaagggagaaagctatttactgtctggctccattttcccagcctcatgtcttgcacacatacacaccatgttctctttcctgtcttccttcgcgtttcagggatttcagaatatttctggtgtctgctagtgctgtcctcccgcccccctgtgacatagtctccagttcatgggcccggcagaggtctgctcattcctacatcccccttgtcttcgtgtgctgcactgggctgggagtccctggagggaagagagattggctttctattgcctgctcagtgcagcacctaacttagtattagtatttggtagatgcctactaagcactgagtgaatgcatacatatcaggccattaagagctaaaaattcttttttttgagacagagtcttgctctgtcacccaggctggagtgcagtggcacaatctcgactcactgcaagctccgcctcccgggttcatgccattttcctgcctcagcctcccgagttgctgggactacaggcgcccagctaattttttgtatttttatagagacggggtttcactgggttagccaggatggtctcgatctcctgacctcgtgatcctcgaggatgccaaagtgctgggattacaggtgtgagccaccgcacccggcaaagagctaaaaattctgactagtgcctgtgtcatggatcagccagttcataatcacacactgccctgtgacatc

SEQ ID NO: 78359 - DNA, 1109 bp, Homo sapiens
tttattcttcccacagtggaatctctagcgttgtcactcatggctggcatggaacaaagttaaatgtcttcagcgtaataaatatctccgactttgtcatcatacatgtacatttccaccatgtgcagctgaaaagtgaaaatatttttattttggtttatttgtaaaacttgtccacagtcagcctggcacagtcgctcatgcctctaatcccagcacgatgggaggccaagacaggcagatcacttgagcccaggagtttgaggccagcctgggcaacatggtgaaacccggtgtctaccaaaaatacaaaatgtatccagacatggtggtgtgtacctgtagtcccagctactcaggaggcaaagatgggaggattacttgagcccaggaggtcaaggctacagtgagccatgattgcactactgcagtgcaacctgggtgacagagtgagaccctgactcagaaagaaccacttgcccacagtccagacagatggattgtaggtgggttttctggagattagtagatactgtatagagttgtatacataaaattgtgtcagtagtacaaagtgtatataggctgtttactcttacatttcctactgtaagatacagatttatggtactgatacctttaaattatatcatattttgaaaatgtaattactgatattcaaaataaattaaaggacttaaaatcattttattatccttttgctgctgtcctacagtcacagaagctttttatatagagttttacatgttgtcttccctaaaagttgtcttagatgtagctgtcctagaaatgtttatattttggctgggtgtagtttctcaagcttgtaatcctggcactttgaaagactgaggtgagaggattccttgaggccagcagtttaagacctgcctaggcaacatatgagaccccatctctccaaaaacaacttaaaaattagccaagggctgggcacggtggctcacccctgtaatcccagcactttgggaggccgaggtgggcggatcatctgaggtcaggagttcaagaccagcctggccaatgtggtgaaaccccgtctctactaaaaatacaaaaaaattagccag

SEQ ID NO: 78360 - DNA, 1052 bp, Homo sapiens
gcgggaaacgctgtcttcttccctttgtgccttttaaacatgcactggattcgggtgaaagatgaaggaatggccgtcgtcgaggagcactccttaattgtttatgctgtctgtgtgttgcccaggtgcacacaggtgggaaagaaacagcccctcccaccagcctgatccctacccaacccaggcatctgccaggtgggctgatggagcttccccgagctcatctgtgtgcctggtagcccagccctgggctgaggtgcatgttctcattgtcctgagggccccacctggggcagtgggactggtggatggcacagcgggtcctccatggcccaggggtgtgggagatggagggaggcccttgggtgttctatgagcgattgagactttattctgtggaatactgggccccatctctgccttttattaattattttagcatccgaatagtttttttcatacaaatttgacagataaagacagaactgctctcccttgccctcctggggcactctggggtttcatggcgcatggtttgaaaaccacagctgtaggcagagagagccagtgaaagcgtgagcaggagagtgacaggaagagaagcagaggtgagtgcaggtttggcggtgcctgggggatcagagggaagcctgggggagggcgatgttaggaggttgtgagaccacttggtcttgggagacccctcccagaggcagcctgaccctggccgaaggggctgcagccccaaggtggggggcggaggccatgtggcgtggagacgtgctctctttcagggttccttggcacactgttttagatgtcagcacctcattgtgattttcaaacttgatttctgtttctctgttgatgaggctgttcttttgagctggttttgagtggccgcttttgaggatggaatttgaagtttttgtgcattaaagaaagcagattacctcacacctgtaatcccagcacttggagaggccgaggcaggcagatcacctgaggtcaggagttcaaaaccagcctgaccaacatggtgaaaccccgtc

SEQ ID NO: 78361 - DNA, 1068 bp, Homo sapiens
tagccaggctggtctcaaactcctgacctcaagcctcggtctcccaaagtgctgggattagagaagtgagccactgtgcccagccccaaatcacatttaaaaaaaattctgttgattcactgttctttgttttgaagcatgtgatgattgtgaggttttacaaaaatcaccctcccatctcctgggatgtctgctgtgtggagaagtgaggtccagggtctctctgggaactgggttccccaagggcagcatggggaggcactggctgatgccctgagcccgtgagcttgcagggggagtgtggcgagggctggccacatctagatgggttaaagaccaggagcctgggcggatctgcccgttttctagttggtggaagcactggtgcatgcctcctttgcctttgccccttggcctgctgtctccaactttctccagcatcttcagggctctgctggggccagcagggtccttgaccctgctcccctgcctccccagcccctgctgcctgcccacgccggggcaactctgtctgtggctccagctccatgctgcctctgtcctgcccctcaggcctaaatcggtctccagcacctcactcgcacttggaaagtggccatctgtacctctgtgcctctggccttgaccccctgggtgggcacccggcactgggtcagggcggttctcaaccttgctctgtggctgtgggccctggggcagctggcgaccccatccagcctccctccactcatttgccaatgtgtcagggtggcctccaccttaaggcagctgtgaggaccacttcttgagactgcatctgtgtggatctgaggctgaggggcagccagtgacatgtggaagaaaggaggtggacccatggagcccccagcatgccctgtaggcactgcccttcaagtgggtggcactgggaacctttgcctcctgcccaccgtgggtcccttgaagcccatctggggttccacgatccagcaggtgagtgaggtgtgcagcatgatgtgagctcagacacggagccagtctgccaccgcccggtggatgttgctcact

SEQ ID NO: 78362 - DNA, 1145 bp, Homo sapiens
caagcctttgacagtctaaagttcctcatgccctttcggaatcaacgctccttttgtggttcacttctcttctctgagagtgattttatgtttccttcatggagcctgctttctgtcagtttcaagtacaatgctttgactttttgccagtttgtactttttttttttttttttttttttgagacagagtcttgctttgtcgccctggctagagtgcaatggcatgatctcggctcactgcaacctctgcctcccaggttcaagcgattctcctgcctcagcttcctgagtagctgggattacaggtgcccgccaccacgcccagctaatttttgtatttttagtggagacagggtttcaccatgttggccaagctggttttgaactcctgacctcagatgatctgcccatcttggcctcccaaaatgctgagattacaggtgtgagccaccacgcctggccaatttgtacttttgttttcgtctgctctttcaggtattttcttgctgttagcctcaccctgactgtccattcctggtggtcctcgccctggccttggttaggcaagaagtagccacatggaaggggcttgctgctttttaaagaagtattttggaaacatccagattttttatgatgatgtccttcagcaaagggaggagatggaactaactgggagatgaatttttgttttaccttgaaagttaccaagaggaaaaaaatctctcccagttttcacttctgaaagttagaacatctgaattttacaggcgttttattggagcattttgctcagtaattttgctggaataatcagcaagattttgttactttagtgatgtagttggtaaagtgcaagtcaagtaatgatggtgcagagcaggcagtgggagctgctttcaggaaggggtctggttgcccacattgtaaacacttcggcctggagcctcactgggcagatcgtttctcatcgaggagcagtgactgcaggtgcttgaaggagggacatgggcttggctcctcactgacctgcagctttctgccctcctgcttcctctgcacagagaaatgccattgagcgtttctgcggggaagtgaggcgcctgtgccatgccgagaggaggaaggacttcgtgtcagaagcc

SEQ ID NO: 78363 - DNA, 1937 bp, Homo sapiens
gctgccgagtgtctagggagtctgaggaccccgggacaaggtgcatttatcccaggctcgcggtgcctgtggttcatgcatggtgccttatgggggtctctgcacggtggagccctgttggtgatgaggctgtgttccaaaccagtcgagagacatggccaggctctggtcatgtgggtgacttcacattcctgttggttactggggacagccagctgcgggcaggcggggcccagctctgctccgtgcggaggctgtgttctgccctctccctgcccacagcatgactcagagccacctcactgctgccctgggctaacagatgcgaactggagctcagggcagtcttctgggggtagtaatactctccagaaggcagactcctttttaactttcctgttgagctggtccattaccacatccctccatggcccccagagtaatttgtattttcatgggggctgttctgagagccttgtagttgggtgaggagatggtgtgattgtgaggctggaggtctcggcctctgggccttgctgatcacttggtggggtgttcagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcaggttctcgtcccttgagccccgcctgcaccctctccctggggggacccaccctgagctgtgagcgggtggggctggtgaggcccgggttaaatgaggtcctcgctgcctgctcaggcagagaaagtggcgcctgtggtttctgctgctcctctgtttcccacccaagtgagttgggagcgtgaggagacgtgccttgattgtcagatgtgtcatgtgcactaaaaaggagtctgactccatttcaactcccatcccaaaaatgtgggcacaagtccacgtgtctgtattcattctgtgtttcttgatgggtgtttgaatgtctgtataatttttacgttgggtctgcaaatgactgtagatggggcgtgggaaactgtgaggtgctgcttgcgtgtgtcatggtcctaagctgcccactgtcctctctcctggtgtgttcaggcctccccgaggtgcttctcacgactttcacacccggtttaatccacaccgctgcgtctgtcctccgtcctggggctggtcttctccctcatctctgccggaggcttttaatctcttctgccactcttctggaaagtcaccagcaatgcacgctgctggctctgcaggagggtcagggggacggccctcggcctgtgcgtggtgccagccaccctccctgcctccctctgcgtgcgtcccgtgtccctgcctggggtgtgtgtgtcgagtgactaacgtctctctcctgcctctccctcctgtctgtccgtgtctagctctacctggtgcgcaccatggccgagtccttgggctctgccgagctgctcaggcagctcaagtctctgggcatggagaggctcttgcatgcggttaacacgtttctgaggcagtcgtgcacctacctaccccttttaacctttggtggtaagacatcatttgtttctcttgacgtttatggcacggaggcgaactgctccgctacaagttgttctttccccaaagcagcagcaacgtggccgcgtagacaggcacccggacccctcggggagctggtgcggggccctcccgaccagggcgtagcggagcagtccttctctcatgggctttttgagtttggcataactaatgtaccatgtatattttctcccccacaaatgtttccttggataatccagctttacatggtgagaaccatgctagagtccctcattgcagacaaaagtggttccaagaaaaccttgagaagt

SEQ ID NO: 78364 - DNA, 1054 bp, Homo sapiens
tgtaatctccctggcaatattctttgctctgaagttgattttatcttatattaatacagccactcctgctttcttcagcctccgcctgatctgtctgcttccattactgatcctgctttgtacccctttgctggaataaactgcagctgtaagactctgagttatgtgagtccttctagtgaattatcagatgtgtagagggtcatgagaccccccaaaacaaagagccaaaactgattacagtgacgagattagacaacactgaaggacagaaaccccacccagtgtctgtcccaggcccaagccctgcggcccgctgcaaccttgaagaaaccatctacacatcttcgcccacaccccctcctcccagcctctcctcagagcagcaccctgggctttatgtgctgggattctgtgtaatatttttggttgataacaggttcaatgtttgaaaagaagaacacgaaagtcatcagtgaaatctaatgacctcatgttacaagtgagagaattcattctcagacccgccctgactggctcaggatgacagctgtcagaggaggcatcactcaatgaacacatggtcccaggcctctggccccctgcccagtgtccggtttcccagtagactaagctcaccccaaagatgacacatccgagagacaacacagctagggtaacaaacagcagatgtgacttaactactcaggggagtgggaggaggcactacttctggggaagggcaccgtcacaaacactgtgctgtaaaagacttaagctcagaagaggaagcactctggatgtccagtcacacagctcagttcaagacagactctgctgcccgtgcctgatacagtctccagccttgttcgacaagcagagaaggtgggtcacagcacacagagccggctctggactcgccagtcgtgcaacttgggtgctctaactttcacgacactctgagccttcatctgtgaaatggggacaatcttacttatgagataaagaatactagttaatgtgctcaaaagggtgtcttactgagaagcaggca

SEQ ID NO: 78365 - DNA, 1012 bp, Homo sapiens
agcctcaagtccctataggcccagcagggcagcaggacccagcagtcggctctctcgcctcattgggtggcaattctttcgtaggggtgcccgagagcgtggtgttcaggggtctcttgtctcaactcttgcaggctgacctctgcttcctcgcctgcagacagtgaccccaacacacctcttcctggttgtaaggtgcatttgtctgtctactgcctcttcccacatggcaaatctaatccttctcaagaatttctgacttgaattcctttctgacctctccacagacagcactgtgagctccacacgcccgcactcaccaggagagccgtactcgtgccggggcaggcggcagatcttgggcatcacctccatcagcgtcttcacgtactgcaggattgtgccttgcagctgccggggagatgagacgggctgcgtcagccaccccactccgctctgctaacgcctgtggccggcgcataccctgaaacaagtctgttagcaaagagctcggtaaccagcaaggctgcaggatcgtctggctggggaataaaatccaccccgggagagagagcaaccatcaccaggtggcttcccatgactgaattcatgttctgaaactggactcctctttcaagatgaaagtggtcccggggtgccacaatgaggggagagctttgtcgccaggtgtctcctatggggatgcaccccagcatcgtgagcactgccagctccagggtcccccaggacgctgtctgtgctcctgggtgcggccccaggctcagctgtggtgaggtcagcaatcctaacaccctccaagctgccacatgttttgggacagagtccccagcgggtcctggaaggacctgtttgggtcacgggctgatggctgtgccaagtgaccaaactcttacatggtctcaagtcacagaagattaaaataataaaaaggatgaaaaattataaaaagtaagttatgtctagaaaactaaatccaggctggccaaggtgg

SEQ ID NO: 78366 - DNA, 1047 bp, Homo sapiens
cccaccacccagggaagcagtcctggtgcacaccccacttgcaacacttgaggcctgagcagccacgcagccgctggacttcacgatgccttccagtctggctcccaaccaggccacctggcctggcatggatgcccagcttgcaacagccacagccatcacggtacacgttacctgaggggtccccagtctttcaatcagtgggacaagatgcagcggggcgtactttgattctagtcttttcattttggcatcaagtctctccccctctgcagtagaaaaaatattttactatattctgctcctttgtatgaaacggtaattgcaaaggtttacatttgtttaaaaaacaaaagatttttaagttaacattatggatacagattctctttgaaaattattttacagaactggctcatttaatattttaattcaaaccggcagaaccaattttctgctcaatattcacttttcatttattgaatattccaaatgtaatcgaaagcagaaaatggcacaatgagcctgtacccatcatctgctataattatcaactcatggccactctgcttcttatatacccaactccccctgctcccatgctattgatatttggaagcaattctaagacatcatatcattgcagctctatttctcaatcttcatttaactaggttctgtacactcctcattacccctgggtatgactgaacaggcgccaaacccacaatctgcactggtccttagctctccggttgcatacagtgggcaccacccccacagagggcagtctggactccctggtgggggtcagcaggctcacctttcacatggactcgcggcaagatgttctggaaaggagccgcgtgcagcaggtcacacacttcttctaaagactagagcagagaaagagagggtcaagctaggaagggtatctcgccagagagcaatctggtgctgaaaaccaagaacttctttgccttttagcataaaataaactctgtaagtttattttatctctgtcaagagatttctgggatgatggaa

SEQ ID NO: 78367 - DNA, 1087 bp, Homo sapiens
gtcttgaggctacagtgagccgtgatcatgccactgcactccagcctgggcgtcagagtgagaccctatcttacaaaaaaaaacccaaaaagaacagtatgtgtgtcaattccgtttgctattatttttctgagaaaatataagaatcctgacattttgaaacatgaagaataaatgttgaagtgttaatagtaaaacatcctcactttgatggttgtagcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatctatttgtgttcatttatttactctaaccctgtgctgcctggcttggcaaggaactctaacctgaactcacataccaggccagctgggatggaggtcacctctaaggctgaggtgggatgggaccgtgacaccatcccatat

SEQ ID NO: 78368 - DNA, 1454 bp, Homo sapiens
aattgttgaacattcaaggccacctcatggtttctcctccctagtttctgtgtctgttctgttcccactgtccctcttgcctggtgagctagagcacttaagtcggcataaagtgctgctgcaaaaatgttaggggtataacaatttgtgaatatgaagctcgcattaatcttccagtgtgtccatctaagtaaatttttgtggttgcatttctgcttgggctgcaaaataaagctgatttttatttccaggccataccttttctccctatcaagtttattatattttgttttgcattctgtgtttaagaacaaccaaccatttgactcatgtaacttttctttgcctcctccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttga

SEQ ID NO: 78369 - DNA, 1062 bp, Homo sapiens
agcactggtggtttggatagagattcttttttttttttttttcctttggagatggagtttcactgtgtcacccaggctggagtgcagtggcgcgatgtcagctcgctgcaacctctgccttctaggtcctgccccagcctcccgagtagctgggattacaggatgcccgccaccatgcctgactgatttttgtatttttagtagagatggggtttcaccatgttggccaggctgggcttgaactcctgacctgaggtgacccgcgcaccttggcctcccaaagtgctgggattacaggcgtgaggcactctgcctggcctggatataggttcttaattaggatataaatgtatacaaatttgttctttattataaatttcatactgacttcttgcagtggaaagatggtaagtatacaggtgtagtgtatgatgaagcagatgattccctagaaatgtttacattttatgatgaaatgtatactttttttccttggcgaaagccagaatcttcataagttcacagtgttttagtttgatttcagtgatttaaattacgagttttattgatatttgaaaaaggaaagtagctgattaaagttctcaattttttttcctccccattttagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggtaagaaaaaagtcttattagtcttactgtattttactttttaacttagtttttactttaatcgaaatttgatgagcacataaggaaagaaattgttccacctggtagaagaacaaattgtcgtcatgttccctgctccctcctatcaatcccaagcctgtgtttctactgttctttaactctgtgtttgtaagtagtgtgcgtatattgctactacttacttccttagctttaggcattatctgttttaccttttatttactgtacctatat

SEQ ID NO: 78370 - DNA, 1031 bp, Homo sapiens
tggagaaacctcgtctctagtaaaaaaaaaaacaaaagaattagctgggcatggtggtgcatgcctgtaatcccagctactcgggaggctgaggcaggagaatcgcttggacctgaaaggcagaggttacagtgagctgagattgtgccgttgcactccagcctgggcaacaagagtgaaactgtctcaaaaaaaaaaaaatattctgaagacactgagccttgactgactgttcagtcaacaaatacttattgatcatgtcttgtatgccaggcattgttctaggtgctggagatacatcagtgagaggaaaagactgaaaaatctccacccacatgaagcttacattctaggtgggagacattaaacaagataaagaagttatgtgtttatgtgcctgtgcgtgatgataaatgggaaggagaaggagtgaagtcggaaggagtgttgtgaaatggaggatagataggtttattaggatgttagatctgcagccagggccagcctcgctgaaaggtatttgggtagaagatgtaaaggaagcgagtgatctgcccatatgatatttgggggagaaacccttgaagcaggaggaaactgtaactgtgaaggccacgagtggggagcatgccaggccaattaacgtgtgatacatagccctcagtgactcccctcctggtattcacacctttctctaatcccctttcacagtgaattagtgcagttcaaaacggtgtgatccaagaataccacagaagtgatgatgtgtgtcttccgaggtgaagcagagagaggcattgcagctttttcctgattccttggattgctcactttgagagaagccagctgctgtgctctgaggacactcaggcagccatggagagctccccaggctctcactgtgccaggacctacttgccagtcctgtgagtgagctaccttggctcacctgttgtgtattaaaaaatacacaacaatagtcagttggaagggaaaaaatggatgaagagttctaaggttctggcattatc

SEQ ID NO: 78371 - DNA, 1863 bp, Homo sapiens
tacaaagttgatgtttggttatttatattgagaaaagaagtgagaagatgtcataattagttaactactcagtcctgcagttatcatcaaaatggaaacagggaccaatgcccaagtaatatccaaccttttctttaaattttgatatgtctgcagggaaggaaataagagtccatggttaggctgggcgtggtggctcatgcctgtaatcccagcactttgggaggctgaggcgggtggatcacctgaggtcaggagttcgagaccagcctggcaaacatggtgaaaccccatctctactgaaaatacaaaaattagccgggcatggtggcctggcctatagtcccagctactcaggaggatgaggcagcagaatcgcttgaacccgggaggcagaaacctctgcagtgagccaaaatggcaccactgcactccagcctgggtgacagagtgagactccgtctaaaaaaaaaaaaaagccatggttaaaatcagaatttattaaaggctgggatcttttgtccatgatagtagacgttctgactttgaacttcgacattttggcaggaaggaaagactgggcttccccagcttgaagagtatccagtttagtgaacttcggctggtgtaggttgtttctctagaaatcactgacaagtcacaagaccctgcggggtaatcaggatgattggccctgccctgactcctctatcagggacactcgtggtagctcccggtgttaagtggcgttatggtcacattccatcattctatcctggcttcatttttagacctgattggaccttatgaggagagctgccttggcaggaaacagtaccacccttctgtcttccctgtgccatctctgtggctaaacctaattcagcagtcagaaaaacatgaaatgatagcctctatggggttcagtggacagaggagaaactgtcagcatctactgcttgttcccctagtccctgatgcttggtcctaagaggtgctctcactgttcatgacgggtatgcttgtaaaggattcattcaccttggcaagataatcattaagaaattgtcagagaaatcccgagtcatgcagaaacctttatttaaaggagtaactgagatatttaaaaatctgtcattactaatagttataatttatacaagagtcttacagtcttccaaagatgtgaaatatttcttcattcacaggtcaaggtggccatgcatatcttaaggaatggttgtggtgggctggactgctgtcaagtatgtataaagaacattgcaagaaaaatatgatagctatatattaaaatatttgcatatggtattatagcctcattactagcaagttttaaaggtttaaataatctttttttttttttttttgagacagagtctcactctgtcacccaggctggagtgcagtggcgtgatcttggctcagtgcaacctccacctcctggattcaagcgattctcctgcctcagcctcccaagtagttgggattacaggcgtgccaccaccacgcccagctaattttttgtatttttagtagagacggggtttcactgtgttggtcaggctggtctcaaactcctgacctcaggtgattcacctgccttgccctcgcaaagtgctgggattacaggcgtgagccaccgcacccggcctacttttttcatttttgtgagtacttagtaggtacttatagggtacatgagatactttaataaaggcatgcaattcataataattgcattatggtatccatgggttatccatcccctcaacaatttatcctttgcaggacaaacaatccagttagtccttttttttgtttttgagatggaatcttgctctg

SEQ ID NO: 78372 - DNA, 1069 bp, Homo sapiens
tgcaccttaatgggcaaatcaaaaacattggactttttcatttcttgggagtaatatcaactcagtgtgataatgtcgtgtttaccattattgcagtctccctgcagtaatgttatcactccttatttaactatctcttgtctgtcttccttgtgaagctagagagcttagcataataaacgcttagcacataatatccagtaaatactgtttgaatggatggataaagtaattgaggggctaggtggacagggagtttaagttgctttggttaaaagccagtgtctcataacttgaagaacggaaaaacatggctagttagggtcctgactgaattgcagattagttttggaactccgaagttaaattgtgggactaaaaatcccaagatgtgctagaaagctgatctggcagttagaaccaatcataaaccttgttgctaaaaactattttttctctgctatccacactgtgctttagttcatctgtcaactgagtttatgagttggccatttggaaaaacaattgcagtcttggtaagcctctgcttcctgtctggcctcgaggattgagccctccagataccatggtcctcatgttctccaaaggccaccggtaccatactgcacgccccagcagacacctctctgcaagaattgttaccctctgataaataatgtgaaatctgccttctctcagcacatccctgaataggctaaataaataaattagcatatgcttatgtgcacctattgctaagaagaaaatgtatgggtgagaaaattttgagtttctttgtatagattattcaaaaggacacatttgagaacctgataaatgtatttccaaactagatttgtatattatgcctaattttttctgcagaatttttttttcttatcagaaagttttattaaggctagaaacatttttttttaaaatatgggatcagagtttatgaaatcagtttaaacttggttttatagcatgatcctatcttttgccataatttgaagaaatatacaggttggtgctaaatttaaataataaatattatcaatattagtaa

SEQ ID NO: 78373 - DNA, 1032 bp, Homo sapiens
cgccactgcactccagcctgggaaacagagtgagacactgtcaaaaaccacaacaacaacaacaacaacaaaaaagcccttcccctcccacacacagaataagcagaaaatcataagactctttaaaagtgtttaaaacgtcagtaggttatttttggaatttttaattctcttagtcgtggagtccttgaggataggccctttgatcatctttacaacttcagtgcctggcagataatagctgctcagtgtttgttgagcaatggtcacagttcggattactcccgagtccccctaagtaaactgggcaggtgaaccacatggagcttgggaacctagttgaagtgaaatttagaaaattttactgtttatctgtctttaatactggccctgcctcatggctaattcttaagaagaaaaaatatctctgttgcaggctctcccggctgtgatagaccttcagttacagagagagggagcagagtgggaccaggtctgagaatagtgaagcaactcattcctttcaggacattccctctgatgtcctattttcaaactgtaagtcagaatgagatcacttattttcttggtggcagaaggctgctttataatttgaaggcttgcaaattgtatgctgcttgtcatcccccagccctccacacatacaccctggtacagttccatgcatgaagaaacaaccagatcaccttatttggtgatatgcctcattctagaaagatttgtaaatcaaatttgctaccgtaaatgagtgccttttgtggggaaaccaccacagaaaacctaagtaattgtttttaaggaacttaaagagtttaccttgaagatagaacagtagttgagaattaaatagtaaagaagagaaaatgcctgtgggctggagttaattgcagaagtctttgtagcacagcttaaggtgtaccctggccttgagtggagagcaggctttgggttgcaggaggaggaggaggggagggcctgtctgagggtgtcaggtttctgtgttaggaaatg

SEQ ID NO: 78374 - DNA, 1053 bp, Homo sapiens
tgtatttttagtagagacgggggtttcaccttgttggccaggctggtctcttaactcctgacctcaggtgatccgcccgcctcgaccccccaaagtgctgggattacaggcgtgagccaccgcgcccgacctaagagctctaaagtgttaatgtaatgtgggcagccgggtgtagaagtaaagtccctttctgtgtggtcctctgcatgtgactcttttttacccctgggaggtttccttagctgtaaagtgataccttcatcttattgcgtagaagagaaatgagtagaaatgatgcatggaatagtgcctggggaggtgttcagtaagtggtagctattgttagggagagataataaaaagaatttcacatattttcagaatgtttttaataggtaaatatggtttactcatatttaaaacacatgactttgaatattacatttttttatagatggtgtaagcttcatttaaactgatttatttgattgctatacattgtgatattgaacagaaagataagacttctgcagagaataaaaggtggggtgggggtgggagaggaaatgggagatttaggtcacaggatacaaagtagcagatattcaggatgtacaacttgagaactacagctaatgaaattgtattagagattttccttcaatgagtagattttagctgcttttgtcataaaaaagtaactacatgagatgatagatatgttgatttgctctactgtggtaactgtgttagtatctgtatgtttcccataacataaatctcaaatatacacaatttgcaaagatttatctgtgttgtagaattaaatacacccctcagactagattagagcatccttaaacatttctgcatatctatttgttttatgtaaatgaagttgaaacagaactacttaaatagttctgtaatggctccagatgaaaataaattatgatctggccaaataaatgggttgcagatctgttccttgccttttgggtttgtgtatggcccatagggccccacgtgatctgacactcacctttttttttc

SEQ ID NO: 78375 - DNA, 1023 bp, Homo sapiens
tgcgcgcgaggcctcttgcgtcatttagccgcgcctaggttttccggcgccggccctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggtgaggtcgccactccttcctttcaggcaagcgcgaaggggctgacttggtggcgagccagcccgccttgtgtcggagaagggttcttcgggcaactttcctttccgggtgttctgaagcggttttcctgtaatcctcagtgaggaaacccaccgtgaatcggattgccgttcagtcccacggaagcctggctcgttggccatgtcggggacgcatgttcattaagttcattaaaataatttcatttgtcttggtgagttttagaaggtggcttcagctgctgcggggatcataactgacagttaaacaagccttagaagtctgctgtgacgttttgagcctgactgttttaatttccttttataaaatcacggaatcctatttccctctctatacaattgctcaaaactgtgtgtttagtttggtgtttgtgcctccttaatttcttttctaggttgttagttcatttaatacaggactgcatgttaagttctgtttctagaaatcctgtgtatagccatgtgcccggttaatactttttttagtaagaggaaatatcagagtcgagagtttccattccagtaagctgcctgtcgaagcagtagttgtgctcgattgagtaggttttatgttgattggttggcaaaatgagtatgaaggctagtaaccaaattataaaacgtacttagtaactttaagtcttttgcctacttctgtgttttc

SEQ ID NO: 78376 - DNA, 1094 bp, Homo sapiens
atatgttggtgtttgttcttctttggatttcacatctgttttctggtagaagtgagcactgttcacttgtgcagtcgtcttattttccttcttcctagatgactcagctctttgtaaatgttgtgctcaacttctaggggccagttctagactttggagatgcagtgtctcccaggtgtgcacggacacctggtccgtggaaacaggtgtgatgggcacaggctgctgcccttctgtctggtcgggggattcctcttcttcaagctgctcagctaacccagaagaggggagagagtactccggtggttcccagagcccctcccgttgtgccgcttcgacctgacacctgctcgatgctgacttaggcttcctgccaccaagcaggaaactagaaagagaacatttcagtgtaaggtctgttcccgacagcatggattagcttccgtgttctgaagttgttcttttcatggtgtctgacaccgagggcgttgttcgtccatcaggcgggattggatggagtcttggtgttttgccttctcagggaccaaaaatgtatcattgactccttaacagtgaccttcctcccaaggacatatccgtgttcatttttcataggttttactcatattcataggtagattctgttaatgtgagttggaaagaaaagaccaatttgtacaccagtcacaccacaagacagtttatcatataaaatacctcaattttttgtattcctcatttccacctcacaattgtactggtgatgaattttaagggtctgtcctttagcttataggtgatgtttcacatctggccagattcttatacctccattgtatacttgaaaaggttcagaattacaggaacagcagtgagaatttggcccactaccacgactcatttgtttcattcacattcctcacgtgcaacaacataattatattttaagaaaatgtaactttgttacatcaaaatatgttgtctagtaaaaagttgatattcagtagaacaaggatcatgtaaataaacatctatttcacatgtacccaaaagcatttaaaaagcagaatccagggcccagagcatgagccagg

SEQ ID NO: 78377 - DNA, 1072 bp, Homo sapiens
gaaatgcaggccttaacttactgaactgaactttctgaaaacgtaatgtagcagtatcaatatacttttgggcataaaaatagtttcctaggtaaggggtgtgagatattcaaagaatacatgtggctaacaagtgtaatgagaaagttcatgtgtcacatgaaaatgatcatgtttgtgttgctacagcttttgtgggaaatttagtttaaaggcagctcttggtgtaccttagtatattttaatccacaattataccattgatactgagaggtgatacccgatgatcttctctataatattcttagagtaaaacaaaatctcaaaagtattaatagctcttctacccttgaaggtgactggtcctgggacagttagaatctttcaggtttacctctgttcagcagatacttcagtaggatacatagcttttcttccagtgaaacaaagttcatatcatccattgtttttcaagcacgtgacaccagcctcaaagtaaatgacatgaccagtggttgaacagtctaattttcaaatttaatatagagcatataacttctgatttgatagtatttattttaaaaaattatgttttcatcattcatttgaaaatgaaaaagccccaaagtgagaactttgggggagggcctagaacatggatagatctcttagtggtctttccaaaagtacatgtacttgaaatattttcattatcatactattctttgaaaaaaaagatgcttactgtatacttgttttcaagcatcctctaaaatcaaaggttttgatcacaatatgcagatttctcttgatagatacttaaataggctatttctctcctcttcttgggcaatgccttgttttctcctctgaatatttgcatttgaaaggattgcttcctgttctgctcattgatcaaaggtagggccaattaaggattctaaccctaacccagcaccacaaagcccccctggagcatcttcccggctggcaggaccatgccatctctgtggagaaggtgctggggagggaagtccttccagtgccacatggagtgaggccctgcccatgc

SEQ ID NO: 78378 - DNA, 1057 bp, Homo sapiens
tggccgtgctcggctgcagcatcatcgtccagttcaggtacatcaacaaggcgctggagtgcttcgactcctcggtgttcggggccatctactacgtcgtgtttaccacgctggtcctgctggcctcagccatcctcttccgggagtggagcaacgtgggcctggtggacttcttggggatggcctgtggattcacgaccgtctccgtggggattgtccttatacaggtgttcaaagagttcaatttcaaccttggggagatgaacaaatctaatatgaaaacagactagattgcaataggagcttggatggttcgaggaataggcattggaggtggtttctggccgtgattggatgtgaagtagaagaggtcctcgatcatggtgttagaattgactggatagtaacaggtggtctggtggatagcggggagcatggctcagcaccagagcagaggcccagccagccctctgcagcccaaacgtccccaacggttgcctggcaccatctctctctgatgagacgaatctcattttcatttccattaacctggaagctttcatgaatattctcttcttttaaaacattttaacattatttaaacagaaaaagatgggctctttctggttagttgttacatgatagcagagatatttttacttagattactttgggaatgagagattgttgtcttgaactctggcactgtacagtgaatgtgtctgtagttgtgttagtttgcattaagcatgtataacattcaagtatgtcatccaaataagaggcatatacattgaattgtttttaatcctctgacaagttgactcttcgacccccacccccacccaagacattttaatagtaaatagagagagagagaagagttaatgaacatgaggtagtgttccactggcaggatgacttttcaatagctcaaatcaatttcagtgcctttatcacttgaattattaacttaatttgactcttaatgtgtatatgttcttagattagaataatgcaacttcgagtatgctttaatatttcaatattcaagtta

SEQ ID NO: 78379 - DNA, 1047 bp, Homo sapiens
atggtggctcacacctataattccagcactttgggagtccaaggcaagaggatcgtttgagcccaggagtttgagacttgcctgggcaatctagtgagacccagtctctacacaaaatttttaaaaaattagctgggtgtggtggcatgcacctgtagtcccagctactccggtggctgaggtaggaggatcacttgagcccaggagttcaagcttgtggtgagctgtgattgcaccactgcactccagcctgggcaacagagtgggaggtggtctcttaaagggaaaaaaagaagaaaaagaaaatggtttttctagataaaatatctgctgttagaagaaaggtcaggtagtttggtttaaactttaatgatttctcttttttcaataaaggtccattttagcttcctatctcctgaaggaaaagctcaacatcttgggcaagttggggtgcctgctaagctgtgcaggctccgtcgtgctgattatccactccccaaagtctgagagtgtgacaactcaggctgagctggaggaaaagctgaccaatccaggtaattcctttctagcagcactgccaagaaagtttgcagtaggagtgccaacttttttaaccacgtcttcaaattggatgcttcctggcagggcagaggaaccgtgtgtccaccctgatctgttactgtagatctgtgttctctgggaacgtgcatcagtgggctgtgctcgcaggctagccctctgccctcaccctcccgcctgatcctcaggccctgcggggagcctccgtggcctggtattccttcgggttctcttctggggccttgtgcatgggcgccttcccttcccacagtggctccccttgggccaccctcccaagtctgactgccacccgcccctccccacatacctttcctggtgtaccctgcccactctatctccacctcagcacttcactccctccagcgtgaagctctgtgagaacaaagacctggcatctcttaagtttagattcctcatatagccctgtttatatatcttttgacataa

SEQ ID NO: 78380 - DNA, 1633 bp, Homo sapiens
ctatgagaaggccaaccccaatgaccgccgctttggcattctttccaattgcaaccattccttctgtattaggtgtatccgcaggtggagaagtgccagacagtttgagaacaggatcgtcaagtcttgcccacagtgcagggtcacctctgaattggtcattcccagtgagttctgggtggaggaggaggaagagaagcagaaacttattcagcaatacaaggaggcaatgagcaacaaggcctgcaggtattttgcggaaggcaggggtaactgcccatttggagacacatgcttttacaagcatgaataccctgagggctggggagatgagcctcctgggccaggtggtgggtcattcagcgcatactggcatcaacttgtggagcctgtgcgaatgggagagggcaacatgctctataaaagcattaagaaggagcttgtcgtgcttcggctggccagtctgttgtttaagcggtttctttcactgagagatgagttacccttctctgaggaccagtgggacttgcttcattatgagctggaagaatatttcaatttgattctgtagcatcgtgctgtggcatgtggtctagtctgctgaggttctgtcgtctgctattgcctgttttccctgtgttgacactcttactgctttcaggggctgttgaggcagtgcttctgttttcttgtctattctgcatatctttccccctaggattatggtgattatctgtgttaaaaaataagtccttaaagttactgttttggtgaaattaatattaatgtcagcttatggcttttttttgtcatctctgttgtcaacaggattaactcagttctagtgtagtgtttactgaatttccacacttattttgaagaccctcaagagtaaatgtggcagagtgaaaggagaagttttaattgaactagtagctttgtgctataatagccttaacaaatggacccttgcagggctttgcagctgctcatctgtttgtttacagtttgttctttccctccttccccttcaagtgcacttgttaaactgtgatgaacttgtgattttgtgttttacttgaccaaaaccaagtgtatatgtttacatgtttttatcctgtttagcttgacatgaaataatttatatttggaaatatatatttaagaattatatatataaaaatatatatgtataagagttatgtatttgaaaaaaatatataaaagaatatacatcacaatataatatttatgtttatgtaataaagtaaatacagagctgaaagctgaaggtcaaagcctaacaggattggctgttgtgtggatgtgagttgtgtgaataatctttctgtccctcgcacagaagccagtaattagcatctaatgaaaaggactgttcaagtgggtctggccaaatgtgacagatgcagatcttagaggacttacaaagcactatattggtaattcttacaatggcattaatagcttactctataaatacagaaatggttttcctatgcagtttagccaccttctcattaattctttgtaacagcaaatcctaggctcagaggcacagtgctttgtatttgatatacaaagtctctagactttcccaacaaggggcttttga

SEQ ID NO: 78381 - DNA, 1079 bp, Homo sapiens
gaagctctggaggaggccagagctctgcgggaggctaatcccactgcccactaccctcgcagcagtgtctctgaggactagcaaagtctggaggcagatgaatggtttctgaccctcaccagggctgtggaagggtgggggtgggtcattatagtattcaggatttacagtgcagtattcacgtgtaacttttaagttttcagtacagtgcttttatacctttaatgcaatgttgtattcatttgggtactattgtgtagtatttaggatgtatgcatgtttgtttatatgtaagcttggttggtgctttcgcttttgtgctacctttcttggatttttgtaccagagatgtgctaaactgatgaaatacattgagaaagtttccatcttattcttttatatgggactgatgatgtgtgttggggtagactgctcctgcagagtttggaagaagtcaccagcaaagccggcctaaccaagaaaagtcaaggcccttcatgaccttgctgggcacagaaaacaccctcgtggagtacactaatttgaactggactggtctcagtgtgagcacttggcacactttactaaacacatatacaaccccaccgtgagtcaactttaaagtaaacattaaagattcttgtgatacaatcatttttggaaaagtgtactttatcattttaacaaagcagtatggttgggaatgagacaattctctattttacagtgtatacagatacaactatttcccctaatagggtgggaaaaatcgctactcatgattactcctaaatttgtgaagtttatagttctattgtctttaaatgtaactcatgtttatttcaaaaacattcacaaatatagaaaagtatacaaaacaaaacagtaagattgtctgtaatcacatcatatgggaataaaaaacaaaaataatttccttcccttaagtttctacattttatcaaaattaatagatgtcttgtgacatctattaatatacatataacatatttataatataaaagagtgagacattgtgctaagccctaacatgtatttttctcctttaatccttgcaa

SEQ ID NO: 78382 - DNA, 1017 bp, Homo sapiens
aagctcatgtttacaaagccgcccagacctttctctgggactctcatatttaacttaattctggatatacccaggtaagcgtttcccaagaaacttgaccccaacatcccaaaaacttaaggtatctttcccttaaactggccccttctccagtacgcatccatctcacttctctcctgccctagatcttctcagcccaaacaggaaaccccgggatcgctctcccagcaggtgaagcctcgccatggaccctccccgtcggggccccgcgctgccccgcccgcccccagccgctggccaaggccgcggtcgcgcaggcgcagtgccgcgtcccgccgccgccccgccctgcccgtcgctgcggaaggcgccgcgcgcagcaacgcgcacttcctctccaggaatccgcggagggagcgcaggctcgaagagctcctggacgcagaggccctgcccttgccagacggcgcagacatgtcagaacaaagtaaggatctgagcgaccctaactttgcagccgaggcccccaactccgaggtgcacagcagccctggggtttcggagggggttcctccgtccgcgaccctggcagagccgcagagccctcctctaggcccgacggccgctccgcaggccgcgccgcctccccaggccccgaacgacgagggcgacccgaaggccctgcagcaggctgcggaggagggccgcgcccaccaggccccgagcgcggcccagccgggcccggcaccgccagccccggcgcagctggtgcagaaggcgcacgagctcatgtggtacgtgctggtcaaggaccagaagaagatgatcatctggtttccagacatggtgaaagatgtcatcggcagctacaagaagtggtgcaggagcatcctccggcgcaccagcctcatcctcgcccgggtgttcgggctgcacctgaggctaaccagcctgcacaccatggagtttgcgctggtcaaagcgctggagcccgaggagctggacagggtggcgctg

SEQ ID NO: 78383 - DNA, 1004 bp, Homo sapiens
tggagttaccctgttctttatgtattgagagaactgtttcttgtaagcattttcatcttcttccattaagtagcacatgtaatcggcaacattctggcccatgatgtgcttccggtgtacttctgcattaaattccttgctttcagaaccataaccagggaattgtttggtactgtgagggatagacaagcctccatccacagctcccttcagggcaccaaaaactttattgccagtggtagttctggcaaggcctgcatccaaatagcaggtaaaggcacttggctgaccatcaatgctttccacaatgtattcatcgccagtcacctccacttggccttcatagatcttgtccatgccaaacctactgagaagcctgcgggccagcggcaggccagtacaatatgctgcagcataatttgtcgggccaaccttcacaccatattttggcagttcgtgtgcatatgctgtgcagactatcatatccccctctatatgggcataagcaatctgacaaatgatatctctgtttgttacacgaactatcatcctgtatttgagtgtgttgtatttatttttatcctgtatcaccaagcgtttccgagtatcgtaatcagttttaccctctcatcatcgtcttctaaatttcacttggtatctcttaaagtaggccttattcttaacaactttaacaaaccccatcctgcagaacagagacccgcgtccacagctcaacagagaccagcaggcacagcggcgctggggcagggagaaggggaaagctttttaatcttcagtgggtacctggaacaaggtatctgtgtaaaatgcttttattattcaaccagactttaggctaagaaagcccattttaatgggtttattttaatattccagccctcatgctcagtcacctgtttctccagttctttaatgtttaacttatacattcattagaattataatagagggtcagtggaaactgactgttctggttgctaatg

SEQ ID NO: 78384 - DNA, 1071 bp, Homo sapiens
gcaccatttgcatgtttttttaaagtagatattttataatttaaactatgttctattccactatataagtatgtctactgtatcctaaaaatattttttgaaaccattttggaaatcaggtttactgtttttggggggaaggtgagtagggtagtggtggtatgtatgtatctacatctgcataagtgggaattttatatgtacgtgactacaaatagaggtagatatattattttaatttcattttctgattttttttaaaaccagattttctgatgtcatgggcttctaaaaggagaaaaaagtggttatagcatagattatgactgtttgaaggttaaagatcttgtaataattttaccttgttttaattagatttaaaaatccattatattaaatgtagttctaaatataaccttgacaaatagttatttcatagattgatgcagtctaccaaacaaatgcctctcttttctgtttcagggatcgcttacacctgagacgaactacagaacagcacgtaccagaggtggaagtccaagtcaaacgcagaaggactgcctcactgagcaaccaagagtgagtacagactgtgttgggaacaaatgcaagtcagaatctcctttcagattagaacaaaatatcatgcaatgaggggattaaaatgaacataattgaagaagcagacacatctaatacagaagatgtagtaaaaaagcaatgaaattcttaaccatattatcctaaaataattcaccctcttaaagattttagtataattttcttttttcctatacgtgggtaagtgcattttatctttataaaattttgtaattacccttcaacataagcatacttaaatttttctgcattattaaatcactttgtatgcttgcaaaatgtactgtgcgctgaagtgattaatttacatattcattcttgctctgtgatatttaggtgtttgtttttggttagtgcatttattctgttaaaatttaaaatacatttgtgttttttatcctgttttaagtatatatatgtggaatgtatatataggatgtatacacagac

SEQ ID NO: 78385 - DNA, 2985 bp, Homo sapiens
cataggtatttcagaaaaaaggaaaaatctgaatgaaagagtaattgagatgttgatacagagatgacttcatattaattctgaactagagagagagacactaccttaaataaggatggaaagaaaaatactaaatttgggaaaatgacgcttagtttttgaaacatttaggaattactaggtaaaataaaattcaatgactttcatcagtcctaagtgtgtcaaatgtgagagttaagaatgagggactagggaaatgtggcagtcccttggtgaggaagctagtatgagaggaaggatgtttttgaacgtgtctgtcatagtgattttcatgcaaaattgtctgcctgttttaaaacatggtagattgcagtgcagctttaacatgctttcctctgcaggctccatctactctttgaagcttctgcccagcttgcattgtttctaggagaacctgcgtcatacctttatctatagccttcccctaggtcttcagaagcatcaagttttaactgtggacattggatttggtggaacagcaatcatggtaagctgtatgataaggctgagggttgaaatgtgctgtaagggccgaaagaaatagtttgccagcatgtgcagtgatcttgggttctgaatgttagaaataaggatacatccatggatatggattctcattgcattgagtatcagctgaagatgagctgatttttttatttttatttttttcagacggggtcttgctctgtctcccagtctggagtgcagtggtgcggtcttggctcactgcaaccctgggttcaagagattctcgtgcctcagcctctttattagaaacagggtttcactgtgttggccaggctggtctcaggctcctgacctctggtgatccacccacctcggcctcccaaagtgctgggattacaggcatgagatgagccactgtgcctggccatgagaaatgtttcatgatgtgagaaaatacaggagtttttggtcatgattccaccagtggtgaaggactgtcctgcagatgatggactctcaggtcagattacaatagaaataaagagggctttgaaaatggaagggttttggcattaacagtacagagaaaagcagtctggagagagagaacaccctacatcattgtggtttggtttacttaggggagtggacagtttagagcatgcatcgtcacagagaaggataatcacctgtaaggaggtgaaaattggttcttgagatgtgaaaaaatacttcataatcctttgtggtcctccaaagagccatactaaatatggaagaatgttggtgaaaaaggagagaatatttgtttagttaaggaaaccaggcttagattatgtaagggtggagaagaaacaggagaagattagaagactagggtgttggcaagctgaacatgactcttgtcttactgcttctagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagtaaggctgatttgggcaaatgggggttggacacagaggcagtgggaagggaaggccagagctggagtaagggatttccgagggtaactgaagtagttagggaaactatggtagagccagtctattgtttaacctcttgacctgatctctgaattaggtcagagtctgcatctgaactcttttaagtttgtaaaacaatcatggatttattactgggagtaaaagtatatgctatggtcagaatactcgtatttatttttaaaattgagaaaaatgctatattaattaattggttggcttctgcagcagtcttagaccaaatcttggttgaaatggagaagaacagttgttcttcatggttgaggagttgggatatggttgccatttggtatcctctctttgcctatcactgttcccattatttcagttctgtgtcacctgtcattatgatttaattatttaagtaattttttaaagaaatttccattttaatgtggaaacccaggtttcaattttgtttttcttaaaaggtatttcacaaaagaaattagtcttgttgtagtgtaacatcaaaggaacattctgtaaaagactaaagttagattagaaaatagcttcactatttacccttgtatattaactgtgtttacagatattttttggcttgtttttcagtgataactcagtaaatgtttagcatcagttgtcttaattgatacttgaggttgtataaatattttgatgagtgagtgatcactaaaatttatctcactaaaatttaattctgatttgtaggccaaagaatgcgaagcaaccagagcgtgaagaaaagcgggttttgggtctggtgttgctgcgtggggagaacttggtatccatgactgtggaggggccaccccccaaagatgtaaggaagatgtagggcaggacagaactttaatttgcagggacatcatattatgtgagatgtctgaaatcagggtagagcagacacagttcaacatggattgtcaaataaaatgtgccaggcacttaatatcaattgttggttgcctatgctattcgggattaggggatttttggtgaattattctatgtgctgggcattacctaggtaagggtaggagttggtgattcatgtttgcttggtatgtttataaaagaggtgttttcacaatttgacaaataatgtgcattttatacacaagatacctccatggtatacttgcttgtttgttcatttggacacagaactaatatgagataggtgtcatgggaaaatggtggagagaagtgatctctgatgaataagaatactgagaacttgtaaattgtttgattttaggctatgaattttcttgtttcagactggcattgctcgggta

SEQ ID NO: 78386 - DNA, 1037 bp, Homo sapiens
taatccagcactttgggaggccgaggtgggcagatcacttgaggtcaggagttcgacaccagcccggcccacgtggtgaaaaccctatctctactaaaaatacaaaaatcagctgtgtgtggtggtgggtgcctgtaatcccagctaccaggcagggagacaggagaatcgcttgaacccaggagtgggaggctgcagtgagctgagattgcgccattacactccagcctgggtgacaagagtgaaactgtctcaaaaaaaaacatgggaataatgagagaagtacattgcaacagttgtttgtaactaattggtcatttttctcatttattttctgtgtttgaataatgtgaaggtttgcatcgctttgactgtttcccgccctgccttctcaggtaatgactccacagggaagaggcactgtagcagctgctgctgttgctgcgactgccagtattgctggagccccaacacagtacccaccaggacggggcactccgcccccacccgtcggcagagcaaccccacctccaggtaagggattggtgaacacgaagacgaacttgaatctctgatgagagatagcttactgatttaagacacagcctgagagcctaagaatttggggaatatgcttccttcttctagatactggtttttaatgaaagacatagaagagtaattgtcatatagaagttatttgactctatcattgttgtctggcccatttctttagggattatttgggctaaattctaacttttctaagccattttatgaggcctttatttctaccatttttcactgtaggcattatggctcctccacctggtatgagaccacccatgggcccaccaattgggcttccccctgctcgagggacgccaataggcatgccgcctccgggaatgagaccccctccaccaggcattagaggtgagtgggagcataggggtttgatggttcagccaggcccctgaatatgtgtatcctctttttctcaatgtttctatttcctttccaggtccacctccccc

SEQ ID NO: 78387 - DNA, 3088 bp, Homo sapiens
tcaaaaaattagccgggcgtggtggcaggcacctgtagtcccagctactcgggagcctgaggcaggagaatggtgtgaacctggtggagcttgcagtgagccgagatcgcgccactgcactccagcctgggcgacagagtaaaactctgtctcaaaaaaaaagaaaaaaaaaaaaaaaagaaaatacatacatgtctcatctaaaacatggttggtcaacaactttctgatttcctgatacacattttattaaccggctccttaaatatatccatgttgcatatcatgtttgacatgctttcattgtagcttatagaataatttcaaatagaattttgggataaaaattatgctaccttaaaataggttatgaagtatttgaggtattctctttttatatgataggtaaacttggcttggaattaaaaagattttgaaagttgcttagggagctccctgcttttgtgaactcattattccttaattatgatgtcaaatttcagaagtttgttattaacataccggtattttgctttttatagattcttgtaatagaatattacaagtagaaactgatttacatagataattatgtgaaatagtgctgcttgactaggattttcatgatctcatttcaaagattagcaaaaacaccctttacctggtatgtttacctctgatactaccttcactgatttcagcaggtagtcagttataatccatggattgaagttttgatttatttatttatttatttgagacagagtctcactctgttgcgcaagctggagtacagtggtgtgatcttggctcactttagcctctgccttccgggctgaagcgattctcctgcctcagcctcctgagtagctgggattacaggtgtgggccaccacacctggctaatttttgtatttttggtagagacagggtttcaccatgttggccaggttggtctcaaactcctgacctcaggtgatccgcccaactcagcctcccgaagtgctgggattacaggtgtgagccaccgcaccccgccatgggttgaagtttttaaatgcatgttttccggtagttaatacattgcttgattctgtcttataattgcatttcagttctcttcatcttgtccatacacataataatgcttagtatataataaagcaaggtatattttcatgggatttttgtagtgggagaatgacatctgagcctgaaataggatatttgtgttgtaactttttcagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacagtgagtatagtacctgcctttaaatgaatactgttggttttttaggacagttgcttttttttcttttttcttcagctgtgtgcagttgattaacttgtacagagcctatcacacaatagatgtttaagaaatattaagtgaatgaatgaggcagcattgctaatttttgtatagtgagacagtatctcacagtccaggctggagttcagtggcattaacataactcactgcagccttgaacacctgagctcaaacgatcctttcaccttatcctccagagtagctgggactacagtcgcgtgtcaacatgcctggctaattttagttttctaatttttttagagttgggatctcactatgttgcttagactggtcttgaactcctggcctcatgccatcctcttgcctcagctggtattgtaggtgtgagccactgtgccaggtactaattttttttatgttagaaaacaagtttttaggtattttatagttacttccttatgacaatatctcatcagaatctaggcctatctgatatctgactccatacgtttataccgtgtagtcagccattcccagatagaggtcatttgagttacttagtgtttaccagcacttgtttactaccttgcgatgatatttacagtgtatttttgggtatggttttggggttatttggttgttgttaaaatgcctgtaatcccggcactttgggaggttgaggcgggtggatcacctgaggtcaggagttcgagcccagcctggccaacatggcgaaaccctacctctactaaaaatacaaaaattagcctggcgtggtggcaggcacctgtaatcccaactacgcaggaggctaaggcaggagaattgcttgaacccgggaggcggaggttgcagtgagccgagatcgcgccaatggcactccattcagcttgagtgacagaggtgagactcccatctcaaggtaaaaaaaaaaaatagaaatcagcaactgctatttgagtttacaggagtgagaagtcctctcttgcatggtgagatggggaacatttaattcaatagaaatatttgagaccaggtatggtggctcaagcctgtaatcccagcactttgggaggctgagttgggtggatcacctgacatcaggagtttgagactagcctggccaacatagcaat

SEQ ID NO: 78388 - DNA, 1231 bp, Homo sapiens
ttttgatgcatgttttcagtgtactctagtcctaaaattggtttacatttaattattggggagaatagcaagttgtcgatagtatctgtggtggcattagtgtatttctgtttcagttctttggacagtttgctagtggaaatagtcattgtatttagctctgtgagacccgactggcagattgctgtctctctctctctctctctctctctctgtgtgtgtgtgtgtgtgtgtgtgtgtgtgtgtgtgtgtatgcgcgcccgcgtttgtttccttcatgtagattgctgtgtgtgtctttttcttcataattccccttaattctgtgtgctttgaatgacactgttgttgttactgttgttttatatccattgtcacataaaactcttatcatttattcttccaggccagggactgtccttatgggtagagatacactatctgcaggaatttatttttttacgtatttttactagttgatgggaaagacattgggaaagacctgggctggatttgtgatgagctgtgtttactgagcatgatgaagtaaagctcaacgtgattactctgaagtccagccttactgtcagtctaaggactcaggatacaaatactcaaaacataaattcttagactctaaatttcacatggtttttcctatcagtacaggttaaggataatggcgtgttgtaggtttttccagtgcaatacaaggaagttggttctagatcctttagtacagttaatgttttgtagagtgtgttctatgttcactgcattggtatgtctcatctttggcatgatcttggctcaccgcaacctccgcctcttgcattcaagcacttcttgtctcagcctccagagtagctgggattacaagcatgtgccaacatgcccggctaatttttgtatgcttttgtggagacaggctttgccatgtttgccaggttggtctctaagtgatccacccgcctcagccccacaaagtgctgggattacatgcgtgagccaccgtacccagccacacctttgcttatttctactatgcatttcaagtgatcatttcaagagaataagtacttaggagctcctatgctctttttttttttaaccctgttgcttgcatcacccggttccaaccctatatgaaagtttcatgagcatgtttctgtcactgaggcagcttctccatttggcatataattgagaaattgctagtttgtggctgaga

SEQ ID NO: 78389 - DNA, 1993 bp, Homo sapiens
aaatgtatatatgctgtcatgttagagagggagagtggttccctcccccacattttgatttaaaagtaaaaattaatttttattaaattgtttgggtcagtttcatgtaagaataatctctacattgaatggtatatcttggccgggtgcggaggctcacgcctgtaatcccagcactttgggaggccgaaggggccagatcacgaggtcaggagttcgaaaccagcctggccaatatggtgaaaccccgtctctactaaaaatacaaaaactagccggccgtggtagtgcacatctgtaatcccagctactcggcagtctgaggcagaagaatagcttgaacccaggaggcagaagttgcagtgagccaagatcgcgccactgcactccagcctgggcgacagagtgagactccctctcaaaaaaaaaaaggtatatcttattttctttgatgtactgaggttcatgatgcaattcattcttaagcatatactatagaatctttaaattatatggttctgtgttcatttgtggcatgacagtaaccaagacaatttagtaaataatcagcaaatgaaatatttaattttgaacatctagtatttctagatgtatagagagtctcacgaagtagattttttaagtatcttgttgtaaatttgttagtactgttgtcttttgcaattaatgtggcaatgaaattgattattgatacacaggctcttggagctaaacaaaatttatcgtgttttaatttggatattagaaggaggaaatgaaaagagactctctacattttacctgttattatatagcttaccattatatcagatatgaattgctttttttaaaaaacttagattaaatgtcatgtaaatgcatttagtctttccagatacacttcttgatatcataatttttatttcctgttaatattcaagatataaatgacttcattaaagagattttctactacctctaggaactatacaatattctgtatgtgttcccttggttgcatgacaatattcaagacaactttgtaaataatagataaaaaattttaatttttaacatctagtctttctagatgtatagagtctcacaaagtataattttgtaaataagtcattgtaaaatttcatggtttcattgtgttttgcaaatgtcttggcaaagaacttgataaaattttgggcttcttgacctatacatattttggtatctctttattgggttgtttagtgtaaggaaaaagttgaaagaatgtattttcaactttgaattgtaatcagaaagaaaatatattttaaccattgtttagtgcttctgttatatattgaaaacttcagtcttaattttttagttacattgttgatagggcattatataaatatacttctatagtcattgtaggaaatgtcttttataaggaaatatttcttctacctctgaattacacagttttgtatttacttggactgcatggcaacattcaaaaaacactttgaataacagataaaaatgacattttctaaagctctaggtttgctagatgcatgaagtctcagcaaagtataaatttgtaaatatttcattgtaaaatatcataaattgactccttcaagtgttcagtagtacaataggtaatcaataattggcctcttgggactgactgtaacgttttggtgtttgtatgttttgagacagagcaatagattgcctccatatcttttaaacattcaggtctcttgtataagaaaaataaccattgtggggtttttgtgcatcttatactaatatgaaacaaacaaaaccccctggatattttatccttagaaagatagaggaagacaggagaagggaatggtcattgtaaattagatagatatattgagtgttagaagattatttaaataattgttcttttgttatttgtactctttgcaaatttatttaaatgcatattcatgtatatcataagtatatattc

SEQ ID NO: 78390 - DNA, 1742 bp, Homo sapiens
actccaccctaggcaacaagagcaaaactctgtataaaaaaaaaaattaaaaaaattgtggaactagtgttttatttctaagcttgcagatatttctagaattccacttactgttacatctaaatgtatgctgatttttcgttaaataataagcaggtctgtaaacattttcttttctaacctctttccatatttatatgagtatagaaaaactgtggttatgaatattttttactttttgataacttttaaaaactatcagatatgtgataatcagatagatttcaagtttacttacggtgtaaattaggaaaatttttataaagattctatccagtattgatcaaaagtataaattgtgtgtctttttaagcagcagtttggcaatgacaatcaaattgatactatgtaaaagttttgaaatgttatagctggctactggggtttttatctattccagttctcgaaaatttaccaaatataggttggctgtaaaatcataactatctgaggtatctgtcaataaatcaaagattgcaatgatgatagcttctttaacatgaatgtaattctaacagtaaaaaatttctatatggaatatgttttgtagtcctaaattgatattttatatcatttttcagtgaacaagtagttgtttacaggtgtctgtgcatatgtctcaagtttttctaactaaaatattaatagttaagtctaaaaatatgaattatacgtggggcttgtcattctgacatttaatacttcagcgtggtgataatggtgatataatatactgtttgaaattgtaacacatgagttaaaatcaaaagattgataagtacatatttgtatattgctacatgacaaaaatctaggaagaatatgattcacatgaaaattctttggaaggacatgacagacttttaacagtcctgtatagtgaaaggagaatagaacgactacttctactttctgtatctgaaattttcaaaagctatttcaaaatgaacatttaaacaacaggaaattttagagacaaccactttgtgcctgtcttcatccttgacattcaacatcctaggaacaatgggctgttgtattcaacttcttattcccaacagccattatgaatggtttttgattgatctcacaaagagcatgtgctttagacattaatgcagcgactaccatgaaacagagtattggattacctaaggaaagaagcagaggatggaatttgaggtaggtgtcaaacagtgaaatttcgtttgagaaacagatgagtgaaagaaaatagtaactgaaacattcattctataaggagagtacattttaatactggcgatgctgtatttgtgggtactgactagatcaagatgttagaggaggtgtctcttgggataagttggaagttatccttcattaatttggtataaactgaaaacagattgcttctttccttttaaagtggttgagtctctgatgggtttaaagtaggcctttggggatttatagatcattcaaaattagcaggggaaattttaaatattctctgcatctttctaaaaggtgtggtttaaagttggtgagaaagtgaaatggttgctggttgaacttgattttctctattcactatgcctggctagcctaaaattatcctaatgggtatgttcaggtgcctgatttgtatctaaatgtttctgtattggatactgtttttcttaggcaatcaggatgagtga

SEQ ID NO: 78391 - DNA, 1650 bp, Homo sapiens
ttcatggttgctgttggatcatatctcaggagctggaatgacagacattattgaacaaagaaatcaggatagtggaacttaaagggcttcatctcagtgctttcataagtatgaagtgcatatatttataattttcactaatcacagggtaaatataaaattgattcattaaaaatgtttcataagaattcaaaggacatagaattttgtgaaatgtagtatttttacttaagtgccttttctctgcttctaccccacagccaattttttataaaccagttgataacataagtagtttttgggggatgatacattacttatacattttctatgtagtaaacatgtatgtgtatgtgtgtgggtgtgtgtctaattactttgttggacagattcctgtggtttggaactgctggggccaagtttatacaaaaatctacatttttgagtaaactccccatgactctagtaagtttccacagtatttgagtattctttatttcctaaagctgtacaaacatcagataatcaatatttgtaaggatcgataatataatttataatgaaattgctttatcagctattaatgttaactacatcatcttcatatagccttataactcatttgtgctattccattttcctctgttccttttattttcacttcccttgtaatgttagtctctttgtactgatttctgaagagttcatttatgattaaacatgttaacattttgtctagaattgcaaatatgttttttctcattcattttactatggtgttttattttttggttatacagaagttgtatattgaaatataatcttgttctgttttatgactttggagttttgtggttttttaaaacatgtttacattggtatcatttatttgtattgccttctatttcagcagttagtttgtcatttctttttccattaatcatcattctggtgttaatgaatgcattaaatatttaaagtactcactttgacccgtgtagttatctgttaagttctaccataaagaaaatttccaggtaaaattggctacatttctgttaacttgccttaccattttattgacactttaataattactaatgatttatactgtcttatctattccattgagttctatctcatttctcttctttttcagaatattccctctgtatacttgcatttttttctatcaattgacgcttacaattatttttgcaagttggaaaaaaatgcagtattaatttcatttgcaacaaatttaatagattaattaggagagaatagatatctttaaaattgagtcttctgtccaactgcaaggtaggtctttctatttttaatggaataataatttggggatattgctagtgcagttttttaaagtattttttaatactaggcattttttagttatttgttaatttagtgatttggattagtcattcaacttgtctaattggtatgtgaaaactttttgtatgtcttttctagtaatctttactgaatttctaaaattatgactttcttgaacaatctgtcattttaattaccttgattaaagtacatttgtaagtacttctaggatatatggaagtagaaagtatacttggcaattggactgttaattgcaatccccttaggtcatgg

SEQ ID NO: 78392 - DNA, 1786 bp, Homo sapiens
tcttactgtaacttttaagaagggcatatatctacgtagtgtcatcaccataaagataaatcaaccaagtgaaaatattttgaaactttggaaatgtataaactccaaaatcatcatcagttacatcatcaattatgtccctaaagatcccatcactctgcctcacactggggtcttgcctacttctctgttccaaaagggcacagtagtggtatcaaatctgtttcttgaggcaaatgaagtaccttgctccaaaataatcacccacagcaggcagataacctccaagtgcttcaagctgagattgagcaggaggatcccagctcatcacaactgggtggtaaatatacacttgggcccaaatggaaggaaatgcattaccctacaatgcatacccaacatgcttgcatccaggccccaaatccagcaaaacaatgctattccccttcaacatgtgttaacggaactgagatatttttccaatttaaattgtgttccccaaagtcttcattattctctagtgcctattacaatctgtgtttttatgtttacttcatgactgcctagttccctcctgaaattttaagcctcgtgagagtaagaactatctgttttctttactccactgtcctgtacatacatacttgttgaatgaatgtatgaatgccaccgtgattgcaaagtccaagggaaatgatgttgattcactgcacactgtacaggagggtgtcaaccagacttccagatttctacagaaattaccagtaaagggtagtataagaatggttcctgcatgtgaaaaatgatcttggatggagctgttgtggcattcacctgctcctcatactctcctgccactgtgcagggacagcacaacccccgtgctgctttcttgagtgtagctcatttcagaaaagcagtaaaaggaaaacccacttgtttgctttatgttcctaagaaggtggtgagtaaatcaatcacgttatcctaagaagtgacttgaattttatgaaggctcctttgtttccattgcactcctttctacccatctctactcccacctccacccccaccctcaaatcatgcttataatttccattattcaattaagggtggcttttttctcatcacaaacatctgtgtgctttaaatagcttctacataaccgaagtggaagtagtcatgtagaacagcacatggccactccaggggacatgagaagcctctgcctaaaggtagttctcccttctgtcatctgatctcacacatggcactgcaaacctgcagttatttagccatgtgctttgtgacattgatttcacttccttgggttattcttaccgtctttaggaacttaaatatttaagaaataaacaaatactattcaaagagagctgtaccattattatatgcatttaagtgaaaaactaccacttcccatatatatttatctcatgaccacctaattgataaaaacatgttaactgttatcttatattgcctcagggaaaaagtctgaatgttgattggaggcactgcaggatagccattcgatacctgcttttgtgacaataaactaaagcattggattttggtggattagggataaaaatggcttgacagatcatcttgtccagccctcagtatatagatgagaagacttaggtctcaagctctgaagcgctttgctcaggatcgctggccatttcatatatgtaacaagctcccacttcatgctcatttcacagtagcgtgtcactttcaggtcagcttccttcagtgggcg

SEQ ID NO: 78393 - DNA, 1023 bp, Homo sapiens
gggaaggcaggcaggtcagataatgagggccttatagaccataccaaggactttggacttttattttgcagacgttaagcaaagacataatcacttttcattttatatttattacaaactgaaagagcacaagtgcacatgtggtctttgcagttaagttattgccataattctaaaaaggcagataatctgaagatagaagggaggccacagtccaagacatgctagggactctgattgattcagtgctcatgcatgggaaagataagagtcaaagacaactcccacatttcaggttttgagagctggacggacagtgttgctgttaggtctatagagaagaggagtggattttgaagggaaaattattaatagtacaattgaatgatgttttagttgtgtctgagggatatccagggagagctgtcctaaggcaattaaaaatatgggtctagagaaaaacgtacacagaagataaaaatgtatgactccagcacatagaccatagctgaacctgtggctaggaaaattctcctggaaaaggcagagaggagagaaggacaaggatggaatgcatggaaatgctagcatttgagagttatacacggaacccacagtagaggcaaatgagaaaaagcaggtttgtttttgtctgctccagtagacagacaccaagctccatgagggcagagactttgtcttattcgtggctgtacctgcagtgcatagagcagactgtacatgtgctttgtggacccatgcagttactggggtgtctcagaaacttcccatcctcctccctactgtgtctttgcataaccctggctgggcctcccttttctcaatgtcaactctcactgtaactttttttttttttttttttttttttttgagacggagtctcgctcattgccctggctggagtgcagtggcggaatctcagctcactgcaagctccgcctcccgggttcacgccattctcctgcctcagcttcctgagtagctgggactacaggcgcccgc

SEQ ID NO: 78394 - DNA, 7835 bp, Homo sapiens
aataaaggagaaaggataaataaaatatatacccaaaggcacctggagttaatttttccaaatattcatttcagtctttttcaattcataggattttgtcttttgctcattactgactgcataatgtgattataccatagtttaaatagtcacttcctgttactacacacttgggttttctcaattttttactattgtagtactaatattttactatattgtaatctaatctaaatttttacgtattcagagctgttcaggataaatttgcttggaaatttttaaatcaccagaagtgatactatcctgataattaacttccaagttgtctcttaatatagttttaatgcaaatcataagcttatgttagtaccagtcataatgaatgccaaactgaaaccagtattgtattttttctcattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggtaggtaattattaacttgtgactgtatacctaccgaaaaccttgcattcctcgtcacatacatatgaactgtctttatagtttctgagcacattcgtgattttatatacaaatccccaaatcatattagacaattgagaaaatactttgctgtcattgtgtgaggaaacttttaagaaattgccctagttaaaaattattatggggctcacattggtttggaatcaaattagtgtgattcatttacttttttgattcccagcttgttaattgaaagccatataacatgatcatctatttagaatggttacattgaggctcggaagattatcatttgattgtgctagaatcctgttatcaaatcattttcttagtcatattgccagcagtgtttctaataagcatttaagagcacacactttgcagtcttgtaaaacaggtttgagtattttctccaccttagaggaagttacttgacttctcagtgacctaacctctaaagtgcatttactgatgtcctctctgtggttttgttgtggaaagatttagttaaatgaactgtaagaattcagtacctaaaatggtatctgttatgtagtaaaaactcaatggatacagtatcttatcatcgtcactagctttgagtaatttataggataaaggcaacttggtagttacacaacaaaaagtttatgatttgcattaatgtatagtttgcattgcagaccgtctcaactatatacaatctaaaaataggagcatttaattctaagtgtatttcccatgacttacagttttcctgtttttttccccttttctctatttaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaagaaatgtgtgctcttcagttctcaagttttattattatggtatttattaaagttctacaattgtaataacgtatccatatgacaagttttaaagtggtaattgaaataggttatcagatatagagttgttcacatcaagtagacttttaacagagtcagaatgaacctacccttaaaattttagagaaaaaaaatcgtcggttgcacagaatagctgctctagcttgcttaattatgccgggcatgttgtcactcctcttacttttgctgccttttcattactatttaatggaatgtccctgaacaataaggaagagcaaaacatagacattttgactacagtggatacttcctctaccccaaatgttatgttataaaagtactttttttgcccaggtactctattatatattttggttttctttgaattagacctcaatctccaggaagctctggagggaaaaaaaggaaccataaactaaagtaactggttttccaaataaatgtaaacttttttaaccttttattattatagaacatttcaaacatacataaaacatgaaaacagcctgcagccaaacttttctggaccttggcagctccagcaaatgagctggtcatcctaaccctggtttcctgagacaactacttttggggatgcttgcttgtatagggagatgatagatagatagatacatatcaaaaagaaacttgaaaaaggcttcgaacagaacttgccgatgttactcatccctcctcggtacagacattctgttagaacagatggttgtaatggggcagcatcactccctattcccattaaaaacatgaccattctgagatttcaggccccttcgaggaatttttctcaagaattccatacaaactgtcagaggaagaaatgtcgtcccaagactagtccctgtgtagtcttgatccctttacctgcttactgtaattttttttctctgactttccgccagtgtctaagggccatctgtacccctcccacccttccatgagccactgtataatccaaaaacacaccttccatttgctccctcacttgtctccttttacctcaacagtgttagtgtgtaaagaattgcctggggagggtagagggttttacaagtacagagtcccaagtcttttctcccctccccgttagtgggttggcatttattaataggcactgcaagattttgatgcaggtgtggggtagatatcactgtgaaaggctactaatgcatggtagtttcaccgaaagtacagtcttcaaggatccttataatctcctcattgccaaaatcagtaacatctataaccttgacaacaccctagcttgggctgttgcttctctggctacttgtttttccatcccagtttacccagattttagatggatactcctccaattctgcttaaagtccttacctgttcttgcccagttccctctagtcaacctcagtcactcccaaagattcttccccaatcccatatcttttgctcagacctctgtctctgggatttctttgttacctcatagtcagtagtcctaaaaacaaaattcttcatcttgcatctctatcgaccgaccattctttgtttctttttaagaaatgtaaccttcaccccaatcatcaaaatctctcattcctcaattgtcacaggttgtcacttctttccccctaaacctctcccatcattccttccttctttatactgcccttacaggtcctgatcctctgactcacccggacattcttagcagctgcctaatttcactccctgactctcatctccctcttccaatccttttcattgtgctagaacactatcttgctaattttaatatcctctgcattcagtgcctccacagattgccccctcactgacctttccaatttggccttgtgttacacactttcctcgctgcattcctacccagcatcttcacttgtcatatttctcaaatactcttcatgaccagatatttaaagtacctcatccatgaagacttcatcaacccccaaagtgcctccaatgcttccgtggtagcacagcataatggggtacatttcttagttgaacagtgaggagtcactgggattcttacagagtgtcttagggtctcctcttgatactctttccacatttcagttaaggaattttcttacatctttttttcttctaataacctttgcctggagtgtaagtaaattcatgatagagactgtcatttttaaaaaaaaaaacaaaccattttgcctttcacatgttattacctccatctttctgttatcttgtcagtgttgccacctaaatgattgaaaatgaccgagcatgcagtagaatgtagtgaagtttcctatttcatccattttttgcataagtgcattggtatctgtatatccatctgcccaagcaccagttgttgaaaagactattatttccccatgaatggtcctggtacccttgtcaaagaacagttgaccataaatataagactttctggattctcagtcttactccattgccctatatgtctgtcgttataccagcaccgcactgtcttgatggctgtagcttggtagtaagtttagatttgggatgtgcaagtcctccattttttttttttttttccccaaaatcattttgtctgttttgggtcccttgcattgcatatgaatttttatatgatcattgtgtcaattcctgcaaaacagctgggatcttgatagggatttagttgaattggtagataaatttgagaaataactgctattttaatggtgttaggttttctgttccatgactgtgggatgtctttgcatttgcttaggtctttatttcagtgatgttttagagatttcagtgtgcaagtcttgacgtctttaatttttttctaagtattttactgatgccactttaattatatgattattttctaatttttatttttgtattcatcactggtgttagaaataaaattaatttttgtatattgattttgtatattgtagcttttctaaaattctttttttgtcacttagtattttttgcatatgagatcatgcatctgtgaacagaaatacttttacttcttcctttccagtctagattcctattatttcattttcttgccttagtgtgctggctagcacctccagtacaatattggatagaagtgacaagagcagacatctttttcttgttcctgattttaaggggaaagcattcagtctttcaccattgagtatgatgttagctagctgtgggtttgcttcaagttgaggaaattcttttattaaacctagtttactgagtgttttttaatcaaaaaaaaaaaaaggaggggctgtgggttttgttaaatgcttcttctgtatcaagattttcatgttgttttgtcctttattaatatgttgtattaatggacttttgtatattgaattaactttgcattcctgggataatctcagttgtccatgctacataaaccttgttctatgctgctggatttggtttgctagtattttgtttagaatgtttgcatctatattcataaggaatattggtctgtagttttcatattatatatctgtccagtttggggatgagagtcatactcctgacagaatgaattgggagctttccctgttcttaaacctactgaggtattttttaagtgaactacttggagaccttcacctgtgatcttcagatgctgggggacacagggatggtacctgactctgaaaaggctctcagggtaagacgtgtctgaactggcctgtggcagttaactaaagagtactcctaccaataatggagtcaagatgtatgtttcccataggccacgctggtcactgaaagagatgggctatgagccatcttgaaaactaccctgcacaaatggactgccggcctggagccaggcaccctgcagctgagtgccatataatgttgaagctgttgagggaggagaggttggaagctgccagcttagagaatctcagctgtggtttccagcagggtgtattccaggaaagaaagtcattccccaccctggctcaaagtaataattaacagtgactgggtaaggcaggatctttttttctaattccctcccctccagaaagggcagcaacagctcttgaatgggaaagaaggtggagggaggaaaagaaaaaccaattgccccaacactgctgtctttaagcttcccacccaaagacctcagtaagaggcagaattatgttttcaattaagagagagtttggcctcttggtgtttcaaaagtgtaggctttttaatacctagagaaactgatgatttgttgattaccaaaaagggaccagaaaagctacatagcctgagatttcatccccagaaaaacgaatccagagagcagacttgcaaaaaaaaaa

SEQ ID NO: 78395 - DNA, 1964 bp, Homo sapiens
cttcctggtttgcttaaatcaaatatattgtactctcttaaaacggttggcatttataaatagatggatacatggtttaaatgtgtctgtttacatacctagttgagagaacctaaagaattttctgcgtctccagcatttatattcagttctgtttaatacattatcgaaattgacatttataagtatgacagttttgtgtatatggccttttcatagcttaatattggctgtaacagagaattgtgaaattgtaagaagtagttttctttgtaggtgtaaaattgaatttttaagaatattcttgacagttttatgtatatggccttttcatagcttaatattggctataacagagaattgtgaaattgttaagaagtaggtgtaaaattgaatttttaagaatattcttgaatgtttttttcttggaaaaattaaaaagctatgcagcccaataacttgtgttttgtttgcatagcatattataagaagttcttgtgattaatgttttctacaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccgggtaagaaagcaggtgtctgcaaaaagtcatgtatcgatttattgtttgtaatgatacagtagtatagcagataactaagacatattttcttgaatttgcagaatctagatttccaagcactagaagaaactacagaatatgacggtggctataccagggactctgttctgattaggtgaggtacttagttcttcagaggaagatttgattcaccaaaggggtgtgtgattttgcttcagacctttatctctaggtactaattcccaaataagcaaactcacaaattgtcatctatatacttagatttgtatttgtaatataatcaccatttttcagagctaatcttgtgatttatttcatgaatgaagtgttgttatatataagtctcatgtaatctcctgcatttggcgtatggattatctagtattcctcactggttagagtatgcttactgctggttagaagataattaaaataaggctaccatgtctgcaatttttcctttcttttgaactctgcatttgtgaactgttacatggcttcccaggatcaagcactttttgagtgaaatggtagtcttttatttaattcttaagataatatgtccagatacatactagtatttccattttacaccctaaaaaactaagccctgaattctcacagaaagatgtagaggttcccagttctatctgcttttaagcaaatgcccttactactctactgtctacttctgtgtactacatcatccaattctgaaagacataggcttccccatcccctgctaagactggttcaagtggcagctactgatggattgcagtgagaaggcatgcaaacacgtaccttcctggaagttgtctccaaaggctattgctctaagactcaagtatataaacactagaatgaatatcaactctatctagcaataaatgttatttttatattacagttgacccttgaacaacacagctgtgaacttcatgggccctctgacatgcagattttttttctcaactaagagcagattcagtattggtgggactcagaacctgcatatacagagggctgactttcatacatgccagtttcacagggccaactgcagaacttgagcgtgcatggattttggtatacacacgtggtcctggaaccaatccctgtcacatataccaagggatggctgtatgttactttatattcatttgttctgttattttataaggttgttcgtcgtggtatgtgggaattcaccagtatttcttctttctggtgcaccgttggtcatttc

SEQ ID NO: 78396 - DNA, 1050 bp, Homo sapiens
gaccgaagtaccagaaacacttaaaaactcaaagggggacatttttatatattgctgtcagcacgaagcttttgtaagattgatttcatagagaagtgtttctaaacattttgtttgtgttttagtgaaatcttaagagataggtaaaaatcagagtagccctggctaagggtcttggtagttacaacgagtgtgcctgctcctaccacccccacccccaccttgagacaccacagaatttctcatagagcacagtgtgaattctattgctaaattggtggtatggggtttctcagcagagaatgggacatcacagtgactgacaatctttcttttataggttggaaactatttgggggactggagggatactgtctacactttttacaatttttattgataagatttttgttgtcttctaagaagagtgatataaattatttgttgtattttgtagttctatggtggcctcaatttaccatttctggttgctaggttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggtaataaatgtttttatgtcacattttgtctcttcattaacactttcaaagcatgtatgcttataatttttaaagaagtatctaatatagtctgtacaaaaaaaaaacaagtaactaagtttatgtaaatgctagagtccacttttctaaatcttggatataagttggtatgaaagcacacagttgggcactaaagccccttttagagaaagaggacatgaagcaggagatagttaatagctaagtgtggttgtagtataaagcaagaagcagggtgtttcttgtattaagctgtaagcaggaacctcatgattaaggtctttatcacagaacaaataaaaattacatttaatttacacatgtatatcctgtttgtgataaaaatacatt

SEQ ID NO: 78397 - DNA, 1211 bp, Homo sapiens
tattggaaattacagatttttttcagacttaattcttaagatgttttcattgtttcacagtagcaactaaacatgtagtaaaatgatttaaattcaattaaaatttttttccttagtcatttaaaagggaagaaatcaatttttagtagtactcattccaaagattccaattttccttttttttaatcttttattttttggtggagggaggcaggatctggctctgaggcccaggctggagtgtagtggttctgtctcggctcactgcaacctccacctcccaggctgaagactcaaaccatccccatgcatcaccctctcaagtagctgagactataggcacatgctaccacacccagcttattttttgtgtttttgtagagatggggtttctccatcttgcccaggctggtcttgaactcctgagctcaagtgatctgcctgcctcagcctccccaaagtgctgggattacaggtgtgaactaccacaccgggccccaattttccaatgagtgatataaaaaaggcctccacgcaggcgcctgtagtcccaactactccggaggctgaggccagagaatggcatgaacccgggaggcggagcttgcactaagctgagtgctgctgcactccagcttgggcgacagagcgagaccgtctcaaaaaaaaaaaaaaaaaaaaaagcctccatgattggggcttgcatagtgaagaccatgtgaaattgaaagactacgaaactacttttcttttacgtattggcccataattaacatgtgtattgaatagctttgtttatctaagttcatcagatttatccaggtttatgtatttcagatcatctgattttattaggaaaatgctagaaaaatttcatggcaccattgtctaattttgaaaaaacgaacctttctttactgtgattaaaaattgttttttaggccaggtgtggtggctcacgcctgtaatcccagcactttgggaggctgaggctggcagatcacgaggtcaagaggttgagaccatcctggcaaacatggtgaaaccccttctctactaaaaatacaaaaattagctggcgtggtggtgcacacctgtagtcctagctactcaggaggctgaggcaggagaattgtttgaacctaggaggcagaggttgcagtgagctgagatcgtgccactccagcccaccctgggtaacagagcgagac

SEQ ID NO: 78398 - DNA, 1058 bp, Homo sapiens
ttagtattcagtgtatttttcttaattgaaatattttacttatgacttagtagatactaagacttaacccttgagtttctattctaataaaggactactaatgaacaattttgaggttagacctctactccattgtttttgctgaaatgatttagctgcttttccatgtcctgtgtagtccagacttaacacacaagtaataaaatcttaattaattgtatgttaatttcataacaaatcagtaaagttagctttttactatgctagtgtctgttttgtgtctgtctttttgattatctttaagactgaatctttgtcttcactggctttttatcagtttgctttctgtttccatttacatacaaaaagtcaaaaatttgtatttgtttcctaatcctactccttgtttttattttgtttttttcctgatactagcaatcatcttcttttcatgtttatcttttcaatcactagctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtaaatacattagtaatgtgattatggtgtcgtatcatcttttgagttagttatttgtttatcttactttgtaaatattttcagctatgaagagcagcaaaagaaggatttggtatggattacccagaatcacacatcatgactgaatttgtaggttttaggaactgatttgtatcactaatttattcaaattcttttatttcttagaaggaatattctaatgaaggaaattatctctttggtaaactgaattgaaagcactttagaatggtatattggaacagttggagggatttctttgctttttgttgtctaaaaccatcatcaaactcacggttttcctgacctgtgaacttcaaagaacaatggtttgaagagtattgagagactgtctcacaagtatgtcatgctcaaagttcagaaacactagctgatatca

SEQ ID NO: 78399 - DNA, 1027 bp, Homo sapiens
tcattgaagagagtgagtaaagcatagtagttaagagcttgtttcctggattagtatctctgttccacaacttactgtgacttactgtgacttgaagttatttcacctttcagtatcttggggtccttatctgtaaagtggagttaatgtttccttcctcataagggtgttgtgaagattaaattagttgctatgtgtgaaatgctacaaaagtgctatatattattgttgctgtattcatggaatatttttgttctataatgctatggtaggttttcagaaaatattttagaaccaataaaataacagcaacaacagctagtacttttaagcactaactttatgcagggaattaatctaagcagttcatacattaatttattactatattattatggttattttacagatgaaataagagaggtaaagttgtatgtttgcatttacaatagaacatattgcattgcattacattcttttggcaccaaggtggggagcatagaatagagatcagtggaagtggacagacatgtaatattttatggagaataaagataaatttgcttcagttatcatttgacatgtcttaggtagagctaagactagatagaacacagggcctctcaatcctgtagaaattcaccaccacatcctttaaaaggttttacattgataaggagtcagctctcatctatgaatgttagtggggaaaagctgtagaatgcacagtctaaataccagataaccttttttttccccactttggaatacattatatttgataaaagcaagtatacctttggatgtaaaggtaaatataaacactgacttacatctttaacacctagccagttgggaactggcataaggaaactcagaatggattacatggcaatatggaatgttggcctggtcccacatttgagctaagatgttaattctaattttagtctcctcagaattctgtatactccgtagcttgaaacaggtttccaactgaaactatttttttccccaaggttatttt

SEQ ID NO: 78400 - DNA, 1105 bp, Homo sapiens
gtggacggcactgcctggctgtggtagtttcttcccacttaaaaattcatagagacaactctgggtcttggaacttctggaaaacagcagctattccaaaaatctggggattagtggtgcctgtaacatcaagtccagggagattgagcagggaaatactggaaactcaggtactcatcctaacttcctggttttccagatggggttgccatttgttccttttctttcctccacaagataattttagtgtatctgtttaagaatataagagtggccagaagacagaaagcagtcgtcagtcacatttcaccaaaatttacatttgtctcaggtgcattatcgcagagctttattgtatttctagtattagctatccctgtcattgctgctacttttttatcatcttcaagtaaaatttaatgtcaacaaaaattaaggtagttaataatactatagtatactagtaaagttgtctgacacagacaactaggaaatgtgatttttactttaaaatgtattttagttttagaatgtctaaattttagttttagaattgtctaaattcgagaattcataaagctgtagcccggtggaaaaagttatttgacatctcagaaattaaaaattgcagagattttgtgtgttttttttttttttgttactggtttgttttttttttttaatgtcagatatgtttatagtgttggagaaagattctgcattatttaagcaactcaggtggttttctagcagagacaaaagggggctttaactgcctgaagtcattattattgcttgctttctggtaccctttttatttcacttacatagttttgagacacatgaataattaatacacttaatgactgatcataaggcagccagcaccttactttacatagtttagcagaatgatagggtattttataagaatgtgagtgatgttttatgaaaggtatgttgaggtctgtctatgactatccattgttggagcagaactgcaaatgccaaagctacatactttatgtttggcttcttgaggtgagatcccttcagctgtcttcatcaaaagctatgtctagcctttaaaaggcaatgaaattac

SEQ ID NO: 78401 - DNA, 2188 bp, Homo sapiens
tttttttaagaccttgccttcttagtctttggagaacagagtactgaaacaagaaaactcacagattagtagtatttctgtgtgttctacagtgaggttttaagagctgtattatgattaatcagtacatgacatattggttcatatttataattaaagctatacattaatagatatcttgattataaagaaagtttaaactcatgatcttattaagagttatacattgttgaaagaatgtaaaagcatgggtgaggtcattggtataggtaggtagttcattgaaaaaaataggtaagcattaaattttgtttgctgaatctaagtattagatactttaagagttgtatatcataaatgatattgagcctagaatgtttggctgttttacttttagaactttttgcaacagagtaaacatacatattatgaaaataaatgttctcttttttcctctgattttctagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccgggtaagttgggctgctagattaaaaacctaataatggggatatcatgatacagttcagtgaattcattttaaaagtgactgaaaaaaatgataccatatagcataggaacacatggacatttctgatcttatataagtattatacttttgttgttcctgtgcaagtttatagatgtgttctacaaagtatcggttgtattatataatggtcatgctatctttgaaaaagaatgggttttctaaatcttgaaaactaaatccaaagtttctttcattcagaagagaatagagtgttggacaaagaccagaacaagagaaatgtggagatacccaataataagtgtggatgtgcagtcttgaactgggagtaatggtacagtaaaaccataccataaaattataggtagtgtccaaaaaattccatcgtgtaaaattcagagttgcattattgtggacttgatgaagtgaccatggc

SEQ ID NO: 78402 - DNA, 1020 bp, Homo sapiens
aaaatgtctttctcagtagaacacctgtatcaataaaccaaactttttgaatgttcatatctaattacagtgttttttgactaatttttatctatatacctgaaaaattcagtttaacatattaaacactacaggccaggcacagtggctcacgcctgtaatcccagcactttgggaggctgaggcgggcgaatcacgacgtcaagagatcgagaccaacctggccaacgtggtgaaaccccctctctactaaaaatacaaaaaaattagccagttgtggtggcgtgcatctgtagtcccagctacttgggaggctgaggtaggagaatcgtttgaacccgggaggcagaagttgcagtgagccgaaatggtgccactgcattccaacctggcaacagagtgagactccatgtcaaaaaacaacaacaaaaaacactccttggaaaaagtataggtacattctatataggattagtagactgtcagaatcacttgaagatgttccgaaagcatgacatatcaacaaaggacatgtgagtctagaatggtgatccctaggacaggccatattactgcatgcaaagcaagtctttgttaaccttatgacttgctcaggaagcaaagtgtttcatgtcctaataggatagtagtattttctgttatgttacattttaggaaattaggagttttgcattgtcttgtaagaaggtattttaaaaattttcaatgaaaataatgagaaataggtttccagtggttttatgcttttggggaagaggttactgatgtttagcaaaagatgcttatatattcttaatagaacaaacctgagaattagttcttaaagagttaaggcccataaaagaaactgtaagtgttggtactcttgtagctgggccacagatcagatccttagtatgataaaatttggtatttttgtgcttcaatttttggagaccattcaatgatcacttacattttatattgtctttcattgtgaaacatatattatagcagagg

SEQ ID NO: 78403 - DNA, 1206 bp, Homo sapiens
aattattttgaaatgaatcaccttctgcaaaacaatatagtcaaaatgacttagactctgaagctgaaagactcctggactcctattcttgtcttggttctgtactttctttgagatcttggtttcgtgatttgactccagttctatttctctctttggctgtggactgaagataatcctcaatgtcatggtattcaaatgagataacccatgtcaaagtgccccgcagtgtgtgtaataagttatcaggcatccagcaaatactagtttcttgctcacctccctattacataaaataactttaaaattagaactgaagggactcataaagctgggaaaactgaggcccagacaattgtttccctaggatcctacagctgcttagggacagaaggatgacacttaatgcagatcttctgatttttcagtctcgttctgtttgtgctgatcactctcctcctatgtagtatataaagaagtactatgtatctgacaagttttggggaggttattttagtataaaagctcacattaaaaatatctattttggtattttgacttttgtaatttttttaaaaatcagagacaatttagtaaatctcggggccattcaaatcatgtatatgaagttttataactgctattgttttccccttatagttattaatttttaatatgcaagtagcatccttactatggaaagaataaataagaaatcaaaagatggaagaagttttaaaactcacttaatcacatcatccagagaaaatgctattaatgctttgaaataacaatgggttcatcctacacctgctactttttaactgacttttgtcagttagtgatatatcaggaagactaggcagttctttgtcgaattcaaatcttgatagtttttattttattgtgtgacctattatcagttcatttaagtaatcttttattagacatgtttttttcagatatagaaacaatgcatttttgtaaaattgtcaaattattttccacaagtaggatctcattcacacggtattcgtgtttttaagactttcgatacatgttcactgttttcctccagaaaggaaatacctacttacattttcaccagggaagtcactgtagtttgggagaacatgacattatctccctttctttactgaagggtagcaatatatattttaaattttctagattctgcatttccat

SEQ ID NO: 78404 - DNA, 1639 bp, Homo sapiens
tgtcaaacgtgtatttttaataaccttgcaagagagaaaggattgaagagaaacgtgtggtggtaaggtagttcagtcagtgagagccttgacaatgacagtggtataataggaattcaaaataaatttttctggatttaagacaaatatttaggacatgaagtaagtaagactttagtgatttattgtgaagactaaagatgtttcagataatagaggtagtaattatcaaagcaaagtttttcgaggtattaagggttggaatgaaaaatacaggtgtatctctcatacaggtaatataaaaaaagaaaaatgcagatatagtgattgaccttgaataagaggaaagatgcccatctaatgaaattagaacaaggaagtaaagatggatgtgtgatattaattgtaattgtgggtgagggtggaaaaatcaagatttttttactgaaaatattggaaccttatttaaatgccggtatatattgtgaatctgcaagaaacgactataaaatgtatttctcaaatttatgtgacccaaccatgtgacttgtcttttaagctttaaaaaattgtagtaaaatacacataatgtaaaattttccatttcaccatttttaagtatttggctcaatggtattaagtatattaatattgttgcacagtcacgatcagaactctctgttttgcagaactgaaactctgtacccattaaacaataattcctcatttccttatcttcacagcctctgacaaccattattctactttgtgtctaattttgactgctctaagtaccccctataagtgcaatcatacagtttttgcccttttatgattggcttattttacttcgcagtgtcatcaagtttcatccatctttagcatgtttcaaaatttgcatcctttttcaggctgaataatgttttattgtatgtatataccacattttgcttatccatttacctgttgatgagcgctcaggttgcttccatgttgtagctattacagataatgttgctatgaacaggagtgtacaaatatctttttgagaccctgctttgaattgttttcccagaagtggaattgttggatcatatggtaattttatttttaaaattttgagaaactgccatactcttccagagcaactgtacctatttgcgtttctaccactagtgcacaaggggtccagtttctctacatccttgccatcacatattgtgtgagagtgtgtgtgtgtgtgtacttcaatagtagtcattgtagtggatataaggtagtatgttactgtaggttagtgaccacgaaactttttatgaaacattttttaataatattttgtggaatacaaggtttgtttagaggttttgagaagactgaaaacttaggaagctactgaggggaatgggtgaagaagtggatcagaagttgagagtcttgactggctggctacctgaaatcagaaaccgtatcagagtaggagaatctcattccactgagtgactagttaagattaaagactttatcacatttgaaatttaaagacttttctccaatagccagaagattatgcatggtattttagggttggatattagcagagctgatggaacagaatcattagtggcatgtgcataag

SEQ ID NO: 78405 - DNA, 1004 bp, Homo sapiens
ccaaggtattagattttagtttgaattgtctggagtagcggtagcggttggcacatttgttcttaaagggccagaaaataaatattttaggctttatgggccatgtggtttctgccacaagtcctcagctctgttcttttagtgtgaaagcagccatagatgatacctaaatgaatgagtatggctgcatcccaataaaacttcatttacaaaactacatggctggcctaagctttagtctgtctgcctagggagtagtttactgagccactaatctaaagtttaatactgtgagtgaataccagtgagtacctttgttaatgtggataaccaatacttggctataggaagttttttagttgtgtgttttattacacgtatttgactttgtgaataattatggcttataatggcttgtctgttggtatctatgtatagcgtttacagtttcctttaaaaaacatgcattgagttttttaatagtccaacccttaaaataaatgtgttgtatggccacctgatctgaccactttctttcatgttgacatctttaattttaaaactgttttatttagtgcttaaatcttgtttacaaaattgtcttcctaagtaatatgtctacctttttttttggaatatggaatattttgctaactgtttctcaattgcattttacagatcaggagaacctcagtctgacgacattgaagctagccgaatgtaagtgtaacttggttgagactgtggttcttattttgagttgccctagactgctttaaattacgtcacattatttggaaataatttctggttaaaagaaaggaatcatttagcagtaaatgggagataggaacatacctactttttttcctatcagataactctaaacctcggtaacagtttactaggtttctactactagatagataaatgcacacgcctaaattcttagtctttttgcttccctggtagcagttgtagggaaatagggaggttgaggaaag

SEQ ID NO: 78406 - DNA, 1706 bp, Homo sapiens
cggctaagagacgaggtttcatcatgttgcccaggttgaccttgaactcctgagctcaagtggtccttatgtcttgacctcccaaagtgctgagattacagacatgaactaccacacctggcatatgtcatagttttgagagtttgaattctaacctcgggactttggtaacttatttataatattctagaaatatactgttattaggatgagtagaaattcattcagacagaaactattataaattactgcaagaaaaatgtctgctagttctgcatatattcatttttctcttgattaaaaaacaatttccaatttgagtagaacaactttgctatgtttaatagacccaggacagatttattttaaggtaataatctttcaatccttcttcttctatactggattggtttaaattacttagcttgtcttatcaatggtttttaatagcctactttaatatatgtaaaaagtagtaattaatatgttacagtttggtggcaaacattttgatgccaaagttcacatattctcttgcttagggaacagaaattgggaagatagatgtagttatcatttgataatgtatttaaactctatcccatttcaggatctcaaaactttgtaacagttacatattgtacttctaagacttagatttgtttttcttcttgtgtcttacctttttgcagtaatatttttattttcctatcatcatgtcctcattttttccctctcttctctttccctgttaattttgaaagttttgctgcctacgtgtttgaaaacttctaatctgcctctcttccctcagtgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccaggtgtgtcacataggtgatttgcttgctccctgggggagagggtggagtgaaatttttgcatttgtgtcacagccaagtcactgccacctccagcatgccccagtttttagttgttatgtaattttgtgcaaaattgaaaatttaaatacattgcaaagaagatctaaaataaatatttgagctgctggagtcttttttttttttttttttccttttccattcttgtccttggaatctgaatgaattgcagtgagggtaattttgagagtctgataaagaagtgaggggttgttttttgtttttgtttttgtttttagctaagaaatttagaaaacaggtttgtgtgtgtgcgtgtgtgtgtgtgtgtgtgtgtgtgtgactgattttaagattcttgttagagttgcttaaagttggaagcctaaagtcagtgagaagttcacaaatcaggactttgtaatgccaatttgaaaatttagcttttgacctcaaaaaacattttttatctagtttgggaatttctaagtgttagaaatcaatattatattgactcattcattgttgctgatgctgtttataaaagtgaatagatagggaaatactgattcatatctcgtgaaatgaaaatgaaaggctttttagtgacttagaattttaaatatttctacatgagagagcagtagtatatttagaaat

SEQ ID NO: 78407 - DNA, 3798 bp, Homo sapiens
gaaggcagggcttcttaaaatgagatctgtgtgtcatgtgaagtatatgttaaaatgcaaattcatttctgcgttcttgggttggtctgaaaaaaattaaaaaaaaaattcatttacccctacttcatgcactgaatgaaaatctttgcgagtagagcccaagtagttgcatttttagatttccccaggtaattctattatagactgaagtttgaaagtcagtctctaaaaccttaaaagttggttaattttatttcaaaatgttttatatgcagtgtattcactttctaccatcaacctctaggacactggataggtttcttaacctttgagatttgctttctttatatgtaatgcagtacatgaaaggactttatttttgttccattgaggaatgttctgattgtatacaaacaagttaagaatttacagtgataatttaggggcttgctttaagcttcaggatttttttttaagagttaagttttgatatatattaagtggttgatttaataaattataattatcgtcgtatattgaagtcctgttttgtgccaggtaggcattatactataactttttaacgcattttctctgctacaataacctgacattggagactcaagggtcagagggtcggcccaaggctgctactctagaaagtggtagatgcccagatttgtacctaacatagccgatgcttagcatatagaatttaattaaaaacaaaattgctataggtatttgaaaggattagagggatatagtcaaatagttttcatatgtgtttagcccttttggagggaggatagagtaaataaatagaaggcactaagctttatggatgaatatgggaaatatggctttgcctgctgaaagcactcaggccacagggcctgcctacctatgctttcctcatcccggcaacagcagtaatttgtttcttgatacgtttttggatgttcataattatagaaaataaatttgcctttatgatgaaatttagtacctttttttttgaaagttcatccagttgtttatgtaaaaagaattgagtgaggtgttttatattttaggttaaaaatctgtaagagcctgattttagaattcaccagctcctcagaagtttggcgaaatatggtatgtttttgttttattttttggaattcgtattgcatgtgtatcttaatgtcataataatgacagatgtgttcagcaaatttgggcccctgccatttttaaagcattgtgtcaggtgctcactaactacacttccaagactgtatgagggacccaggtagggtgctgaaaaaatttacaagagattagtgtgctatgagaggtaaaataatatgcataaaaagattgagagggcaggtttggattttgggctatgagtattaataatagctttcatttgttgttgttgttgctgctgctgctgctgctgttgtttttgagacagagtcttgctctgttgcccaggctggagtgcagtggcaccttcttgactcactgcaacgtccatctcccaggttcaagtgattctcatgccttggcctcccaggtagctgggattacaggcgtgtgccaccacacctggctaagttttgtatttttagtagagacggggtttcaccgtgttggccaggctagtctcgaactcctggcctcaagtgatccacccgccttggcctcccaaagtgctgggattacaggcgttagccaccacgcccagccatttgtgagcacattatgtcaggcactgttctgagatacttagatgttagcttgtttatccatgacagctctatggaataggtactattatcctagttctacctataaggaaactgagactcggagaggttaagtaacttgcccaagatttctcagctagtgaatgaccaaacagagacataagtccagcctggccttggagccttttgagcaccggatctcataaaagaggggactggaagagaggacttgactctagttttcaaaatacatatagctctttaattacattgaggtcaattagtcaattaaaagatattttaactttattatttttgtgtttacaagatggaaagttagacttgtttgaatcttctaattccacataccattagtctcttgagaacccaaggggaagctgtatcatgaccacattgtttattttagggaaggtggtgtttcccatatgacctcagcaatgtctaagttcttattaggcaatgtatagttaggataggagtatctgggagattgcgttatttcttacagatactataaatcccatttattggaatcccctgcaattatttttatatattcaggccaatcctcacctaatctggattttgaagccctgcgttcatagctgcataggtatgggctcaaacattcatgttttaaccgttggtattcgcagataccttgctgttttatattgggttctgaatccacactggtaaccaccttttacgcttgactattgttgctttgaggatgttaattatgaaaggtttcttcctcctaatttcctcatctttccgtagttgatgcctcagatttggcctggataggggaatcgtgaggggaaagaactagttgcacaaaatgatcttttgatactgggatatttcagatgtatggtatctttgccagaactacagtgtcagtaaagaggcctgctaaatttgaactgtgacaatcagaaaagttcagctaaggccatgtaaggggttaaaaagatatttggttgagggaggaggatatgctttcatcttttgccatactttttcatgaaattaaatcttagtagatttatggccaagaaagagtagaatatatttttatgcagtacttaaggggttttgactgatgttttttattattattatactttaagttttagggtacatgtgcacaatgtgcaggttagttacatatgtatacatgtgccatgctggtgtgctgcacccattaactcgtcatttagcattaggtatatttcctaatgctatccctccccttccccccaccccacaacagtccccagagtgtgatgttccccttcctgtgtccatgtgttctcattgttcagttcccacctgtgagtgagaacatgcggtgactgatgttaaatgactttacgtacatacagaattagtgggactagactttgtgtttatgtgtgtgtgtttatgtgtatgtatataactattccattaagcagttgccctccttggtgactgattgctctatcagcttaggaatcttttgactgaatttgtccgtatttgaaagatctcaatctgtgttctgaatctttactcatttacatatacttaaatcttgaaacccagtatagcaaaactaagccaaaacaaacaaaaaaatccatcccttgataggaagtcagtatatctgggttttagtcagtccttcaacactagttccaaaatcttgggcaagtcagttaatcactcggaggctgcttaattttttttttttttaattcttagtatattatctgtcttgattaggtaaagccaaagttgttataagactcaaggtactattgaccaaaatgcttcagaaactataacattacataaaagtacaaggaattattacattttctcaaatgaagagatcatttaagaaaaacaaaatgctggaaaatagtccttaaaaacttttctataataattactcttctgatgaattttacattgacacctaatttgaagctttgaatattattttttgaacaatgaattgggttta

SEQ ID NO: 78408 - DNA, 1607 bp, Homo sapiens
ttaaattggcatttacttatatttgtgttaatttgggaagaaatggtatctttgttcatctatgagtcacatttggaactagctcaaaggccatgggtcctgattccttttttttttttttttttttcttgtagaggggaggtatggtgtcaagaaaacatagtcaccattattacgaaaagtaaaatatggaagagatgatccctaccatcaatcagcttacaactagaggcactgacaaatgtatacagatagctgtaatgtaaggtataacataataaatataaggagaaattaataaattattttatggtattaagaatgtataataagacatgaaggagatggtgattatgtataagagtttagataaccctgtgagatacagtgtttagaatgaggccagtttttaacatggcatgataggtgggtgggggatagaggttagtaatggatagaggaccatttccgagtgaagtctcctcagaagcaaaagcattgaagtcagaaacacaaatatccagtacattatagccaatagtcaaatgatgggactagatctggtaactggtgatgatgtcatatagtgggcagtagtgctgggatggctggggtcagggccacatggcaggggcctcaaataaaatgtgaaggagttagaaatttattctgttggcatgagaaagtgttaaagcttttgaatatagaatgatatgtgtaactttgagtttttaggaagataattctagtggcaaagttgaggataaaggcaaaagggaaaccagatgaaataatggggcactgtagtaggacagtgttggtaagtttgaggaaaaaaggagtaagagatatttttaaggaaattcatagggtttgagtataaattagaaggcaagtacaagggaataagcgtggtctttagaatcagacaaattagggtttgaatcttaaccttgcatttactaaaggactgaaagctagttccctaagagaaaaattttctcttttgtaagatgcttattctataaacatttgcaagcactggaagtataaaagcaaatgatacacatgttctcttgaagtctggtctagtctgtaagaagaggctgcactggcaggttttgaccaaattgtgtagaatctcatctgacgtgattgggagctttggctttattctggaagcaactaaaagcaatcaaaaaagactggggaataatgtgagaatgtagaaatgtaggggaatttctaaggatgaattggtagcaattggtaaacaatttgatatactgggaaagagagagactctttagaatatgactgagaatcttccaatttgagcagctggactgatagtgctaccatcattacctcacagggtttttcttagtgtgtcttgtaaatcttgcttgtccctcataaagaatggttttccttttcttcagactaaggactttttattacagtacacaacttaacaccccctgtatctctccatcacaacacttaactgtgcattgttattgcataattaattgtggtttttatttgtgcccatttccttcaccacatgagggcaagaaattatgtctagtttttctacctctgca

SEQ ID NO: 78409 - DNA, 2310 bp, Homo sapiens
tctaaagctcatgttaaactcatgttctttattttcttctcagatgattcctttggcactgcatgtaacagtacaggaatttcttcctttcgtacttccaacaaatacttttttgtctcttaacagatgtgaaccataatgctgttctttagaaagcaaaggatgaagtgcacagcagtgttttctatataaagctaatgggtcataaggggaaatatgggttatttccagcttgttaattgtcttaatacatttttcctaagaattctattgtgcctctgtggttatatgcaccaatattgataatcttacagcgtgccataaataaggatttttatattatctttgctaaatattttaagtttttgttttgggaattgaaaaaatcttttgtgcatctatggtatgtgatacgtatactaatggataaatcctgtttcacacaaagattaattgggtaacatttttctttcctagttttctgaagtcagtggtcatgttgtgtgttggtgattgaaaatatgctgtttaggctgggcgccttggctcactcctgtaatcccagcactttgggaggccgaggcacacggatcacctgaggtcaggagttcgagaccagcctggccaacatggtgaaaccctgtctctactaaaaatacaaaaattagctaggcgtggtggcacacgtctgtaatcccagttacttgggaggctgaggcacgagaatcgcttgaacctgggaggcagaggttgcagtgagctgagatcacaccattgcactccagcctgggcaagcaagatttcatctcaaaaaagaaaagaaaagaaaagaaaatatgctgtttaagatcattcaaattcagtttctaagaagtgtaaagttttcctaattacttaagctgcttcattctcattcccttttgtaacacattttgccatctctgtaacatgttgaacatgtttaaagaacagagtgggagaataggaagttacgtggataaagtttggtaatcaaggtaggaatacatcctgcttcacagaatgggaatatttctgaaaagttgactgtagtattgaagaacacttaagtgtagtgtattagacgaactgagctaattttggtcttttatacacataaatcaagatttctgcatttcaaatcatgcatatttctttaaatttattgctcagtgtactgtatttcaaatattgtaaaaatgaaaagatcttgtggtcttatttaactcagtatgggataagtccttcccaccttcccattcttattccctcttttaggctgaatgaaaggctgggggagtgaatttaaaaatagatggatctcagctggagaatgggttggtcacgtatctcaactgatattaaataatttcttaaatcctggattgaagattataagaaaacagtaaatgtttgctctcagttcatttctttgttttgttttttcatgtacagttttaggcacttgtaactgctggatgcatgaactactttctagttctttcaggcctacttttagatatctgctgtggggacagtcctcaacacttaaagtaattttaaatagtgataggcagaactaggggtcagttttactgcctatgcctgtgctgaatttgacatggcattcctaggaggggaggtggaacgagggcggtgcacacattgtccatattgctagtcagtgccagattttgagaaactggggctaatctctctcttaaatggtcaagatctaattccccaaagtgctgtttcagataacctagtatttgtccaaaattgccctgctacaatagtatttatcttatatatatgtattatatatataatatatatataatcttatatatatgtattatatatattatatatataatcttatatatgtattatatatataatatatatataatcttatatatatgtattatatatataatatatatataatcttatatatatgtattatatatataatatatatataatcttatatatatgtattatatatataatatatatataatcttatatatatgtattatatatataatatatatataatcttatatatatgtattatatatatataatacatataaatatatatatatatatatatataggtttttttttgtttttcctcctgagatgtagtctcgccctgttgcccaggctggtgtgcaatggtgcagtcttagctcactgcagcctccgcctcctgggttcaagtgattctcctgcctcagcctcctgagtagcagagactacaggtgtgcactaccacgc

SEQ ID NO: 78410 - DNA, 1100 bp, Homo sapiens
tcctcctgtggcttctatgagctgagctaagtacaggacccacaaagacaagaaagatgtctgtcttttttgaatgcttatagttgagtgactttctcacatttgtgtgtgtgtgtgtgtgtgtgtgtgtgtaaaaccctatcacataatggaacttcattttcccatgcccttccaatctaagagcagttctatggactcaatacctcctacccaccagctgctactgtaaagatttacttttttactccttttaaaaagttcaaccctctggcacatgcattacttcattccttggtcccagcccaccaccccagtatctggcacgtagtgtattagtatttgtgtgtgtgtgtgtgtgtgtgtgtgtgtgtgtgtgtgtgtgtgtgtgtgtatgtatatagaatttaaaatttttactccggcagttgtcttcaaatactctaattttggggggcatgattatcattctgtcttctggcagtacatggatagatgctacctgagtaggattgtctatgaggtcagctgctccagtcattttatacaagaggaaattggagtgcaaagctttaaaatgattttcttaaagtcacccaggtgtcagaaccagaaccagagtccatgtctctagttcaggactctgcacacattggcacatgttctgtcctaccttttgggatgaatagttatacttgctttgtgattactcacccacctttttggagacatatgagtgttttgtacactattaatagaaggcagccttcacaaaatgccatctgcagatctgttatttcttctaataaaggaaatgatgtaaaattaccttaaatagaaatagtgttaattcttctggagacatattccataatccaaacacgaaatgtttgaaatacttgaagatgccatataaataagtcctttgtaaaaagataatattaaaaatttttgttttatagagatgggggtctcactgtgttgcccaggctggtcttgaactcctcagcttttactttagcttcccagtgtgttgggattacaggcatgagccacaatacctggccaagtccttttttttaatcaaatgacttattaat

SEQ ID NO: 78411 - DNA, 3233 bp, Homo sapiens
ggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggtcagtgttgccgcggcctgcgccaggcggcgctggctcccctccgtcactcggccggccttcggggcccgctgtggcgaggtcgacaccccccttccccgccccccgccgccgaggcgagtgtttgggggcgcgtggtccgaaggggctggtgccagaagtaggcccctggtggccgcggctgctgcagccgtaactgtcagtcctggctgagcgacggcgggagggttttgtcgcccgaggggacgcgagcgggcccggggcggggcgggacgtgcgaggcgtcgagatttgggcctcctaggagccaggctcttcgagccagccggggccccagacagggaagggcaggccctttccttcaaaggggagccctttctcggcgttttcaaggtttttggctctcttggggaagacatatttagccgtgtgcttggtgggttggggttttgggggtggattgatgggaagggagggcggatgaagtggtatgtcaagcccaagggttgtgcgcacaggttactctgtgttaccggccaccaggatttctgaagttgaacgtgagttattggctttgccagagactgctgtgttatatgcagacctgtatgcaagcagttggccttttttccccccccttttcagtgtagaaaatgaaaaggatgctttcctcatcttggtggtaaaggcttttgttggtaaaggtagaattgaatgtaccaaatgccttagtccgtaaaattttagaaataattttaatacagacactggtgaagcttggcaaccttgaaagagaatttagcgtctacattttttaaatgactttttatggatatgctaaattagtaacagtccaaaatctgtttgagattattaagtggcgagggtgctgttgaaaatgtaaactaatagcatatggggtttacagtgcacagttaacctcaatcatgaagaaatgtggatatgacccgtaattttggatcattttactgcctgcaatattgagagaagcagcaaattattacagttttttttgggagacgacctaaagtttaagaaatacaactgttgaaagttacctgtcagagacacaaaggtacccaatcaatcttgttgaataaattggacaagtgggataaggtgtttgtctcacacttctgatcaataagtactcttacttaagaagtgatttggtaaatcatgtaaaatttagaatttaggagagataagaaagttgtaacttggtgtgtatagtggaaatagctttgaaattagatcctgtttttaaatccaagctacttaccacatttttagtgaaatgaatacattattaatgatgctactgataagccctaaggatgaccagaagcccttttaagaaacactaatacagttgaccaaaaaataaaaaaggaaatagcttcaagaaataattttcaatctttgtgtatttataatatacacaggagaaataaaagaacagaatatgaagaggtaacttataatctttacaaaattagaatgtaaactatgctagtcttactgtgtcaatatttattaacctgcattagtttgctaagtagtatgctcactatcctctggacattgcccctgtccctgaggagcttaactttatacagagatacaaaatactgtgttttgatttcctttcagaggatttataagctacttatgttttatctgtcctaaattctgcccttttttttcccatggctgaaaaaataacttcctaagaaaggtacatactagtcagaggtgtggggaaaacgtgttctcatcccacttgtgcagtccatttaacaggatttattgggtacctacagtgtctttgacatgtaacatttaatcagttgtatttcttaaactttagataatttctatttcgatcatttctatttcaatctcctccctctcccctccaaaaaaatttactgtgtaaactgtgataatacactgtttctctcagtgtcagtcagtggaatgatccagatttataggtcatagcaaaatttttcatcccaagctcttgaaatgatgtttccaaatgtccattttcttaaatgactgctagttatgttctccaatcatgttacacatattttgtttagacttataattgtgtaggtctaaatgtagaaacattacattatgtacatatgcagctgctgaaagaaaattagttttctaatttttagatcggggtgaagacaaacttttagaagtgatctttcggtaaaatactggatgaagtcttaggtgctctttttatgttggttcaggacaaaagttttttgactgctttttgagttttcccctcactgccaaatgtaaggataa

SEQ ID NO: 78412 - DNA, 1023 bp, Homo sapiens
agaaaagcgtccagacggagagttcccaaatagagttttggcccaaaagcaacattttaccgagtcaacacaggaaaattattttaaaaggctcttgggagaacaaagatggctttgtatttggtgctgaaacccaagtaggccacatgcccttgtcctgcagatctcgtgttctccgcgttaacataaaggagttgatgagatcctcggctctggaacacagggaggtgtggagccttctgtagggtgcaggtggccagctgttcaccgcctggatctgttatccatgtaacgagtcagcaactggggaggtttagggacatggggcttttgtatgctgtcagatacatccattggggttcagagactggcacgggggccttccagcaggtgggctgtgatgccattcctgcccagcagtgctgagcaaagccagagcaggccaggcaagtcagagacacatcagcgtcacggggcttgagaaagctggaaagtgtgtttttcctgaagcgaagctgtcccacaccggattaaaccactgtaacatgcttagcaaattgaagtctcagcgtagtggccattggctgcccaagagttgaccaggagtgagcatcgcacctgcccccaggactctcgtccgccctcattctcagtgctctgcctgacgcaggatgctaagcgctgcatgcaccttaacatagtccccctgactaccacctgccacacaggcattgccagtgttatccccacattgcagatggggatgctgaggctcagagccgtgattggctgtgaactcttaagtgctggtgcagtgtaaccctgggggtctggctcccacccctcgctcctcttctctgctggtccacctcatgccccgaacccaagtgcagtggaagggcccctggacacctgcatcagctctccctgggcctcgaggtgatgctggctgagtggccttgggcatttggagcacatgtcctcaaattccagcatgcacaggacagcctgtgggttaataca

SEQ ID NO: 78413 - DNA, 1020 bp, Homo sapiens
aatgcatgaatggaggagcccagtgggcgaagcatcattcaggtattggaggggacggtgtggcggaagtgcccgagacagggaaggaggcaccagcacagaccagtgtcactggccagctgtctgcttattacccgtctccctcctcgcaggtgccgagattgctacatcccggggtgagatgtggctgtgtcctcgtgacccggatttgccaggaattatctcacctcacaaagactcagcccttggccataagagcacctggaggaaactaggttctaggcaaaacccctaaaacagcagccctactggtgttggccacaccctcatatgtaaaatgcagtttcacctaaattctgttcatgatttgttttaggcagattaatgacccccacagatgtgtacatccgaatcctcggaactgatggatgttttaggttgtagggcaaaggggaagtcaggagcttctcagtgacctcgagatagattctcctggatcatctgggtgggcccagtgtaatcacaaggtccttaaggtggaagaaagtgtcagatgagggaaccagagtgccggtggcccagtgcgcaagacttgccaccattgctggctttcaagacagagaaggcggccggccgtgagctgaggcatgcaggtagcctgcagaaaccaggagaggcagggaagcatactctccgctgagactccaggaaggagcgtggccctgccgacaccttagctgagtgggccctgtgttggaattctgacctacagaacgataacatcataaacgtgtgtggttttcagccactaggtttgtggtgacctgttactgcagccccaggaagcgagttcatgggcctagtggtcggaacacaacacgcaaggtctgggtagccccagcctacaacagggaggctcacgggcctgagagaacctgctggacgtttatcaacaaaaagcctgcagtgggaggtgctgaggaacatggtcctcaaggtttgcaaggactgaagctgggt

SEQ ID NO: 78414 - DNA, 1057 bp, Homo sapiens
gctttgttttctgtgtggcggcatgcttggttcctgctcaagaaaaaaaaatttttttgaaagaacaaataacatcaacactcaatactcatttattcacatatttaagacatttttcctgggtatcccattttaattcatccttaaaatggaactgatcttgcctccttagcctaagttcaggggaaatggatgcaaagctctgaaagtcactgatctgggtgctgtgaggtgacatcatcacaggtgacatcaccagccagccatggagaggtttgaacgaaccttccccctttctcccagacagatgtgaccaggctttatgaaaatttgtctgtaaagaggcacttttcaccacattattttaatacacttgtgttattaccagaaaaatgggaaagaaggaaataaaatttgcatcgactttccgcctccttactccacgttggttcttgcaaacagactggagttgtgtgtctgttaccccctcctttctcgcacatgttccagcgttatgcatgatgtggagcaaagctttattaataaggttgccaggaatcaccagccatagaaatgcctacctttttgagtgaacaattccatttctataaatctatcctgggaagataatctttgatgcagtcaaagatcacagtgcccgaggatagtcagtttttacaacagcacatgtaaaacacagcatgagtgctgccaaatccatataataattagatatcatggttcacttactggaatactgtgtatttattaaattatattttaagatactttctggttacatggaaatgcttatgactggataaagcaatacaaatgataacaaatacgggatgttaaatttccctctaagccctgctttagctgcatcccgtatgttttggtgtgttggatttttgtttgcgttcatctcaaagtatttcctaatttccgtgtgatttcccctgtgatccattggttatttaagagtggattgtttaatgtccacgtatgtatgtctttctcaaatttgcttcagttattgatttcatttctaagt

SEQ ID NO: 78415 - DNA, 1055 bp, Homo sapiens
ttttttctgctctaatgtttattattttttccttctaattattttgcattggctttgttcttgcttttctagttccttgaggtgtgtcattgggttatttgaagtctttctaccttttttttttacctgtaaaataagtttatcggtggtaacatgatataatttactcctgatatctgatgttacaaactttagggtccttgagatatgcagcatccttggatgtaactggcagaaaccccattatttgagctctcttaattgcttttgtgatttctttctgtttcttcccacaaagacctgttttgtgccttccacaaatgcatccaacaaatggagaaataaactgggacgctgtacattcttaaaatctacctgctttccacacaagatacatttcttaagggcttctttataagaattttccattggaatgggcaggtcctcattgctggatatctgtttatattgtgaacaacctcttctccatagcaccatatgagtcctgggatgtgtaaggctaacagcagccattacaaggtgtgtcaacttcttcctccccagaccactgcaaagagcaactatagtggccatggttccacattcctccactggttctaccttttatgtaggcatttattgccgagcttccctctttgagatgcttttgctgtatcacataggtttaggtgaaatgagtttcttgtagatagcatatagttgggtcttgtttttgttgttgtttgtttgtttgagatgaagtctcactctgtcacccaggctggagtgcagtggcgcaatcttcgctcactgcaacctttgcctcccgggttcaagtgattctcctgcctcagctcctgagtagctgggattacacacgcttgccaccatgcctggctaatttttgtgtttttagtagagatggggtttcatcatgttggccaggctgatctcaaactcctgaccttgtgatccacccacctcggcctccaaaagtgctgggattacaggcatgagccactgtgcccggccatgggtcttgttttttatccatt

SEQ ID NO: 78416 - DNA, 1030 bp, Homo sapiens
agtagataatccattggtgtttgtcccaccattggtgtattctaacaagaatgtgtccaactttgaatctcctggcttgaaagtataaaccatcacttaattcttattttaactctccacctgaaaaccagttcatatttctggccattttatgtaagcaaaactgaacaattggtgaaacattttgttactcttggaattgactctggctgtcagtgtgagccattagagtaacatcgaatcttggggcaaagaactgcccaggtgaattaaatttttccaggacactagctagtgtgccttggattgattacctcttctactgcattgaaaggcgccatgttttcctgaaatactaaattcccaacacctgggtaaacaatgaccttccagagagtggctcccgtatgcctctccctaggaccaaccccatgaacatgttttgtcacgtttgtctcatgtttctacttcacaagtcagtgagtgtgtttaaggtaagtacaggattattctagtaggaataggcgattgctgtcataatcaattctcatgttgatttcattttattgtaaagataaatttaaacccagttttgcttaagcacattgatgtaattttttggtattatttgacatgaaaaaacagcaaaattgagtgatagatacaatatgaaacttgttgatgaatgaattcaaatttattaaaaaaggagtaactgacctaaatgtgaagactgatttttttttcttccttggctatcttgtgaagatggtgtggttattttaattctagtcattcttgcacatgcccttttgggttatgctgaaagtaaaaaaaaataagcccgaagttgactgcatgtgagatcaattgaactatgacttaaaaaaacgaaaatcacaatttatcctcaacttcaaaggacaactagacacacagagatctaacttgtccctgtcttcaaataggtattttaagcaagtaatatttttatattaaaagtcagggagccaccctacctataagctct

SEQ ID NO: 78417 - DNA, 1040 bp, Homo sapiens
atctcgtatggatttctaggcctgatatccaacagaaagcatagacgtctcaggttattcgttactctaaggtaaaaccatctaggatgattttcccccttgcagttatgttatcattcttataacattgtatgttaatagaaaatatatttgcataatatgcatatatatgtatatttaccaagattttgtttcttacgcttgctatcatggcagcatgcgatgtcatattttcctttatgtgatgtaactactttctgttatctagaaattaagattgaagctaaaacacttctactgttcaatttcagaaactaagaatcatcctcatgcctttatttctgtatctgacatatttcataagcacatccaactactcctagactgactaggattctgcaggaacatgacccgtacacaccacgcgtcacccaacgacccatgaccgttctctgaggcaaaggagggcaacctgacagcaaacacagtcactgttggttccttctgatccacagcctcatcagtatttggactttttaaagctcgtagaaacaagacaaggtgcaccggtttcatagacgcaaccttaacttactatttagatgagatctttctaaagaaaaaaaaaagagatgatatattttttgtaaacaatatttctatcacaggcatccataaactgaaatgactacagttgtgcaaacaggtgtcacagtgaagttgagcatttggagaaaaaaataaaaagcaaaatttgcaggaagaactgctaaattaatactttatcccaaaatgccacgtatgcctcaccctctctgttctatccaaaaccaaggaccagagtgctccaatggtaggccccagttgtctcgatgtaggtagaggcaccaccctccccgaggatgcgtgtggtgtggactatccccatgagctgaccactacttgatttttctttggtggccgtaacaacctttaatttgtgggcatctgcaacagttcaaaacccaccatcagataaaacataatccacaaaatctcac

SEQ ID NO: 78418 - DNA, 1061 bp, Homo sapiens
ttttctatttcttatatttccttttcttaatgggttttttcaacacataataagatgactagtaatgggagtaaaaattagaaacactatttttaattttaggctgcattataaagtaaaagatagataataaatgaatcatatagcatgataatgggcccagaacggctctaagtgagagctcacaaagcttcccaggctgcagtgggagtgcctcaccatggcagcttaatgggaagaggagcatgtgataagtgagctctgctgcatttgctgaaataccagcttattagttcacagatgcatttgagtggctcttagcactctacaaagctggcatgaccttctgtgttcacatttttaatgagttcttcaaaaatattaatgcctagagaatgatataaattcaggctggattagagacccagagctgtgtttttggcataatggtgactgcatctggggagaaagggccgggatcagcatcttcactaggtagttttgccaaggaatccctgccttggaacaatgcacttgtgcccagggactgtgcctctgtctgttggctcagcatctgcctggggacctgaccacgtctgcactggcacacagacattagggcttcagcgcatttcagttgtaaattcaagcttctgtttcattttaaaagggatgtcttagtgcagctgactcattacttctcaacttcaagttatttgccactagctgtgatcacttgggagttttccacatagataccgcatatttcatggcattccatcctgccagtgtaaggaccttgtctaccggagctacaaaaatacttttatgtactctttaagatgcacatcaaatgggaaaagcctttgcctagcagaatagatctactacgtcagataattcttgggttgactaacattccgaggtctctgtctcgtggcatcttgaatggctctgctgggtccgttaccttgaaagctctccttcatccctgcctgaaggaatcctattcaaccatgaatgtctcatacaccagaggtgcatacaatgtgaaacctctc

SEQ ID NO: 78419 - DNA, 1078 bp, Homo sapiens
cccaggagtttaaggcttcagtgagctatgatcgagtcactgcactctagcttgggtgacacagtgagaccttgtctctaaaaaaaaaaaaagaaagagaagaaaaagtaaaacaatctgtgtataagtgggcccctacagttcaaacctgtgttgttcaagggtcagctgtctgttttccctgttctttattcctgatgccacttcattagtgcaggacatcagtatgggtcttgctgtcagctgtcctccatcacagccagggaagccaaggggcatctggccatggcccagccatgaactggtagagtagtgtcggcatggtaagtgtggcccacaggcagtgctgatggaaatgaccagaggcagatgtgatctacctgtcaggtccaaaggcttcaatcaaggacagttgaggggcaaaaatagaatgctggaaaccttcattctaaccaagagtttgtattccataggaatgctggctcctgcacttcagcacccttctcctttagtgtcagttttgaacctcagctatgccagtcaattcactttcctctcccttcagtgtcttgccttcctctggccagtgccagagggaaggcatcccagagaggtgagggggaaatgccagctggctgaagcaagccttctctgcagagtctcccaatgtggctccagctctgggaagtcgtagcatgcagcgagcaagttctaggtgttatttctccgcctcatgtcctgcgtcagaaggcgatctgataattgcaggctgtcattcataaaggtatatttgataatgggctgtagtgctatagaggctgagatgggagtctacggatcttcatagatgttcgccactcctcataccgttctgtttaaccttgctcctggacaaggttagaagagggtgttggattttgagccagggcatagcaggagacagccaaaaggattgcagcttttgtgacatcacatcctgtacattttaagcgacaacagtttcacagttttaaaggtgaacgtaaagcaagagaatcatgactgattaaattaccatctgttaattatattgccagtt

SEQ ID NO: 78420 - DNA, 1380 bp, Homo sapiens
actttttgagtatcgagaatagacttataataacttttaaaatgtctttgctaattctgacatttaaaaaagttttgagtttttttttttttgattcaccgatgtacttccgtattctgggttatattttcatgcttccttacttgtctggtaatctctgtttggatgccagacattgtgaattttaacttgctgagtactggatatttttgccttcctagaaatattcttgcgctttgttctttgacacagttacgttacttggaaacattttatccttttgggtcttgctaatattggttaagcaatactggagcattgcctagtctagatttaatcattactattactgaggcaagaccttctgtgtactccatctcatgccctatgaatgctgctctgtgggaacagatactgttcccagttctggaaacttcttcttaaactctgacaaattttcctctaatatttatattcctgcttctcaatgcactttgtgtccgtttttcctttttttcactgttctcataacattaacttaatgtaaaatcaaacgctcatcacactatatgaatgacgttcctttttctcttagttttattaaaattttaattatttaatctaaaatgggcaattatgtcactattatagaggttcaacatagctcactcaaaaataaatgttatgtttttgtcattgttttagttgatgaattagatttactatatcggctttctttttcacagtctttgaagctaacattttaacagatgaagtttctgacagctgagtgcagggagaataaacatgcatctgtgaacacaagccaggcgggagcctttggggagcgacaggggaaaggcaataatgagcccaaaagagggaggattagccccataaatatcgctcatctcccatcagaccctctcttaacgttgccccttccctccctcttcattctgttttatcatttgttttctctcttggatgtatactttttgtcattaaaattttttctcttttctatttttatccttttgaacatttaaagaatctcttccttttttcttgttgcaggtcccttgtcacaatgttgtttatgtttgcagagcagtaccctataaatgtgtatataattgtgattccctgagtgtggtcacaagatgatccattgaattctaatagatttcactttggaattcatagccagttcacaaaagaaatggaagaatatgtaataaagagtaaatacatcttttggcaatattttagcaaccaaaatattacccgaccctaacgttgtggagtctatgggtaaacactttattgcattttctccctgtttctaattctcagaggcaaagaggctaatgacgttat

SEQ ID NO: 78421 - DNA, 1068 bp, Homo sapiens
aagtgggcacaggagtgtgctgcctgatgaatgctcacttgcacataagctcatgcaaccagtgcccagatggaaacggggagcatgctgtctcccacccacgacatcttatggaaacagcgtgttgcggccaccagttctcactccttcctgtgccagcattgcctgtccatggcattcattcttcccaccctgttggcccctcttggagaatctttttgatgcatatctctgatgtttttccagcctctaccctacagacctccaggctggatcatcccggtagcctcttcctctctccttactcctgaacccagcattgtgtttcggggcccacagagatgactgatggcaccaggcgactgagctgccagtgttgctgatagggcctgggtctcccctctcctgtgcgtccactctctgcctgtccatcctctgcctctggtaccattctctctgcccgccacattctcagcagacggcctcacaccatgaaaaaataataaaaaggttatcaagaggaaattcctttggctgtcctcccactaccactgcccttcccctacagtcacggcctcctgggacacctttcccactgccgcaccctgcctcagccgctctcaggagctgagcgccacctggttgcccaaaccagagtcaggaggaccccgaccgtttcctcgtccttgccctcatgggcaccttgaccagcagagcctggttctcccacttcttaaaaagctgtcctttcttctacccctacctgaccctggaactcccccatggtggcatgctgcttctggccagcaacctcgcccctccgtctgccttcgctgtgcagccagcatgatgcggagtttccgaagcctgcagcccagtgtgctgcttcctgtggctggctttgggtttcccagcccgcggggttccttgaagcttccctgcacatctcctcagcctctgctccggccacgatatctgctctgtgcctcccagctgtttgctgtggtctcctcaagggcatctcctccccaccttcccgaggtggccgtgggcacagggccctggctt

SEQ ID NO: 78422 - DNA, 1029 bp, Homo sapiens
tcctggaaaggaaggcatacctgtcagtgcgtgtgcggagtcctggaacagtccgtgctgagcagggtcgttccttcactctttagttggtcccacatttgtggagcaaacactcatgggcacctgccatgtgcctagcgctatgccaaatgcttcgcatgcagagcgaagaccaggagcttgctgtgctgttgtggacatggcaggaataattacaattcagaccgatgtgcatgtgcctgcccagaggtcagtgtggtgcatgcaggcaacttgtaggaagccccacttgccaggtggcggtggggaccatgaggagatgcacagaggggcctggtgaagggcagtggaggaagcattgcagcagaggaagagcttgtccaggacaccagagggtgaagtggccccacagcatgtcagcagcaagtgtggggagaggcaggctgaagagggggtcggatctgatcacattgggcttgcgagctgagcccaagagggccacacttcagcagtgtgggagcacggaggtgtacagcttcaggagtaacaggattaagttggcatttttgaaaaatcattctggccaccttgtggaggatgatggatggtgggtggtgttctgaatatctgagatagctacagccatccaaagcctgctgctaaggaggaaaggtggattatctggatcagctggggaataactatagacgagagtataataagaaaaaaaaacacattgagcatcatattaatcttgagattgtatgcaaaatgttttgcagcgttagtatggattctttataagtattaatagaaataagctattaaggctgggcgcggtggctcacgcctgtaatcccagcactttgggaggctgaggtgggcggatcacctgaggtcgggagttcgagagcagcctgacccacatggagaaaccccatctctattaaaaatgcaaaattagccgggcttggtggcgcatgcctataatcccaactacttgggaaggctgaggcaggagaatcactt

SEQ ID NO: 78423 - DNA, 1034 bp, Homo sapiens
caatcccacagccggagcatccacacattttcaggtcccctcagggagagcttgtggggacccctgggcggatggaggagggtgaaagccttgcagaatgaagtgtttactgagatttgacatgttggggcggtctaccccctacacacacccctgcaggatcttgtttgcatcccctttgagtgccttatttgggccaatgataatattaacatttttttaacacttttctgataaaataaacagaatcttgggaatatccgcacaatgcacttcactagaatataggttccatgttgcagaagtaaggtgttcctgttcctcagcagttcgtccttcaacctcgattccgggttcccttttgaggaatcttcctcccttttgaagtagctagaaaatcctgagggattgcgtatgtgtgaaggccctatacatgtataaagaaggtttaaagagaaagaatgtaacagctcatgaatcagaaactcttggtattcctaagagaaggtatttgtggtctaagtaaaatctaattccttttggtggggagaggggaagagattgtacagttgccaatttttaaaaacctgaccgtctgggtccctggatactctgaaatgatgcctgcttgccccagtctcgtcttcctaagtcacagcacctttgaatcttcatcacatggatatttcagacactaagttctacaatgctgtgtgattgagctagggatcagagagccaggagaaaaataatgactgacaggagctgatagaggtgacaggtaagtttcactcacgtccgtgtgaagagaccaccaaacaggctttgtgtgagcaataaaggtttttaatcacctgggtgcaggcgggctgagtctgaaaagagagtcagtgaagggagatggggtagggccgttttataggatttgggtaggtaaaggaaaattacagtcaaaggggggttgttctctggcgggcaggagtgggggtcatgaggtgctcagtgggggagctttttgagccaggttgagccag

SEQ ID NO: 78424 - DNA, 1057 bp, Homo sapiens
tcatgcttagacttgggtcccatccccaggatatctcattatatatttgcagatatcctcaaatatgaaaaaaactccaaatttgaaactcttatggtctcaaacattttgaataagggatagtcaacttgttctagatttgcaacattttcaaaagtttgaaatcatttcaaagtgcagaattaaaaattaaagaatttagaagtaatttgcatgtaagcatcattaccagctacttactatgaggtcaaggttcatagcaagtaacattggcgcttttgtccaatgtggtgtgtggaggatgatgcagaggtggcagtcagtgggtggatcaataagggcaccacagtcctccccagccttcttagatcatgtgcctctgaggaggggaaggtggaggggacagcttctggggagggatggtggaattataaacttatttaaagactgtgcatcagcctgaaaagacacctgaagttacagctacttagtaccttcccagaaaaatattcagtcagttgaaactcctcacaaggctatgaaaatccagacctttgtgtgtatgtttgagggaataaggcaccttttcctaagaaccaattcattctacagatacctgtagcatgagctatgtacaaggaggggcactgtgatggggggacagcagttaattagaaatggcattgtgttcaagaaagtgacactataccaattgcctttgacaagtcatggccaacattcacatagtgtattgtgagctccatgggctgtgtcaactgaagaatgtcaagggtcataaatttggaaaggggagctttatttctcataaagggttgcagcctgcatggccattctgataggctgggaagtgtagcctcccattagaagctggaaacagatactttgagggggggcaaagggaacaagaatttatgcagactggggtggctaaatatgcatatttaatacactgtaggaggagtcatgaatatttatgaaggaagaaaggagaaccatgcacatgtgcagttagtctcatgcctctccatgggaccta

SEQ ID NO: 78425 - DNA, 1034 bp, Homo sapiens
tcagtgtctggtaatggcactgtgcccattggaaaggctaccatgtttattttcctttttttcttctctgaagaatatgtagaaatcactgaaagcaactattcatcatatgatggggaactcaattcatataaggcttctgcattttccactctgaccctaagcttggtacttcaagggatgaaagattaaaaagaaaaggaagtaacaccagataaagtccatataggaatttttttgctatgtgcttgtataaagtactggtgtacacacacacacacacacacacacacacacacacacacttattcctccctcgcccatcctgccattctacaggtgaggaaatcgaggcattctgtgagttctcctggcccatctgaaattctgactcagagtcggctccgtgctgctcccgccatctccccctccaagtacttccagcagtgcttgtgtgtgttggggaacctgggaggtgtcttatggcacattgtgcacaccagcagactctgagagtgaatgagtacattcttagtactctgctgggacaagcaggagtggccaaggctgtcctggacaacgtggggccaccaaaactgaccatcacgttagatgtggctcctattgcctgatactgtgaatgtgcttcacagcacagattaggaaaagtcctgtgaggattccaaggagggagagccaagcctcagctgtggagacagggaggcttcctggggtgcccacgggacagagggaggttgtcctggtcccttgggtgctccagaggaggaggagagaagacagacccagtgagtggaccaggtgctttcgggctgcagtggacctcagatgcaggtgctccttcagccatttctcctgccaggaacacagcccagtccccaggtcctcactgcagcgtccttgtcatctgcttggcggtatcctttgatccttgaagagccagcctgtcttccccctcatagtgaaccccctctcctattcagccagggtgaattgatcactacttctaccccatt

SEQ ID NO: 78426 - DNA, 1015 bp, Homo sapiens
tgatgtcggctcactgcaagctctgcctcccgggttcacgccattctcctgcctcagcctcccaagtagctgggactacaggtgcccgccaccacacccagctaactttttgtggttttagtagagacgggttttcaccgtgttagccaggatggtctcgatcttctgacctcgtgatccacctgcctcggcctcccaaagtgctgggattacaggcgtgagccaccgtgcctggccttgacattctttttatacagggattctttgggctatgtcttcccttccgcctgcccactcagcagtgccgtggagcagaggtggttttcatttgtttgcaagtttctggtgcaacttacttctgggccatttatgccagccattaagaggattgtctagctgcaaaatttggaagaagaggactaagataggtctcttggcgatttgctcagtgccattcaatcaagatagagtgagtctcttgatctctgtagctggaaatgtagattgcccctcattcctttgtagtcaggagaccacatccagaattagaagccatgtgtaaacgttaactaatgtatctctttttgcatttttccactgaacttaaacatctcacagaagcatttactacagatatcaaaaactttggcatgtgcggtactaacatttcacatgaataagaataagattaagatctgagaacatcacagttctttaagtgtcctaatttgtttttaaaagaggatatgaattctattgattacatcatcatcatgttttaccccagttctacaataaaagaattccttttatgtaactgctgaatccacatgccatgattcatgacactatatatatatatatatatatatatatatatatatatatatatatatatatatatatttttttttttttttttttttttttttttttgagaccgagtctctcactgttgcccaggctggagtgcaatggtgcgatctcagctcactgcaaccgccgcctcccgggt

SEQ ID NO: 78427 - DNA, 2078 bp, Homo sapiens
actaagtgtggtaagttatgaaattcaataataaatggtctcactttaagtgtgttgtaactcttagagcagatatgacaaacggttgttcacaggtaggatgtggcaagtcccattagaggaacaagtgacagaggcacacagaacagagagggagggaggaggagggacgagagaagctggctgggaggaaggaggtatttgatgtggaaactttcatgaaataaattatatttaaattgtgtgaggggtatgaatagaattctgactggcttacttgaaagaggatattctgggttaggaaagaaaatggcagagttacgaatgggtggatgagcaggatcagagatttagaaggggagattccagagacgaagttggaaaagcaagacaaacccctgtgcacctaggccgttctgcaggaggccaagggcttcacatgataatttcaggaaataaggagcctataaatggtaaaggttttaaagcaggtaattgacatgatttgagatgtggcgtaagatgactattttggccaaaaagttaatttagatagaggattagcgatggtgaggtagaatgaatgagggataactgatcttggaagattctttcttgaaattttctcctcaggttttgatagatgcatttttgaaaacgtgtatgtagtgaaataaatacaaattcaccaaagttcaaaacaaggactttgaaaaacacacgtatctcaaaatggggagagatgtgtatgcatttgttcaagagtttttttagtgtgattgcagagaacagtaacagataatacacaacaatgatgctgttgttgctttttgctttaaacaattgtagactccagtccttatctactggtagcctgtgtagatgatgcctccaaaaaatgtctctgatctcaaataaacacatatatagatcagttaagcatgtaaatgcatatctcatcattcattttggtgttttgtggaaacaatctaggaagggatttgaatgttttaatatttagcattggttttgccatagcttgcttcatggatagtggagttatgcatttccaatttttttctaaatcttttaatgtttcttttcgtacattctttttttttaaaaattagttgacctgatacttgtcaaagaaaattttgttttgtgtaacttccctcttgtttctcttagcccctgtttaaaattttagataatctataaaaattatacacggctagataattattgagatttagtttgtatatttctataagtgagattgcgtatgtccaataacactgtctgctgaaaattactgtgtgtgttataattttggtgcttaccagtggttctagggaacaataaatgtgttgagtagatagatgaagagatcaacacatgggaaaaactttgcaagtataggaaacataaaatattgaaaaacaaaacaattagggatttttaatttaaaaacagtattttaaaatatgagttttaaaaaatttattaaaatgagccattgtttgatctgttaatttggagaagttacatgtacttactttttacttcattaactatctggtattagggacataaaactagattcagactctagtgatagtaatgataattcctgtgatttaacttgcacttcgctattacttcatacttaattaatccattaaaattaactcaatcctaatgaaagtgtaactacaggactttttttttctcatttcatgtgtataaataataaattattgttttttgtttttaaaaattagagttccttttgggtaacatacaatgtgtatttttagttatcatgagacatactcatccattatgctagctgttttgtgtgcacttctcacttgttgcattttcttataaaatccatttttttaatgtgtaggtgtgaaataagtgtgcatatgaacataattttagcacatttcaagaagcagctttgtagctgtatcactactaaatggatacagtcatacccatgtacaaaaatcacacacacacacatttgcactattattttatgtttttcttctttttagaagaggggc

SEQ ID NO: 78428 - DNA, 1067 bp, Homo sapiens
tgcaggaaaggggaacgaagacagtggtctgtgcgttccaggggtgtctctgcggtttttccaaggctgcctcctggactgggagacccgggcccggcaccgccagtctctgtccgaggtgctgacaggcttccgctgcttcagagagcgggaggccgcgcctaggcgggctctcagaggagccgctctaccgggagagtcggaggctggtgacacagtgtcacttaggtcttctgtgaatgcagactggattcaatattctgacctgtgggaagcggaggtcagtaccccgaggtgcgaagcgggcttttgccaggagtgctttaggacgccagggaatcaggagaaggatggccctttcatttgttaattgagctgaaacgccgtgggatttgaaaactagtttagttttctgcggagggacactctggaaggagcatttgtaaacaatatttgttttttggaagaaattgtttggcaacttttctttcggacatacaacattgagaatacagtgagacatggttttagatccactctgtaggcttcttaactctcgtgtacgtcggaatcacgtgggcaaacttgctttaaatgcgtgcctgctagttcctcactccaagggattctgatcaagataggctggagtcttggggtccctgcatttaaaactacttcttcaaatattttgaagcgggtattttgtggacaatattttgagaaactttgcagtaagtcacagatatatgaatatatacaaataaagtaaaactatttttaaaaatagacgttagtgagatacttttaaaatacctaccactaaggatcttataggaagaaacttttgaccacgccaagctgttctcattaatttttcactgttaatctaaagcttttaaatttacaatcccatgtatttaaaaatgtacttttttccaaagtatatcacttaggacatttgtaagtcaaatattgtatcagtaaaagtgttagcaaggaacacagaaggaatgtgactgcataaattaccttacagtaaaaattaacatgtctattttactttttat

SEQ ID NO: 78429 - DNA, 1026 bp, Homo sapiens
tgagcactcagtgaggttcatgctgagagggtacaagggagtgtaaattcttcttttacttgaagcttcaggattgttctcttctcttgctagttcacatctagcctttgccaattcgtgagaagcttctggccgaactcttcatagtggtgtctggggtatctggcatgtatctgccctggctagcagctgctcacatcccatttttccttgcaggtccctccccctcttcatatttcaggttaatcagttgcatcaacacctcacttccatgatgcattcaagaaaagtttttaatttgcagtttgtgtggacttttttttattacaaaattggtagtgatactcttgcgagcttccttctggttggaagccctgaatgggaatttgaattagcaagataggagtcactttggtatattcactaaatcaaagtgtaaggtgtggagaaacacattctaaaaactgacctggtctttttctctttgcctataatgttccagtaattcaccttcacaggtgctttaagaatgactttcactttcatgcttggggtccccagaatccccccacccagggcctggacactgctaatgagcttattatttaaggtgcagtttgaacaatgtcttcttaatgaaatagtcatagattatcacaatgggctgtgctgtcttactggtccatttaggcacatgattacctgtgcctcatgctattttgtcaacaccttgtacattttcctataaacccatagccctatttcagagtccagtgtaatagatgttggataaatgatttaataaacaaggactagttggaatcacacacgtgacattatgttagtgaagctgtttattggtctgtctgctctgcaaatttatgagctaatgaaggcaagaattgtcttatttactttagagcccctatggggatagtaggctttcaatgtattttattaaatgagcaaaaaaattaaaggccttcaaaggtgggacacgcattggctcctccaaagaatcaggtt

SEQ ID NO: 78430 - DNA, 1302 bp, Homo sapiens
caatttctaatcacttcatgtttctgctcaacaggtgttggataaatacaaccctccagaccacttcctccctgagtcctacacctgtttcttcttgctgaagctgcccaggtattcctgcaagcaggtgctggaggagaagctcaagtacgccatccacttctgcaagtccatagacacagatgactacgctcgcatcgcacttacaggagagccagccgccgacgacagcagcgacgattcagataacgaggatgtcgactcctttgcttcggactctacacaagattatttaacaggacactaagatggggaaacgtcctcgtgagatgagagcctgagccaggcagcagagcgctcgctgctgtgtagactgtaggctgcctggtgtgtctgatgagaagcgtccgtcctcgagccaggcgggaggagggagtggagagactgactggccgtgatgggaatgacagtgagaaggtccgcctgtgcgcgtggaacactgtggacgctcgacttccaagggtcttctcacccgtaatgctgcattacatgtaggactgtgtttactaaagtgtgtaaatgtttatataaataccaaattgcagcatccccaaaatgaataaagcctttttacttgtgggtgcaatcgattttttttctttctcctttctttcaagtgtcgtgagtcgtcttgattgtatattggaaataactgtgtaacaaatcgtattataaatatttcaattaattttactctgaatttgtttattaaaagacttttgaacatgaaatgattagtattacttgaatgcatccagaggatatttaaaccaaaatgaaaaaccagaaggccatttggtgtcccccctcccaggtgtccccttgtagcatatgcattatgtcatctgaattgaggcctttctgtgaacagcatcataacttctatcatggaaagtgtactatatataatgtttgtgtcatgtatatgcctaaattttaattatctataaataaaacatctgacataaaagtgtaggctgagctttcttaaccagtacaaccaaaaaatcaattagttcttgatatagcagtagtaaagatttcagccaagttgagattatttttttgttaaaccaaactcaagtcacaaagaagtgattaggagaatggaagattccacgggaccagctggtggcaggggctgaagggctctggagccttcagagtttcctccgacttcctccccagccccatctgtctgcacagccttggcttctgctttcattggcctgggctgagagt

SEQ ID NO: 78431 - DNA, 1086 bp, Homo sapiens
agcagagggggccaggagtcacagatatatcacctcgaaggtccgtgcctgaatgtgtagagattgctggccaagtgagaattaacaggtggtgaataatacagtcatgagtgagggcatctgaaagtcaccaggcaggttttgacctgtagatgttgctaatagttggagctttctagaagttgggttagtttctggcaagcagcttgacaagatgatcttgaaggggctaattaccatacggtaggggcatctctgtatagggaaaagttatagaattggattgaggaccactaatcctgattgtgattctctaatgtattttgttgtcgaatattatggcccattcttagtgatttaataaaattgcaatgttttggagtcctgtcccagcaggttactttttaaagaccggctttgtttccacttggctagaacgatttctgctgaacaggactggtacattcattttactttcacgtgtgcctgagggtggaagtggtcaggcttgtgtttaatggaaagaccatctctctgatgagagaggcagaagaaatcttgggcaggtaaaatggataggaaacataatttcaattactgttcaataataaaaagtagcaaacgattaattttaccttctttttttaatccttcaaagtggtgatgataataggcagcacagaggaaaaaaacctttctttgtagggagaaaaaaagtgagaggcagggcacgtcccacctggccctgtgtgagcgttgtgcaggctgtgagcggggcatgggtgggagctggtgtgtggtaggggagcggtgggcagcagcatctggcacctgctggggctgcaggagagcaggggagtgctgagggcgtctgaaaggtacctctggtcagggaatgtgtaggcagcctcggttctggtcctggttatggtgaggatcggcctcagagagtgggtgttactactcccggtccagagcaccaaaatggactctccaggaaggtgggcgggctggtgactgggaggagaggggagtgctcctgtggagggggagccgccctgaggtccaggcagggcctctgggagc

SEQ ID NO: 78432 - DNA, 1715 bp, Homo sapiens
tgtttcacttcttttttaaagtgacaatagagctatttgactgaaagagccactgagagttgtcatgtgcagtgtgtgtgttttaggcctctgagggcagctgtaggtattgctgaagtcaaatatgaaaaaatctcaagaaatgatcgtgtaatctaaacccttaaaccataagcctgtaaccgttagcatgccttgagatgcacaggtgttcttgtcacttgatgcaggcaacaagtgttgcagcagttgtgtggcacgtggctaggaactgtcagaggtcgccacatcactgatggtggccgtatccttgctgtgcccatggccgtcatcctggaataggaggtcctgcggaaggagccacagaaaccttggcctgttcactgcatttctgagtttccctgagtttgtcatttttggtgcctgcaggtactggtagctcttgcttgtgacctggagctggacactctgccttgctgtgccgagacgcacaagtgggcctggttccggaggtactgcatggcctcccgtgttgctgtggcccttgacaaaagaacaccgttgccccgtctgtttcttgatgaggtattgcatgatattttggaatcacttttgggatgcaaaaacattatttagctatagtgtaacaagatgccaatattacgagacacagaaaaatttcgcttgccaaggaatatcaaagaaaataacacataggtgaaaatgagtgaactgacactgtgaatttcagttaaagtttatttttagtaaactacaggtagaatgatactgtctagacatttctaatatgttagacttgatgcagtcattattggttttgcccatgaaccataacattgcaatgttgctcttccctcatatttttaggcagggattccttctgtctttccttagtatttatctattttgtttgagataagtgtttgatttgtaacatcataataattttgtttaggtggctaagaaaattcgtgaattaatggcagacagcgaaaacatggatgttctgcatgagagccatgacatttttaaaagagagcaagacgaacaacttgtgcagtggatgaacaggttattatattagaaacaagcagtaatgtcgatcgtgagtgtgagaggctgtgtgcattgttcttgcccatggcaaatgctcacttgatgtgtattgtaggcgaccagatgactggactctctctgctggtggcagtggaacaatttatggatggggacataatcacaggggccagctcgggggcattgaaggcgcaaaagtcaaagttcccactccctgtgaagcccttgcaactctcagacccgtgcagttaatcggaggggaacagaccctctttgctgtgacggctgatgggaaggtaagagctctttttctatgtcacaaggtcattgagcctgaggcagttgtggctaaaggtgctgtgtggttcttagcacgtgcaaggatctgtactaaaacgtttctcaggattaatgatactgtggtatgcaggaagcagctagagttctaagatatttttgtataatctttaaattaaaaaaaaaaaaagtttaagacagttttgctcttgttgcccaggctggagtgcaatggcgtggtctcggctcactgcaacctccacctcctgagttcaagtgattctcctgcctcaacctcccaagtagctgggattataggcgcc

SEQ ID NO: 78433 - DNA, 1073 bp, Homo sapiens
gtgggcgtgggtttttctggtgctttgacagatgtctgccagtgtagttttcagtagtgttgttggatgtgagtttttctgcatccagtggaaagcctttatgggccatccctgagctgctggcagatggtccttctgaagcagaaatctggcagggttctcttggccttctaagatcctgtagatcttaggtgtagtacaccaccgctcctgtccacagcagccaggccctctgctccctcgagggcggcctactctgggccgtgctgaaccacacacataggccttttgttgggagagctagggttcttccttctgctgcctggtcacctggttgtatcagagctttcccgggaaatgtccccatggcccctggcctggtgtgtgctggacacctggaggccactcactgtatcctggctggtggggtcatttccccactgggtggtggcttctgccagggcagtgtctgcccgcctgccgcagtttcctgggtacctggtacaggggctgaatgcgtgtttgctgaagaatggtatgtattaaaatgtgaatcccaagagtgttgtgtcactgtgcacttcggcttgggagagcttggattggaggaacttgctcttcacacgtgacggaaatcattctgctttgcgtctaagaaggtttgtgttgattggatgatggagtgaagctaaccccggggtgcgctttcctcccgcaggccgagagtggtccgactggtccagcgagctgcgcatcccaggggatgagttaaagtggaagttcatcagcgatgggtctgtgaatggctggggctggcgcttcaccgtctatcccatcatgccagctgctggtaaggaaggggcttatggcgatcaaggttagatgactggctgtggattgtttctggagcaacagggacacgtgcacatgtccacgtagtgcctgacagcctgccttctgctgtgttggagtgagtgctctcacaggccctgctgaggcgtggaacagaacacagatctgtcccagccatccagctgtcaggctcacactcctcctcacctggtgtggaagga

SEQ ID NO: 78434 - DNA, 1170 bp, Homo sapiens
caatttctcaaactccaagccctccactctgccacgctgtccttgtggagctcctgagcaggacgggcagaggtggcatgcaggtgaccaggtgtggggctgttggccccctcattcatgtccttgcttcctctccaggtggcagatatgctgttggagctctgtgtcaccgagttggaggatgtggccacagactcgcagagcggccgcctctcttctcagcctgtggtggtggagagtagccacccttacaccgacgacacctccaccagtggcacagtgaagataccaggtacaggggctggccccagcggggagctgcagcctttcccaccttcagaatgatgtgattctgtaattgcttcagtagaaacaaccatctccattttataaaaagaagttacagaattgctttagaatcacttttctccccttttctaacaaactacttttgcacaataaatcatgatatagaaagtcacacaaagtaaatgtttagcttcatgataatcaggcagatgccctagtcatcatgacccaagtctagacctaacctgtggcaaattctggaagccctcagtgtatcccctgatgttcctctgagtgatgctgtcctgatattgatccatcactgacttgcatttctggacagcttctgttacccacgtgtatatcttttgtttttaacaactcaacaaaaattattaagaagaaaattgttgaggccccggcctttgatctggcgggcttcactgcagcctggatctgctgactggacacgtgtgctgctgttcagtgtgttcctcaggcccgtccttctgcaaggtgctgcccgattcggaggcccataagttccgccccttttgccagctccttagtggttgtgactcagcctcagcaggcacctcctgcctgcctgtctttgctttgtgacatcagcagtccctgaggcttattagcacccgaggctattggcccatgaggggctacaaatggtgctattctagtggaatcatttcttgcttatttgttagctggaatactttcctgtaaagaggcatttcccttcatcctgtagttagttgttcaaggtgctgtttgcctgagaaagacaagataaaagcttgattctttcttccatttaccagagaatgaattggtttcctatta

SEQ ID NO: 78435 - DNA, 1015 bp, Homo sapiens
ggggtcctcagaaaagaggcgttcccactctgaagtccacgtgaaaagtgtgtggaaagactgttattcttgaagatgctcctagtgcaagatattagcaagactttcctttagagaattggtaactggcgaggagggatccatgcctcattttagagacagagctagtgcctgacaagtgttacactctcttctgcttggagaagcatacgctatgactggcttatggatattcaattttaaattttatttatggaaacaaaattaccattactgtattttagtcagaatgaattttactttataattctataaggccaagaagcaacttacttgaaaaatgagcatactgtttttggtcatttttctttgcaaaataaaagggaaaaaattattacacttagttagagagaggaccttctgtgtgtcttgcaacaaagcagaattggattaatattaagaaaatactccttttataggtattagcaagcattttcatggttagattttcttcagaattgtagtacgctgatgccattttgaaagattgtgaaatggtttgtttttacctttaagaactcaattctttcaactaccgtggcatacgcgttaagcattttgaagtaaaaattacattaaagaaaatgtcctgaaatgttgaaaaattataagcttttttctcctcgtaaacaggtgtatgcttggggtgacaacgaccacggccagcagggcaatggcacgaccacggttaacaggaagcccacactcgtgcaaggcttagaaggccagaagatcacacgcgtggcttgtgggtcgtcccacagtgtggcgtggacaactgtggatgtggccacgccctctgtccacgagcccgtcctcttccagactgcaagagaccctttaggtgcttcctatttaggtaacacagatttgtatcttctctgagatttttctgtaggtttacagcaaccttatagatttatttaattgtgccaacacaattagaggttgtagt

SEQ ID NO: 78436 - DNA, 1051 bp, Homo sapiens
tacacctggggcctcggcgagtacggccggctgggacatggggataatacgacacagctaaagcccaaaatggtgattatacgcatttttgttgcttgcagaaagcttaccatctgaagatgtcaagagaaaataagcttcaagtctaggaaagttcataaagatgtgtgcatggttggctttatctgtgggaaaatccattgctttctccgtgcctgtgcgtgattctgtttttaaatttgtaattgagtaggtgaaagtccttctcggtcacagagtaatccaggttgcatgtgggagtagagacgcgcagaccctggctctgaccgatgaaggtgagtggctggcaggattctgtgcttctgggtgggtaggaatgatatgaaacgctggcctgaagtatatgtgtttcttaaacctaggtttggtattttcctggggtgatggtgactttggaaaactgggccggggcggaagtgaaggctgtaacattccccagaacattgagagactaaatggacagggggtgtgccagattgagtgtggagctcagttctccctggcgctcaccaagtctggagtggtgtggacatggtacgtaaacgtcctccctgtcacactgtgtgtgcttgtgcaggtgtgtgcagggaacctgggcctcgccccaggctcacccggcgtgattgtgacgtgtcctctttttacttatgcatgcatctttgtcctttaaaggatattgagttgggattagtgacaatagtacaagaagaaatttcccattgtaactgggtcattttgaaaatactagaaaaattttaggccacttacctttcctgtttgggtgagatttatgggaacggtttcttctgctgaagcctaaggataaaatggagcaaaatagccttctgaatcctttgatcctgaaaaagttaacatgtgtttcttgtaaaagcttattttattaatatgcaaaagagcaggtgcctggactggctgtggatggtgtgtcaggccttagtgccaatgtcatgacccgaggcagcttgagaaa

SEQ ID NO: 78437 - DNA, 1090 bp, Homo sapiens
ggggcctgaatgacaaggaccagctgggcgggctgaaaggctccaaggtacggcctgctccctgggacccagcagggtggggcactcggcagcagccacacctcgtgaagtttctataataactttactctctatatgttgtattgtttctttacacgaactaaaagacattatcaaattacccctcagaagcgtctctccttgaaaaatttcactttaggtataattgtcttattgcggtcttgtaaactagaaaatgaacttttgaaaagatttgacaagtgcataaatgaaaattatagactgtcaataggtgtatcttgccttccctacaataaacatttttgactatcatgaacaaaataatgtgtaaaaaggctgtagtggcccacagatgagcaaattgttgtctctgtcctccaggtgcttcgcgcctgagattcttcagggtgaagtagcttgcacagagagagaacgctttgcgagcacagagaaacaagcagaatgcacatgtgtgcgcatacacacttgccttattctctgcagggcttgttgtgggtggagagcgccatgatctcattcaccttgtcagtaaaccatgaagcttgcacgggaagccgtgccatagcctctgtgttcacaacgtccttcatcccctaggtacttggatgagaggttaatttgtattttgagttgcttaggagaaaaagaccatattttgaaaagaataggtgtaagaaatgatgcatttgaattggagttgaattcagcattccttgtattacttagtgtctcctggctgaggagccacaaagcaaattcctctaaattttattgcccagaggcactctctgtgttcacgtgagcttatgcttcctgttagtattctgtgagacatcacatcatacgttttctttattgcctgccctattgagaaactgagaaataaagttagaactcattcatttgaactctttcctttcaaggtgcaattagtttttatctgtattggagcagtcttgaattgcatttgtgtttcagtgtacctgagcttggtttgggaagtggacagtgggcagtgagctgtgag

SEQ ID NO: 78438 - DNA, 1050 bp, Homo sapiens
gaagcagcaattccttagcacctggcatcagaccatcagccaagaaaatctaacactgtcctgtgtactcttttcaagttgcaagaattggagtgttttggatgctgttgattaaacttctaacctgctgggtgtggtggctcccacctgtaatcccagcactttaggaggctgagcagggaggatcacttgagcccaggagttcaagaccagccttgacgatatagtgagaccccgtctctacaaaaaaaaatgcaaaaattagctgggcatgatggtgcaggcctatagtgccagctgttcgggaggctgaggtggaaggattgcttgagcctgggaggttgaagctacagtgaaccgggattatgccactgtattccagcctgagtgacagagcatgaccctgtctcaaaacaaacaaaaaataaataaactcctaacctgttgagggcaggtcaggagatagatgagcaaggtggaaggagcaagccctctgggaaggacaggagacgaggactttcagcttagctggccgatgatcaggttcctctggccggtgtcctgggcagagggtataaaggaagagagaagcattttacattgggacatgtgtctgtgttaaagtaactccatggtcatgtggccacatccgttttattctttctgtgggaaaataattggccaaacagctgtctagatttggggatagtgctgcaaggccagacccagcgtggctcctgggcaggtttcctcagtgtctctacagtgccatttgtagcagctgtgcgtctgtttccatggcttggaatgattcccacccatgttcacgttggtatttaagatgaaagagaaggcctggtgtatcatcgttttccaccaaaaataaaggctgaaattaagtgctagtattaaaaggtggcatggttgtatctagaaaatttgaccctccagaggacttactcctgtacatgcttgaggtttttttctattaaagcaaaattttaagagtttctgaaagtaaccataaaactttgagtgcttgaggttgct

SEQ ID NO: 78439 - DNA, 1068 bp, Homo sapiens
tcaggctttttttcctcctctcctgcatagaatgtatgaattcagatttgcttctggttagaagtttttctagtatagtctagcaaatttgtgttgcacattggagtgctgttgtgattacaccaacgcgtggaggcacctcgtgggcacacaggtcagactttaggacagggcctttctccatctcgactgtagtgttttctgtcactcacttggtgggtaaaaggaccaccctaggccaggagtatatagatacatggtttctgagtcttagagtgagacttttctctaacaatcaaagaatggcgtagaatattcttgttgctgccaggttgagggaaaattctctctcatgctacattttatattgaaaaaatctcatgtagattcaagcttcaacgatactattgtagtagctaaaatatagctgaattttgctaactgagaatgtggtttttttgtttttctaaagcactggattcgtttggagattttcccagatgttcttgttcatagattaaaaatgatcgtagatcctgctgacagtagctacatgccgtccctggttgtagtgtcaggtaattcagttagtttacctaaaaagaagtaccttctataataaagacgcctttgtttgattctttacccattttttcctaggtggaaattccctgaataaccttattgaactaaagacaatcaatattaacccttctgacaccacagtgccccttctgaatgactgcacagaggtaagtagctatgctagtgttccatttggatgatttacagatgacaagggaggtgacttggccatttctatactagcattgagcccagtttttccccgtttaaataattggttctttctgttttaaattttgacactttaaaagatacaacttattttgtacaactgaatttgctgcttatcagttcagcttgaaaaggaaacaaatttcattctcactctctttggtagcagaggtatacttggtaactgctcctagcaaaagttttcatcaggcattttaggttgctgattgcatctgaacacttcggttttca

SEQ ID NO: 78440 - DNA, 1119 bp, Homo sapiens
ggctttctctgtcccttgaaagaattaactatatctactgtggactgttccataaaaccaacctatggtattgccgggcacagaacaaagctgtgtttcactactgaagggatgattgggtttctatatcataattacttttagcttcagaacagacccttgttcaaacatctcatgatcttcggtagccattagaagatattttattaaaataccatgttttgacacatcagtttctgacctgagtaaattattcgtaggattaatttggaagtgccttggaaattttgtatacttgtagcttttgagattcattctgcctactatgctactgctattagtcttttttaaatgaagatttttatagagaaaataaaggatttcatcctctactttttaatattatagatttcacagacttatttctttttgagtaggtttatcatgttctcctgtttttttgtttgaatgtatttatttcttgcagtctactggtgctgttgtgacggagagccagacgtacaaaaaacgagctgatttcttgagtaatgatgattatgctgtatatgtgagagagaatattcaggtgagtaattgtcttaagctggagcctcgatccgtttttcattcagcaaatatttgagtatgtcctatatgccaaacatcagtggacagaggcccctgccctcagggagcctgccttctggtgctggaagacatacctgaccagtgagctcatggtacgctagaaggtgctgtgtaccctggaatgagaaagaacagactacagtaaaggggtaggagtgagggcacattacagggatgtggggctgcaatgagaaggtgacatgggtgcaaagcctacagggtgtgaagggtggctgagcaggatgggcacccagacagaggctgctgtggctgccccggtgtagccagaggacagaggggcagatgggctcaggggcagccggagagcacaagtggcctgtccacggtggacatggcgcagggatggctgttttctactagccccacttgtgacacttcctacatacctttccttgtttttcttatgtaattctcattgccatcaaactttaaaaatctaattatgtttta

SEQ ID NO: 78441 - DNA, 1027 bp, Homo sapiens
aatgattattctcagctataaaaggcttacgggtatgtgtggcatttcaggattaagcccatggttttgatgactttcagaacgtttcatttgttagtcgtattggccacactctgacagcttctgtgtcctctccagctccctgccgtggcctttaatgtgaacaacctgcccttcacagagcccatgctgtctgtctgggctcagttggtgaacctcgctggaagcaagttagaaaagcacaaaataaagaaatcgactaaacaggcctttgcaggtcagtacatggtgcttcttgatgaaatagctgccgtcttaaactcgtgtcgtttgtacagtgttcttttatgagtgaattcacggacgtactaaagtcctggggttcacgtgggctcaccatttgttgagttgcggttgggaatgtaaccctgtgttcgtggtaatgagtattttcgagtcagcttttgtcgccatgttcggagccacacttgaagaaccccatggctcacaccctcttctccgtgtcaccctttatcccggaagagaagtctgtgttcacctcttccctcctcctctccatcccagggccctgtggcccagtcaccctgttggaccatggctcacagcctgttctctgccggatccaggggcctctgtcccggaagcgcctggcttgcctgtgacattcaggatggctaagactgtgactgtagcctggcttggctttgccttccttcggttgtagaatgcggctctcctgagtttgtttccatgtttctagggagctcttctctctgctcattctttatgtcctggaagtctgtgtggcttcacccgtaactatggcgtattctgcccactcttcttgagttttctcccctcttgctcccacagacctacgattgctgcttcagcatttatgatgtaagcactttcaactctggatctcccattcacatgtctggttggaggtgcagtgcatgcaaatcaccacatgtccgaaattcagctggctttctctagtagc

SEQ ID NO: 78442 - DNA, 1579 bp, Homo sapiens
ttacctggctgtaaaataatgaatctcaaaattttcacttgattacttgcgttatgagaacagaaaataaagagaggccgggcgcagtggctcatgcctgtaatcccagcactttgggaggccgaggcaggtggataatgaggtcaggagtttgagaccagcctggccaacatagtgaaattctgtctctaccaaaaatccaaaaaaaaatgagccgggcttggtggtgggtgcctgtaatccctgctactcaggaagctgaagcaaggagaatcgtttgaacctgggaggtgggagtttgtagtgagccgagaccgtgccactgcactccagcccgggtgacagtgtgagactctgtctcaaaaaaataaaaaataaaaaaataacaatctgtagtttcctcatcagattttttttaatgcttgtcgttataaattttcttttatcagatcttagctgtgcatttgttgcaagcagtccttccatcatgggacaagaccgaaagggcgagggacatgaaatgcctcgtggagaagctgtttgacttcttgggaagcttgctcactacctgctcctctgacgtgccattactcagaggtgggtggccgtctaccttccctgtgccctggtgaagagcggcgcagtgccgtcactcaggtgggtggccgtttcccttccctgtgccctggtgaagagcggcgcagtgccgtcactcagaggtgggtggccgtctcccttccctgtgccctggtgaagagcggtgtactgccgtcactcagaggtgcgtggccgtctcccttccctgtgccctggtgaagagcggcgcagtgccgtcactcagaggtgcatggccgtctcccttccctgtgccctggtgaagagcggcgcagtgccgtcacttagaggtgggtagccgtctcctttccctgtgccctggtgaagagcggtgcagcagcttctcccctggtttcctcctcagagtccacgctgaggcggcgcagggtgcgcccgcaggcctcgctgactgccacccacagcagcacactggcggaggaggtggtggcactgctgcgcacgctgcactccctgactcagtggaatgggctcatcaacaagtacatcaactcccagctccgctccatcacccacagctttgtgggaaggccttccgaaggggtgggtttgtgttctcagaattaatttagttcaacggtgaacctgtagggattgggcagctccgtgagtgtctctgtcgagctcgctgtttggtctgcactaggcccagttagaggactacttccccgactccgagaaccctgaagtggggggcctcatggcagtcctggctgtgattggaggcatcgatggtcgcctgcgcctgggcggtcaagttatgcacgatgagtttggagaaggcactgtgactcgcatcaccccaaagggcaaaatcaccgtgcagttctctgacatgcggacgtgtcgcgtttgcccattgaatcagctgaaaccagtaggtgaacttgtgcttagttactgcatgataagggaaattgactttacactagaaccgagcaccagc

SEQ ID NO: 78443 - DNA, 1847 bp, Homo sapiens
tgggtatgtgggcgtcctccagtgtgtgtgagagcatgcgtgtattagtggtgtgctggagcgtccgcacatattgatgagagtgagtgtgttagcggtcgatgggcaagtggctgagcgtttgtgttgcaagtgtgatggtgtgttggtagcatgtggttgtgtgggtgtgtgtccatgagagcatgtaagtgggcaggtgactacattcaggtgaagtgggagtgaaagcgtcagtgcattgagccagtgtgtgtgtgagggtgagcatgagggaggcatgagtgagtgtgaggggattactgggtgtgcgaatgagacacccagtgtaagtgtaagtcagtgtaagtcagtgagggttggtgagtgtgaggaagtatgagtgggtggcagcacaagtgtgtaagtgtgcgattgagtgcgagcatttgtgtaaatgtgtatgagtgccttgtgtcagtgtgagcacgagtgatgttattgtgaatgcgtgtgagtgaatgtgagcattttgcttgtgtcagtgaatgggaggttataacagtataggtgtgagtgcaaagtgagaaagtgtgtgggtaaaggtgtgagtgggtgagtaatcggtcgttactagtgttgaggagtgtgagtgcatatgtgagtttttgtatgcattgggaggggtaagtgtatgtgagagtgcatgggagtgtgtgtcagcttgcatctgtttgtgcatacgtgtgactgggattgtgtgtgtgttagtgattgcgacagtggtgtgagtgcacctgaaagtgtgagggtgggtgtatgagtgcccatgagtgtgtctgaataacttagtatcagtgtgagtgtgaggatgcatatgagggtgtgagagtgagtgtgtgtgtgtgagcgcatgtgagtgtgctgaaggaaggcaggtgtcctcataagcttggatagctgagggcagggtgggggaggtgggagggagagcaggtcctgtggggctgtgggcggggtccctcagggggcccagcctccaagcctcagcctccattcagggagtagtggagtcctggagccaggcggagcagaggtgggcccactggtgctagaatccagtggtgtaaacctagtgaaaaactcattttgttaatgcagatgtattaaacttggattggaaactgtctctactaaaaatacaaaaaaaaaaaatatttaagtggtgcagattaaatataagcaagattgtggagatatttaaaacacgaaattaaaaatataatagatgcactgttgcaaagtactgttatttgaattatagatggttttcctattgcctagaaacaatgcatagctaaaattccctaactacttttactacacatacttagaaggttttaaaaatgcccgtagtcccagctatttggcagggcaaggcaggagaatcacttgaacccaggagttttagaccagcctgggaaacacagtgagagcccttctctaaaaaaaaaaagaaaaattgagaaatgtttcttgaactaacttaaaagctgccttccacttctcactttgaattagtttgaattaatttacaaactgcaatatatttgtaaaggagcttattttagaaaaataaaataagttgataaaaaaataaggatatatctttagggatttgtctttagggacttgttaccaagcatgtctattttccctcctgcagcttctccaaacaggctggtgtacagggagcaacaccggagctggtgcacgctggggtttgtgcggagcatcgctctcacgccgcaggtatgcggcgccctcagctccccgcagtggatcacgctgctcatgaaggtcgtgga

SEQ ID NO: 78444 - DNA, 1014 bp, Homo sapiens
attattttttttagaagccgaacaaactgaaaggaacattcaccccactgcaatgatgtttaccagcactattaacttactgcagactctttgtctgtctgctggagttcatgctgagatcatgcagagcgaagccaccaagactttatgcggactgctgcgaatgttagtggaaagcggaacgacggacaagacatgtatggaatgagagatcgagggcccagggagtcagcgctgggggccgcacgcttgtgtctgggtgttcatgtgggtgggtgtggatgtgtgtggattcctttcctgtggctgctgtaacaaagtatacaaacttgggggcttacacagtagaaattctcacggttctggcggctggaaggctgagatcaagggtggttccttctggggctgtgagggggaagctgcttgagggctctgccccagcttctggagtttactggtctctttagcgttcctcggcttgtagaggtgtcacccctatctctgccgtcatcttcacatggcattctccctgtgtgtgagtcgcctccaaatctccccttttcataaggacatcattcaacctcatcaaactgattacagctgcagcgaccctatttccaaacaaggtcacctgccgaggtacgataggggttagggcttcaacatacgaattttgcaattctgaattcaacccataacactggcctcaaacaacaaatttgttctctcagagttctggagaccagaagtcccaaatccaggtgcgggcagggccatgcttcttccacaggctctaggggaaggtccttccttactttgtccagcttctgggagctccaggcttccttggtgttgggacgcattgtgccagtctctgcctgcgtcttcacatggcccctgcccctgtgttctgcatgtccttttctgtctctgaaaggactctttgagtttctttgactctaatccaacatgatgtcacctaaattcttaccttaatgacgtctacagagacct

SEQ ID NO: 78445 - DNA, 1011 bp, Homo sapiens
ctttgtttttctattaataaaaaatatgatgaatatctttctaacttagttattttgcttttttggggggagtaattcctagaagtagagagagtagctttactgagcattttaatatcttttatatcttcctaggatatttatgtatttcatccttccgtttatcttctttttatcctatatcagtaaaatattcataatattatattgataaaacatatagtatggattgttcaaaattacgatcttcattagtactttgtgaatgttttgtgtgtattaaggggacactgtagctacttgttggctcagctattgtttttgacgctccatcaggccccagttgtgacaacgttgaggaagatatgaatgcttctgctcaaggtgcttctgccacagttttggaagaaacaaggaaggaaacggctcctgtgcagctccctgtttcaggaccagaactggctgccatgatgaagattggaacaagggtcatgagaggtgtggactggaaatggggcgatcaggtactcagagatttgatgtgaacacattagccacacattagttatcttctgcacagttctgtacgatattggtgggtggaaattggaataatccaggatgtgtcagttgattgatgacacaggtgttggttcccgagcagccgaagggagtgaacacaagtagggaatcataagtagggcatctgagcagaatcaagtctggaaagagaggcagctcttttcaggaaactcactggcatgaggctcagtttgatgggtcactggaacaagagtgtgagagtgagcaagagagtaaatctcattctgaaagttggtgtagtgaaggctctgaggcaggaagcccagatgctgcccctgtgggctgatggccatgtgctgcgaagtgccctgaagccagtagttagggatctacttcatgggcctgtggccacgtttccatcttccctcattgcaggtctcttctaaatctctgccaggtgcccccagg

SEQ ID NO: 78446 - DNA, 1042 bp, Homo sapiens
acagagctgcccactctgtggaaacccctggaaaatagttagatgtttaaagtaattgcccgtgctttctgcattacgtttattcttgtatccatgcacaagaaatgtaggtgggtgtcaatgcttattagtcagatgtttagagtaatcgcccgtgctttctgcgttacgtttattcttgcatccatgcagaagaaatgtcagtgggtttcaaaatagtcagatgtttagagtaatcgcccgtgctttctgcgttacgtttattcttgtatccatcacaagaaatgtcagtaggtgccaatgctcattaggtatccagccggttcccctgcaaaccatcaccaatgagaacccgtcaggaccgagcctggggaccatcccgcaagcccgcttcctcctggtgatgctcagcatgctcaccctgcagcacggcgcaaacaacctcgaccttctgctcaattccggcatgctggccctcacgcagacggcactgcgcctgattggtaggtctgcacccgcttgagcgcctttgggaaaatgtcaagattttgctttgatttcttttcttttcttttctttttttttttttttaaagctttttgtaaattatggtaagacacaaataggaagtgtaccattttaacgtcacaattcagcggtatcaaatacatttacgattttctagagtcatcaccactgtctagttgtagaactttttcatcactataaatgcacaccatttagccatcagtcctcactcctctgccctccagcccctggtagtcacaaatctgctttccctgtctatggatttgcatatcctggatatttcatataaatggaatcataccatttgtggcctttgtgtctgggttatttcatttggtatatatcagtactttatttttatggctgaaaaagatttcattgtatgaatatataacattttgttcatttatctgttgatggacatttgggttggttttgccttttgacttttgtgaatagtgctgctaggaacatttatatacaaatacttgtt

SEQ ID NO: 78447 - DNA, 1087 bp, Homo sapiens
tgcagtattttgattattaattgaacacattttctaattttcatagtcatttttttcttagaattttgggttacttataagtgtattttataattttcaaatatgtggatgaattttttatttattttgaatgaatttttgaaaacctatttctaatttaactgcattgtagtcagcacacatgctctataagtttatttctttgaaatctgttgagatttgctctgtggcctggcatggcccaatttggtattcatgctgcctagatttttttttaaagcattctatatttaacagaatttgtatgtgtggtattagtttcagagctaggtatgtatttctcccattgtgattgtgggtttgtttatttctgcttgtagttctttcacacagtttgttcttttcattttacctgttgattgatcaatggactgattctggtttctgtatatacagagtcattttttacaggtcagaactgtagaaataatgaggaagtgacacttatacgcaaagctgatttggagaaccataataaagatggaggcttctggactgtgattgacgggaaggtgtatgatataaaggacttccagacacagtcgttaacaggaaatagtattcttggtaagattacacttgttatttcctggttaaaagttacaacctatatcattttaagcagagtatttggcttataaatgatttctttagttttgtgccagcccccacatattttaatgtatctgtggcttcgatgtctgtcttatcaacaaattcagcacatttgaagaatttcctttgattatgcattttttgttttaatacttggaactcatttcaagttctgagttggcccaggcaaccctgggagacagtagaaggtcattatactctggtaaccctcacttttgagttaagcgcctaacttatttcctattcactgtttctcctatatctcttcaggcaagctgaattgaactcatgttgctttttccctttttgtttcagctcagtttgcaggggaagacccagtggtagctttggaagctgctttgcagtttgaagacacccgggaatccatgca

SEQ ID NO: 78448 - DNA, 1048 bp, Homo sapiens
tctgggcaacatggtgagacccccgtctgttaaaaaaaaaaatctttaaattaaattatgactttagtgttcatacacccaaaatttctaggtactctgtagtgcagggtataaaacttgacataaaaaccctgtccctccagtcacatgatacagaaagagcgcaaggacaagggttaacaggcttctgtttgagaaaattattatgggtaaaagatgtgtagatgagaatagcatcatggagcagttagtttgtttacaaagaaaaattttagtagtgaaaatgaaaatttctcaatccttcttcaaggtccagagctaatgggtgttggttccttgctgaagaagtacacagccctcctgtgcacgcacattggagatatactgcctgtggccgccagcattgcttctaccagctggcggcacttcgcggaggtggcttacattgtggaaggggactttactggtaccttttgtttcctgcttgtgtacatgtttattttaggagatagatgaaagctaaagtgtcttctttgctgatcagcatgcctgcatttactctctaaattttctgggcctcctgccctttcacctttgttttttttttttagttactgacagttctgttgttaagccagctggtatgggactcatatcactttaaatgtaattggtaatttagatttatacttccattattgacatttcaataatgaggtcaaaggtaattgtctaattttattttgacagcataataaaaattaggtacctatttaaggatcttaaaaattctgatattacctggtatgttttaactttttgaggttagagcattattttttagtgttttttccctgatgataaacatatcaataaacatttaattttctgaatagaagactcttagttcatagttctgtgattgaaatacagtgttttggaaaatatttttgtaatttaaagggttctgtttaatagctatgcctgtctcaatataaaatataagataattctttagaaatatgctaaaggacaaacatttcttatt

SEQ ID NO: 78449 - DNA, 1041 bp, Homo sapiens
atgacactgtgtttgttctttctagagggtcagatatttctatattagcctcatcagtattttaaatttcgttgtcttaatgtttacattccttaaacattgggaatgtggaagtattcctttggaagcaagatcttctgcagtttggaccactgcgcgcagctccataggcgcacattagtgaagcacgagggcatcattatctcttttgagccttccgtgcccttctgctccgttttggctgaggttgcgcttgttgcagatacattggacacacttggggagggaagccagctgcaggtcatcatgtatgatctgtgtttgtgatattaatttgtcatgatttaccccatcccattttctttttagtagaaatatcttgtttaattttgtaatcctcttctttcctgtatagaaacattgcttctcagactgtagccagattgaaagatgttgcccgtcggatttcatcatgtctggactttgagcaacacagtcgtgaaagatctgcttcattggatttgttactgcgttttcaacgtttgcttattagtaaactttatccaggagaaagtattggtcagacctcagatatttctagtaagttgcttaaaatgtgaaagtgtcttgtatgtgatcggggctcgttactttaggcttttcgacgtgtccatcctatatgcccagatgtgtagttgttatactactaaatgcaccaattttggggcttcattttgcatccacttttttgagttggacctttctataatagcctcgttaatatttttaattttgttgccttaatatttaaattctttagacatcagtaatagcatcctgtatgttcagtttagtcttacagaagatttatcagatttgttccatgtgctatggaatgctggagactggcatgatgtaggaagtaaacagtgacagcctattcatatgtcacatgggggagccagctgggtggaatgggaagaactgttggagaaagcctgggtttcagttacagctcggcttaatagtttagacattaga

SEQ ID NO: 78450 - DNA, 1050 bp, Homo sapiens
aacaagtatgtgagaattccagcttcttcttgtccttacaaagcagctggatgttgcatgtgtggggcacatcacattgggttttgtgagagccagtagcagggttaaggattttagggacttcacagaaggatgctggagagcatcagcagaggcagcctggaccttgattctgtaaaaagaagacactgtttgaaactgcacaactgagttagggtttccaacaaggcagatgggggcctgtgggtaggtgtgtgcattagccacagaggctgggatagcttggcactggggttagggctcagccagcctgtgtgtcttcacacctggtaatgagatcacttgtaaacaatttctttttatgaattacaggatattgaagccaaaaaagaagcacagaaggaaaaagaaattgatgaacaggaagcgaatgcctcaacatttcatagaagcaggactccactggataaagaccttattaatacggggatctgtgagtcttctggcaaacagtgtttgcctctggttcagctcatacaacagcttcttaggtaaatcgtagtagctgtattgtattatatgttatttatttacttttttttgtgtgtgtgacagagttcgctcttgttgcccaggccggagtgctatggcgccatcttggctcactgcaagctccgcctcccaggttcaagtgattctcttgcctcagcctctcacacagctgggattacaggtgtgtgccaccacacccgactaatcttgtagttttagtagagacggggtttcttcatggtggtcaggcttgtcttgaactcctgacctcaggtgatccgcccgccttggcctcccaaagtgttgggattacaggcatcacccaccactcccggtctatttatgtacttattatttttttttaatatttattttttaagacggaatctcgctctattgcccaggctggagtgcagtgtcatgatcttggctcactgcaacctctgcctcctgggttctagcaattctcctgcctcagcctcccaagtagctgggact

SEQ ID NO: 78451 - DNA, 1021 bp, Homo sapiens
ctcactctgtcacccagactggagtgcattggtgcaatctcagctctctgcaacctgtgcctcctgggttcacgcaattctcctgcgtcagcctcctgagtagctgggattataggtgtgcactaccatgcctggctaatttttgtattttttttttttctttttagtggagatggggtttcaccatgttggccagcctggtctccaactcctgacctcaagtgatccatcctccttggcatcccaaagtgctgggattacaggtgtgagccactgtgcctggccctattctgtttctgtattgcaaaatttgacttgctaacaggttgttgaggatttttctgttgatgctcattagagatgttggtttgtggttttctttctttgtgttatactatcttgtctgactttctatcaggggaaagctgaccttatacaaaatattggcatgtgttccgtcctttttcattttctataagggattgtgtagaattagtgttatttcttctttaaatgtttttgaatcccatctgagtctggagattgctttctaaaagattttacgccagacacagtggctcacgcctgtaatcccagcacgttgggaggccgagatgggtggatcacctgaggtcaggagtttgagaccagcctggctaacatggtgaaacctgtttctactaaaaatacaaaaatttcgtcgagcttggtgatgtgcgcctgtaatcccagctactcaggaggctaaggcaggagaatcgcttgaatctgggaggcagaaattgcagtgagccgggatggcgccattgcactccagcttgggcaacaagagcgaaactccgtctcaaaaaaacaaaaacaaacaaaaaaaagattttgcaacttcaatttctttaacagatatagaagtattcaggtgacctgtttgtttctaggaggattttcctgatttttggccctcagatgtgctttacttcatctacgttgtctgatttttacgtgtcaagttttccttagtatt

SEQ ID NO: 78452 - DNA, 1059 bp, Homo sapiens
gacttggatgtggtcaaagtccgctgtggaagtcagttttccattgctttgacgaaagatggccaagtttattcatggggaaaaggtgacaaccagagacttggacatggaacagaggaacatgttcgttatccaaaactcttagaaggcttgcaaggtgagtgcaaatgtaaacttttaaaacccttcaggacagtttctttagtaatgttttaaagttagcaggttttatgttcttaacctgacattccatgagttagcaggttttatgttcttaacctgacattccatgaatggactgtcattagaaacttttactgcctgcttggtataggtattgatactaattggaaagtgggtgtctattacaaaatgactgaaatgtaatttaaacctgttgagttgactttctgtggcaggcacccattaatcactcagcaggctggactcagtaagggttccctctgtgtggtgaggtcacctgtacttgtactgcaggcacactgagaccatgagtgtgcattgtgctgtggagccacattgggaggtgggattgggtccacttgggacaccctcatgtgaactcatccttggtgggtgattcctgcttgctcagttgcaaaggtgtccagcatgcattgtagttggaggcaagagatggaagccaaggtatgtagataagagtgccggcgccttcagtgtgggctgccggtgcaggcagagaggatgggagtctctgcaagaagaccctgagattcttctgtggtgttcttactagggatgttatgctgcaggaagttggggtgggggccatcaaaactatgatgttggagggatctttctaaggtaaaacaggacttttccgtaccacctggcctagtggttgggagatagtcttcatcctaatcgagaactgttgaagggcagacaaattgacaagaaagtaggaagaagggaaaaggcagtgtgagaggtacatcagatggactctttagggttctcttctctcaggggtgggcagcctttttcttaaaggaccagattgtatttgaagtaggt

SEQ ID NO: 78453 - DNA, 1064 bp, Homo sapiens
tcattccttctgttgcagatggaccatggttttgggacattgtgaataaagctgcagtggactttacaagtctctttttttttgagatggagttttgttcttgttacccaaggtggagtgcaatggggcgatctcacctcactgcaacctcctcctcccaggttcaagcgattctcctgcctcagcctcccaagtagctgggattacagacaccctccactatgcccacctaattttgtatttttagtagagacgggatttcaccatgttagccaggctggtctcgaactcgtgacctcaggtgatctgcccacctcggcctcccaaagtggtgggattacaggtgtgagccaccgcgcctagcctattgtacaattctttaacaaacactatttttatatttctactgggtaccatgtttggcatcgggttccaactgaacaaaaagtcatggaggtgttaggtgttggaattctctcttccttctttcacaaggtacctggaaggtgaaactggcctgatgctatgctggtctaaatttggatagtgaatttcctttgttaacattaataagaaataacaccaagaagaagggcattcatgtttgttccctttctccccaaggcctttggaggagcctaaggtgatctccgccttctctggaaagcaggccgggaagcacgtggtgcacatcgcttgcgggagcacttacagtgcggccatcactgccgagggggagctgtacacctggggccgcgggaactacggccggctgggccatggtacgtctgctctgcatgagtgggagcatgcagcaggaggtggcctcttacaggacttagtaaccgccgtcctatctgtttgaaggctccagtgaggacgaggccattccgatgctggtagccgggcttaaaggactgaaggtcatcgatgtggcgtgtgggagtggggatgctcaaaccctggctgtcactgagaacggtacgtagagctctcgccaccctggacaggcccacgaggacacgcatggcagcttccctggaggaagtgagatgagtacagtg

SEQ ID NO: 78454 - DNA, 1011 bp, Homo sapiens
tgcagtggcgtgatctcggctcactgcaagctgggcctcctgggttcacaccattgtcctgcctcagcctcccgagtagctgggactacaggcgcccaccaccaagcccagctaatatatttgtatttttagtaaagatggggtttcaccatgttacccaggatggtctcgatctctcgaccttgtgatccgcctgcgcctgcctggccctcccaaagtgctgggattacaggcgtgagccaccatgcccagcctattatttggcagtctttaaactaatgataatagggctcttctgcctttagaagaattagaactatgatttaatttgcaaatgaaagtaggtgttctccagagtgggcaacgtttagattaaaataaaggttttggttttagatttcaaggccagcttgagatgctgtgctgggttcccacagaggtggttctgcctttctccaggggtcctaggcctgtagggtggtttggtcatgttagtaatctgtgtggatccatcttacctgtggtatcataaatgtatacatgcgcagtcaatgttgtgtatgcgtgtacagcaaatttagacatttacacagtcagtttatatgctgcataaatatatagatgtatagtataactgtatcattgacattgtcatttgatgggtcaaatgagtcaataccaaaatataaagcgtgggtaaaggttaattgtgttaactttaatttttcccaccatttctgaatttttgtttacttttcctttctagcttttgtctggccctctgagccccaatgagagtttcctgaggtacctcacccttccacaagacaacgagcttgccattgatctgcgacaaacggcggttgttgtcatggcccatttagaccgtctggctacgccctgtatgcctccgctgtgtagctctccgacatctcataaggtgtgtgtgcaagaaccgtgttctccatgtgttttgtagctagtaccacttgtaggttctcatcctgggcc

SEQ ID NO: 78455 - DNA, 1052 bp, Homo sapiens
gactggttgtatgttccgtgtgtgtcgtctgcagttcccggcctgcgggcaaaggtgtggaggggctcgccagagtgggatcccgagcggcgctgtcttttgcctttgccttcctgcgcagggcctggcgatcaggtacggtccctggtgtggcgcgttgttctgcttccctaatacatcaacagactgggtttcgaactcggttcagccaccatgtgccctttggctgatcccatgtgctctctgtgcctcagtttccttgcttgtgagatgagaggctgcagaggctgtttggcttttcacatctgtgctttaaagaaaaaaaagagagtgtatgcacccccacccccacgtcaaccactaccatggaacacctgagtacagacttaattctagaaggacaagaagttagtgtattgctcatgtgacagccgtgaaacacagaattgactggagcagctgcgctagattttggcctgttgagtgagggattggaaaggtgacagtggcgtcatctctcgctgaggggtgggaagcccagcgggagagtgaggggagtgggggggctcctctgacgcgtgtgtgcgcccaggcgaggatgcggacctctgcagtgagctgttgcaggagtccctggacgccctgcgagcacttcccgaggcctcgctctttgacgagagcaccgtgtcctctgtgtggctggaggtggtggagagagcgaccaggttcctcaggtccgtcgtgacggggtgagttctttcctttcttgccttctgcacgcagacagctggcctgcttgaggctggttcttaccacccttgctttagagctaagaagcctagtaggttggtttttcacctgttttcagcgggctgtcagtgctgtgattccgggtctgggttctcagcttttcaggcgatttgatttatgatactctgactagacccaggaagctgtgatactaaatgagacggatgagagagaatgcttagagatttggccatcagtcattcgtagaggtttgagtgcttacactgtgtgtctctctgtga

SEQ ID NO: 78456 - DNA, 2910 bp, Homo sapiens
acccgccgcggcgtgatcaagagcgctccgagccaagcagtctcccgtgggagtgcgggagtgcgtgcgtgtggcggaaatcccgccttccggcgcccgctgttggccttggccgcagccagggcgctccaagtaggaagataagcgggattgctggaagcgggagagtcgggaggagcggcgaagggctcctcttccccattggctgcgcccacggagcagcctcgttgcgattggccgtacgcggggggcggcagtcccgcgtcggcccgcccctcgggccgcgagaggcgccgggatcgcgggcgccggctgagccagcggctcttgggaggctgcgtccgcgcgccggcgaggcgaggcggccgggccctgcgcgtcaggtcctggcctggggcacctgggcggccggtggcgggggcggtacgggcgcggggctggcgggcggccgagcccgggaggcgggcgtgggcgcggcggccgcaccggggcctgcgcggaccacccgcggggcagcctcgggcctctctccatctcttaagtggtggtggctgtgggtttttctgcaggcgatccttttgagtaattttttgtttcacgcacgcgccctgctgtggggtaaagcggcagattcatgctgctgtcatttgtcgttaaaacgatgggctccctgttatgtgtgtgtacttcttggatttgagggcagggggatgacattgtgacttggcttcctgtgaccgtccattctcaaggtctcgtcagcgtggtgcagaaactcggcacaccctgcttaccttggaaggaggctttcccttccccacctccctctccctccatctcttccctctttccctctctccccttctctcccctccaccagctcttctctcccccctttctgttctctctctcttttttcttttctggctttcgggagtgtctttgtaaactattaaaaagcgttaggtcttcagcgtatgtgtttacttgcaggcctgagacctgggaggaagctggagaaaagatgccctctgaatctttctgtttggctgcccaggctcgcctcgactccaaatggttgaaaacagatatacaggtggggtttgacatgtctttttcttggtgtgtttctgcttccatgtttaaatttctcgtgtaaggcttttttttagggtatgtaaggggaagtcagttgtatcttgctgaattagaggagcaggtttatttcctgtaacttaaaatgtaacagtctttatggctgtttttgtagatcgtgcgcggctgccttttaattagtttcttgcaagtgcacgaaacttgagatctattaataggcaaaatttttttcctatttattattactggttaagaaatctgccacactcctaaccatatcatggtgactgttgtttgttactgatcgtttttgagctgttgagttaactgtggaggggaaaattggagaagtaagttgcagtaattatggcctatagaaactcactcattttatgaggtcttgtgtttgtgtttctggagagacaagagttagttcagttgagctgtttgttttgtctttgtaactccttattaagaggagtgctcagattttcacatcaagaatgtgaggaaacaatgttggccttagatcctaattttttgatttaatgagataactgcaagcttgtcaggacattattaaataaataataactaatatttcgatagacaattatttacacccaatctacttttatttggaaatggcttggaaaaactacttttggaactccttatcagcagcaaaaagaagtgtttgaaatattttgtgtgtgtctgtattttcctactccctaaggttaaccattttaagtattaagtaatgtgccttgactgttcatcaaaagtcgtgtaggctgttaagcagtagttgatcatggatacttacactgaagtgttattgccccttcctaattttttttttctttttaaacaggtattgagtgttggtagatatgagagtccagtgtttagagctgtgttgcgtggccgggcgcagtggctcacgcctgtaatcccggcagtttgggaggccgaggcgggtggatgccctgaggtcaggagttggagaccagcctgaccaacatggtgaaaccccgtctctactaaaaatacaaaattagccaggcgtggtggtgtatgcctgtaatcccagccactcgggaggctgaggcaggagaatcgcttgaacccgggaggtggaggttgcaatgggtcaagatcatgccattgcactccagcctggacaatgagagcaaaactgtttcaaaaaaaaaaaagctgttgtggatgatgggattgttattcatagtgtaatgttacataagacagagtacagagaattgggtcaagaattggtgtagttactctttgggtttgtttctctttaaacatttcctttgatttagctataatgatctgttttgtcattttaagtggatgggagaggtgagagatgagtactttcatatttctgaaatcctgagattcaggcaaagttttaataattgttttatattagtgtttatgtattttgagaaactttttggagtaaaggactttacgtaataaagtgtttttcttaataattgtaatttaataactgctaaacatgagttctagtgtcttgatctaaaaccagtttaatgctgaattgagttcctatgatgggttgggcagataaacatacagtgaagcaccatttatatcttagagggcctgttgttttgatttattaagtttaatacacagtacttggtccttgttacacatttccaatatgattagaaagtctttttttttttttttttttttttgagacgcagtcttgctctgtcgcccaggctggcgtgc

SEQ ID NO: 78457 - DNA, 1005 bp, Homo sapiens
ggcacagccccagagagctcccctttatccacagccccaggccctcccaccttctgcagggggttccacagccttcttcatactctgaacgcaggctgtcttagtatgtcatgctggttatagtagtgacagtataattatgtattatatctcttatgtaatagtaatggtagtgatttgcatgtgtggagcacctgtagggtgcaggcccgctgaggacctcatgcacgctgttgtatctcattatgtcaatgagaaaactgcctttgggaatggtagtgaactttgccagtgcagaacagtaatcctagttttgaatccagatttttctaacattttatttctagtataaagagtatttattttgttttacagtcattaaaaaaaaaaatacagtcacatggttcaaaaatcaaacctaggcagagacacactgtcgcttcccctgcccaccccttccacccattttcccacctgctccctctgactttccagtctcctctgtaacctccttgttctctggcatgagtacgttcgtggtagcatgcttcattacttgtgttgcttgttttttgttttttttttttaactaaccatatatactggagtaccttatcagagtgtccctctttgtttttataaatcagcttagtcttcagtgtgtggatgtgtcttttatctatctttctttagtgagtctcttattggtggacacttgggcttattgccacaatgttgctatacaaatagtgctgagggtcgggtgtagtggctcacgcctgtaatcccagcactttgggaggtcgaggtgggtggatcacctgaggttgggagtttgagatcagcctggccaacttggagaaaccccgtctctactaaaaaatacaaaaattagcggggcgtggtgacggatgcctgtaatcccagctacttgggaggctgaggcaggagaatcgcttgaacctgggaggcagaggttgcagtgagccgagatcgcgccactgc

SEQ ID NO: 78458 - DNA, 1189 bp, Homo sapiens
ggtgctatgtctgttgttttgtgtttcaaggatcaaagttaagagaaaaaaaatatgtggttgaacttcctgcattgagtgactgaaaatattttcatctctagttttctggaaacggaaacactccaacatttgaagatggttttgatggcgaaaccactggaatgaaatgcacatcattgggcaattctgtgtgttgagtttcatccttctttgtttgtcattttaaataatttcccgacaaatctggaaggcacgtcttgtcttaactttgcaacaaggaggctggggacaggtagctgagctgtgggttgcctaagaacactctgctgtgacggggcagtgctggcctttgagcctgagctggagagagtgtgaggcccatgttttctccctgtctcctgctggggcccattttgtatcagatttgtttttcacggggtgggcatgactaggactcgtgaccactggtgggcaagtacagaggctaattttcaacacgtgccgagagactgatggctggcatcagagagtcatggaaatgccacagatgacatgggcccttcacagggatggggagagggtctgggagcttgccctccaggaaggtggctgacatggttggtgggacatgaaggtgttttccgttttgcacttgaagccaacatggattcttagcacttgttgtccctagaatcaactgcgcagagagatgcttggttctgaaactctcaggcaaggacagttctgaggaaactctcattagtaaatagtgagtcggagaacactattgacatttggcattttcagttgagatatatgtgtacagtcatgcgtcacatgacagtgttttggggaatgatagcatatatgacagaggtcccataagattattatggagctgaaaaattcctattgcttagtgacattgtcgtaaagttgtagtgcagttactttattttttaaaaaaatttaatgtagcctaagtgtacaatatttataaagtctacgctagtgtacagatggactcacccagagaaatttccagtcttgcaagctccattcatggttagtgtcctagatggggtactgtgttatatataatatatatatatgtttttttgagacggagtctcgccctgtcacccaggctggagtgcagtggctcaatctcagctcacggcaagct

SEQ ID NO: 78459 - DNA, 1048 bp, Homo sapiens
agaacacatccctgccattaagcgatgcataactgtgtgtatatgtgtgtgtgtgtgtgtgtatgtgtacgtatatatgtgtgtatgtatgtgtatatatatataaaattttttttatttggttggttttacattcctggaattgactctccagcagggcagctgtaaatatgaattcctccgaactgttgtatgcattgttaatttagtaaagtacagtttatggtttcccaccgttggtttaattgtcaactgtcttggaaaaatccattgttgcaaaaacaggaaaaccactaattgagtgaatgcgtgcatttagggatgatggatttctcaggtctctctggaagcaagtgtgtgccttgtgcaaataaaacatagtttctgtttctcagtcttttgctgtaataagtgagccatgtgctctagcatctgtctggattatccggagctggtggcagctgtcacgggtgtggtgcagtggggccaggcatgtgttaggaactggaagctctgggaagccaggctttgcctccacgtgtgagccagctgtagagcgtcactgctcagagtttgtcttgactcatcctgagaagggcacgtggagatctgtgtcccattcctcaccagccactgagttactatggatggaggagatgagatgtgtgcaactgttctgctacagtaaagcactcagtcagtgcagtcaccaggtttagggtgtgtgtgtgttttaccaacttgcctgctgggtttcagacacctggcactacctccagcctcttactgattctggctagtacttgtgaaagccgtcagctgggtgatgaatggaccgattttggccgcaggtccctgcacttcccatctggcctgactgctagattctgagcccctgaggcaggactgagtgggtcacattaatggctgattgtctcgggaatggcattgggtgaagtcgaggttttcctgacccacagctcctagtagaagtgcctttcttttgtgcatgtattgtgaagattctgcctgtgaactttctctaccc

SEQ ID NO: 78460 - DNA, 1113 bp, Homo sapiens
tttattgtttttgtaaatgctgactttcattatttttcaacatgttgctgtttgtaggtacaaagaaagctatcgatttttatatattaaatttgaaaccattgccttagtgaattctcttattttttaaaaatagatttttagttgttttcttgagtttttcctggcatgcaatcataccatctgcaaacaagaatgatttttgctgcttcctttcttgttttctattacttcttcttgcttaatcagattgggtagaacagaaggaacaattttacataatagtagaatatggcttcctaaaaataacacctttttgaaagatctatgcttttaattttgtcataaaaacttcaagcatatgaaaaaatagcttcagtatttacccattcatggctagtggtatttaatctacaccctgaccctttcccagattattctaaagcaaatctcagatcttacatcatagcctctttaaatatttcatattgtatctctaaaatataggagttctgtttttaaaaataatttcaatgctgttatcacaactaaagttaatatttgtttatgccattaaatatttgtttttgtttgcattttcccagtttacagggcgctgtttgaatggggatccaaacaaaacccgtctattgagattggtcaatgcatttcataattcttttatgtctcttttaggttgtccatccgtctcttttttctgtcttacaaatttttgttggtgttattgtggaagaatctgtcatttatcctgtagattttcctgcagtgtggattttgctgattgcatcttcatggtgttgtttaatgtgttcctctattctctgtgtcctgtaaaatagtggttgtttttagacatagaggcttgatcagattcagtttgattgggcaaaaactttcgtacatatttttgtgttgttctattgaggcacataatatctggtcatctcttttttggtgatattagcaaccattaatgatcattgtctagatctagtaattgattagaagttgccaaatggtggtgttctaatttcatcatttcttcttcattagttagctggaattcttctatgtagagaaactttccctcaa

SEQ ID NO: 78461 - DNA, 1587 bp, Homo sapiens
cctggagcctgtggaggaggatgccgagatgaggggtgaccaaggcacgcccactacgggcctcctgatgatcgtcttagggctcatctttatgaagggcaacaccatcaaggaaactgaagcctgggactttctgcggcgcttaggggtctaccccaccaagaagcatttaattttcggagatccaaagaaactcattactgaggactttgtgcgacagcgttacctggaataccggcggataccccacaccgaccccgtcgactacgaattccagtggggcccgcgaaccaacctggaaaccagcaagatgaaagttcttaagtttgtggccaaggtccataatcaagaccccaaggactggccagcgcagtactgtgaggctttggcagatgaggagaacagggccagacctcagcctagtggcccagctccatcctcttgaaaggtggattcagagggacccccgggacaagggtctgagacccaaaggcacagtttagaggattgggggaagggagaacgaacccagggagcatattgctgtaaacgcttcaatgtgtgtagctttaggatgtgtttgcaaagttttgtttttttaatgttgtgttattttgctccagattttcatctataaacaaaggagcatttgttttgattttactctttttggtataaaaaattttgctagcttagtaaaacgaattggaaaacttgactatgatctggaacagataatgcaagaaggaacacataagtaagttgctttggtgccaagaaaataaaaaagctattatcaggtctcctaactaccccagtttgtaaggaaaaataaaagtttttataaaattaaaaaaaataattgcctatatccttattatgttaacctattttatttttctatatttcgtacatatataagtattattcatggttccaagcaatgagtgtaatgtattttctcccaatagtaattgtttatattcataattattcagctctgctgctaaacacgtagttccacttcgtttttttcttcttgctactgtagttattacaataaatactgtatttttgaagcacttaagcattgtgtgttttttaaatcgtgggtcatgagagaatttcatgactggaaatcaacatcttaaagtttttgctacatattaaggtcaatgctgttttgtagaagttgtttcacttttgtgtgaaacaaaatcaggatcatgaggtgaaatatatttctcactgtggatctcaaaaaggcttataaaacaatagcgtaaccattaaccatgcctgtttgggaatcggactgtctgggttgagatcctggccccaccataactagtatatgaatttacataggttccttagtttgtatgcagatgtttcttgacctgtaaaatggttttagtccgtgatgtggagaattttatttgttattctttaatgtttttattttttattctccttggtctggagctgccactttttaaatataacttttctttatctttttttccaaatcattcctaggagagcaattcctggttcaaaagatagtcctctagtctcactctattg

SEQ ID NO: 78462 - DNA, 1051 bp, Homo sapiens
catcacattattttgtgtcaaaatacatacatgcctacctctaaaagagaaggtggcccttattttttatttttaaaatgatatagtcacaatgccgtgatcacaactaatagataccaataatttggtttatcatcaaatacctcatgttcaaatttctgtgtgcctgtttctctctttttgcattgggttgttaggtctcttaagtctctctgtctctcttctttattttcccttgctggccccagtgagcagaggccaccagagctcccatgtctcttgattatccttcaggaaataaaccacttgagatatacaattaaatggtgatatgttacagtcagtttaaaccgctctctgtggttaaggcacctgcccgttttactggttcacttatttcattttgcttttgattttagggattttaattaatttttgatttaattttgtttcataattatataagacatttactgttacaaagtcaaatctatgcagtaaagtgttttcccctgaaaattctagttatcatttctgtcctgtttgtattccttgtctccccaccccccggccctatagtaactactcttagattttcgctttgtcctttcatttctaaattataagcaagcacatgtgctgtacacatactgcatgtacgtgtgcctaccttgcacattgttccagcctttggttttataacttagtgatatcgcgtggggtcagtctgtagcagtgtataaagacatttcttattcctgtttactgcataatgcggtttatcatttgtctttcatttgtcttttttatttgcttctggtagtattcatatgtaaagatttgtattttatgtagttaagttcatcagtttttcccttattactttggactgtgagttataggaaatatttctcaactttccggttagagaggaattccatgtttttttctaatacttaaagtggggtctctctgtctccatttaagtttctaatctatttggaatcagttctgatataactggtgagaaacagatgtgtatttttctttt

SEQ ID NO: 78463 - DNA, 1028 bp, Homo sapiens
acagccttggcggggagcggaggtggggtgtgcttgcccagcatccctgtctaccccaccccagggctgtgcttgtgctctgtcccagccccatctctgctccccgctagccccactcggctgagctgctcacaggaaggaccctggcattactcctgaaaggcctaagggtcacgaggaacttcattcaagagatgatccatgtgatatgtttccaaatacagcctctagagacagctttcaagaactatccaaagacctatatgtctcctaatattcccatcagttacggaggaggagccagcatttagtaagcacttactacctacggtacgggcacttgtagccttagtggtcatcattgcgttcggatttcatgacagttctttatggtgggattatattgttcccacttaatgtagggaaaggcagccttggcaaagggaaacaacctccagaaagttatgtaatagagctgggattaaacacagacgtgtgtgtgtgtgtgtgtgtgtgtgtgtgtgtgtgtgtgtctgcgcgcgtgcgtgtttaatccaaaacacagactcctcaccatgagtttacctggctctataatgctatgcatgcagtttcttttagcagggcactcctcatttcaataaatagctctgtcctctgcctctgtcagcccctgggagtcaggcctctctgtggacgctgcactgtggatgcttggggacacgctgtctgtcccaggaccgaatgcagtctgagtgcccagtgtttctctgtggcactgaccttccaccagaggacactcctccccactccacctctggtgtggagcagtagctgggtcaactaaggcaacttacttgaagaaatgtcatcaggtgccagctcagcagtcactggagtggcccagaaagccccatgtgttatgaacatcagcaggtgcatagcagggtgctgctaataaaagtaaagacccttctataaagccccttcttctgagggtgagaggaatgtgtcccagatggtaatac

SEQ ID NO: 78464 - DNA, 1052 bp, Homo sapiens
gtatgttttttgagtgtatcggagtctccacagggtgtcatcttgattctgctgtggaaagtggacttggctttgggtttgacttgtatttttccccaatgattcttagacatttctgttctgtcatttaactttccacttaaaaatgaattctgggtaggtctaggtacatactgcaatattttatcttaataaattgtcaaggatggtgttttgtttatattatgatatttatcactctgttggtttcggacttttaaggtgatgggtctgaagagtgtcctaaaggaaaaagctccagccaccatgtagtgggtgtgatttggtgtttctcaccaggcagtctgctggttcttgttcaaagtgcaggtttctgggtgtatagggagactcgtacccccaaccccactgatgtccacgtccttcctaatcgctggaacctatgaatgtattactttacatggcaaaaggggctttgtagatgtggtgaagttatgggtttggagatggggaggttatgccgggtatctgaatgggttcaaggtagtcacaagggccctcataagggaaagagggaggcaggagagtcagagaaggagaggcgaggatggaagcagaactcaggagtgcagtggggccacaagccaagggctgagggcagtctctggaagctggagaaggcaaggaaagggactctcccctggagcttccagaaggagctcagtcctaccaacccaacccattttggacttttgacctcaaaagctgaaaggtgataattttgtattgttttaagccactgagtttttggtcattggttgcagcagcaataggaaactaacagatagggctatatctcaggtaccccaagttggactccgggggttggggctcaggcagtcttcgttttcaaccccgcttctccatgattcgtatgaacagtggaggagaggaaatcattgctctcacttctttgaaagttgttgcaggataacgattaggcctggaaagctttgagaatggaaaaataacaacagcaattaatagtatat

SEQ ID NO: 78465 - DNA, 1067 bp, Homo sapiens
gttttcaaggctttctaatgacctaacatgacagtgccagccctgggtatcatcatggaagacaccagagcttctagtttgatagatgaaaaatgttatgaatgcattattattttacttagcatttcatgaattactcatgactgctttccccacttctttgttggtgagtttgatctttaagattcaagtatttcctccactcaggtaaatagtctgaatccagcttcaaatagaaaaggtcagagagtgagcctaagaatcctaagtataaaagcacgaggcagaattcatggatgcctaaacttggaaacacacgcttcagttcttcttcatggtgtctcaaaatatcacagatcaagttacagtctctcgtgtccttttccaacctgtctatttcctctgtaaacaaagaggaatttctcttttacttcatttctttgtttctggaatcaatatgtagtacttgtgtgcatgtttcaaaacatcacacaaatggttttaactgtgatgtcattctgaaacttgcttttcacagttggtattgttttccacttccatgtgggttgatctgcataaagtcatttaactcctctatagagtgcccttctgagaacatatcccaatcttctgtgttgtgttgttgctgaccgtttagcctgtttctggtgttctgcctttacaacatgctgcaggggtgcataggtagaaacatgttggtagagcctgtctctagaagtagaattcctggggcaccttaatgtcactataatcgtcaaactgctcttcaaattgtttaaatcaatctgtactcctagtagggccaaggagagttaacattcgtctactttctctccaataccaagtattattagactttttaattttagctactgtgatggttgtgaaaaggtatctccagtggaggattcaagttttgtagggcccatctcagttcttttaacagaaagaatacaaaattgtaaatacaaatttagtcatgacagtggatatttatttggaatgaaaaaacaaatcacaatgaattataaacttaaaaatgcttt

SEQ ID NO: 78466 - DNA, 1018 bp, Homo sapiens
gaagttctagagatctgttgtcaaacagggtacatgtagttaacactatagtactgtacacttaaaaatggctaagatggtaaatcttacatgttttttaccacataaaaaccgaaacagaagcaaaacacttgccccagcactccctgctccccctatctgggctctgtttttcccccggagcactcatcattcttttgtgcccaatttaattacttaggaggtctctcccctctagaatgtagacactgcaagggtgagattgttgtttcttttgttcacggatggtcaagaacagcgccaggtattgatgaggcactttataaatgtgttgaatacaagaatgtgctccagatctggctggggccatactgcagagatgtggacatggactcggaggtgctcctggtgagagcctccttagcgtgtccatgaagctgagagcttgcatttgggtgggaatgctccttgtggaatagggacagagagtcatgggtgagacaaggctgccttttgttttcaaagtggagcacatgttcatcattggctgaatgaagttctaacagtcttgctaaaatgagaattgcctgttcaccccacgcctttttaaatgtgtgtcatgcactctcccctgtatcatggcaggtatgtgtatcaacactgtgtcttccctccacggagaaggtggaggggacatggttttgcagagggaaaaattcctcattttgtttgcttcttgctaatgttgaccaatggttttcaaactaggttccgtggaaccttagggttttaaaattccttttcaaatagagtacatccacttttagtggcttcatattttgatgcagcctaataattaatttgacaaagtgttgtgttgtgtttggctttagggtgctttgggccgggtgtaccgactagctttgtcacttggcccctttactgctgggtagttcaaagcaggcggcccttgtggtccctaagatgctttattttgccattttgaaagctcagggag

SEQ ID NO: 78467 - DNA, 1002 bp, Homo sapiens
attaatacatcttttgtatatgcgttatatgctgtattcttaccataaagtaagctggaggaaagaaaatatcattaagaaaatcatagggaagagaaaatgtatttactattcattaagtggaggtggatcatcataaagatcttcatctttgtcgtcttcccactgagtgggctgaggaggaggaggaagaggaggacttagttttgctgtgtcagggtggcagagaaggaagaggtggaggaggtggattttcaactgcagagggagtcaggagaggctggcacacttggtgtaactttgactgaaaaaaatccatgtataaatgcacctatacaattcaaacctgggtttttcagggtcagccgtagattggagattgcctgggaagccccacctgggtgaagggtttgaggggaggttggggagggatgtgtgcagaagatgggtgaccggccgggctggtctgggaggtcgtgaagagggcgggcatgtactgagcctgggtgctgcgggccagcttcgggcctgtgccatggtctgcagagattaagcatgtttggaagtccatgtagcatcactcatcctacctggtgggctaggatgctggagtgggagagggagaccccaggcgtgggaaacagcagagccattctcccgtggggtggcttcagaggcctgctaggcagcgtgggcagtgttcacatgatgacaggctgctcctctctgagtgccctcacacctctttctctcctttttcccttgtttccaggagcaagaaaccccacccccagatctctggggaggggagtattttatgaggggcaggtatccgctggcacaggtgggtgttgaagaaaagtttgtagaatgattgaagaatgactgcctaattccttaacctctctgagcctcatttgatcatttgtgaaaagggggattgacttattgctgtttccaaaccatattgcactgtggtttaggagagctagagaaaattgt

SEQ ID NO: 78468 - DNA, 1023 bp, Homo sapiens
ccacagtgagcttcgattgcaccactgcactccagtctgggtgacagcgagaaatcctatctcaaaaacaaaaacaaaaacaaatacaaaacaaaaacaccaaaaaaaaccaacaacaacacacacacatagacagaaccctcccttgggcatcgggtaaaaagtcctagtcatttgaagatatagtacactggaatgctcatagccaaattctatgctaataaacaatgaaactctgtcttaatattgttttctggaaattttttgaaataatttctaacttatagaaaagttacagaacagaaccaagaattcctgtgtctcttctcttaaattcccgaattgtaaacatgttattgcatttaccccatggcttgagcttgtgcacattgtctttctcaaggtaaaaaaattctcaattatcattagtctttttctcagtgttttgggagaaagctgtggacatgatgttgcttcacccctaaaaaactcagtgtatattctcaccactcatggatgctctttatgtactcatcataaacctctccaaattaggaaaacaacattggaagaacattgttatccaatctgtagaccccattccaatttcatcacctgaccaagtagtgtttctttttcctctctggcccagggtcctacccaggaacatgagcattccttgtgtgtcttcactctcctcagccttcctctctgtttcacgttttccacagttttgaagggcacaggccttgcattctgtaggatgaccctgaacctggatccatctgattatcctcatgggcagacttggctcatgcattcttggcaggacaatcccaaagttgatgccatgcttttctcagtgcatcgcatcaggaggcgttgatgtcagcccttctcaccattggcgatattcaccttgatcacctaacattattgctgtcctccaggtgttatcattttaaattcaccatttcccctttaattataatttgtgtaaggaagtctcagattatgccaata

SEQ ID NO: 78469 - DNA, 1053 bp, Homo sapiens
ttcttttctttctttttttttttgagacagagccttgctctatcgcccaggctggagtgcagtggcgtgatctcggctcactgcaaactccgcctcccgggttcatgccattctcctgcctcagcctcccgagtagctgggactacaggcgcccgccaccacaccctgctaattttgtatttttagtagagatggggtttccccgtgttagccaggatggtctctatctcctgacctcgtgatccgcctgcctcagcctcccaaagtgctgagattacaggcgtgagccaccgcacccggccggaaaatgtttcttttctttttaaaaacaatttacaaaaatgacattataccacccatattactctgtaacttcttttaaaaatttaatgtataacgaatattcccagccataactcattattattattttttaacacattatctttaatggctgtggagtagtccaaagtatgaattattacaagttattcagttattctcctgctgggaataatctctaccagttctatgtgtctacaaacagtgctgcttatccagcctgagatgccactgctttttttttttttgaggatagattccccaaagtggaattgctagctgatgagtattcaaattgggagttttgttagctatttctggattaattttcacaaaagaatgtaggcacatccacccacagaagcctacagtgtgtgcccctttttctgtcctcttgcagcgtgggatattagcaaggctgagcatttttattaatttcatagaagcagaaagatatttcattggatctgaatttccatggatactttattatgtgttgcaaatattttctcattttgcttaatttttgatgtcttgccagatagaaaactttaaaacttttaatatagtgcatcaattttgggagtactgacagttttatcatattaaatcttccaattcagaaacagagtatgtctcttcatttctttgttccttgttttatgcccttcagaacatgttttatggggatgtattcatggtggcaaagta

SEQ ID NO: 78470 - DNA, 1661 bp, Homo sapiens
aggagaagtctgaaaattaaaaacaaaaaacaaaaaactgttcttaatggtgtgagttagaaagaacgttttaaaaaaaatttttttagaagtgtgaaacacctttggaattgttagatgccagcagatctgctttgaaatacagcaatgtgttttgatacaaattcaatatgctgaagaaacagaagaaaattatgtctaaatatacgtatttgccctataattgcaaagcattacggatagcagtttactgaactgtaaatgacatcaacttcttttctctcataggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttctttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaag

SEQ ID NO: 78471 - DNA, 1093 bp, Homo sapiens
cggtggctcacgcctgtaacctcagcactttgggagaccaaggcaggtggatcacgacgagatcaggagtttgagaccagcccggccaatatggtgaaaccccatctctactaaaaatacaaaaattagccaggcttggtggcgtgcgcctgtagtcccagctacatgggaggctgaggcagaaaaatcacttgaacctgggagatggaggttgcagtgaaccaagattgtgccactgcactccagcctgggcgacagagtgagactctgtctcaaaaccaaacaaacaaacaaaaaagaaataatattctctgcgataaccctgtcagtaaaatctgttgccagaaacttatcttgttaaagtaacttcttgattatatggagaaataaaagtgaaagcacgtaatacagtagtagtaaaagcaaagcacctgtgtattattaggaattcactcactagccatttctgaactttcagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtaaatgtgtttatttttctccttagttttgataacttaagagttgccctgtgtgcacttcagagcttatagtgcttggctaataatgcagcacctctctatctccagatgagtgctgtagcgaggggtgccctggggacggtgttgcaagcaagcagtgggtggcctgaagcaaggctgtggtgaccacactgcctgcttttacttttggtgtgaaataaaaaatgatggcataggacaggccacgggatgtctcacctgctgagcagcctaggctgacctaaccaaatttgtctttgaatcagtcagcctttgcgtctctggagatgggttaggtaacacccactcagaaaggctttgctgtgccttcacctgattggagaacctaaacctcttg

SEQ ID NO: 78472 - DNA, 1897 bp, Homo sapiens
tttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgaggtaagacttatgcctttgctcaaagcattggccctgtgatttttctcatgtgagtttgttgtagtttatttgacttgggactttaaagtgatctttttaactcaacctttaaactgaagagtgttgttgcaatgaatgctgttacatagaaggtcctccaggaggtacaagatgttggtaaaataataaagctaacagtcgtgtatggttggtaggtattgtcatcatccctgttttactaagaactgaggttgagtgacagtaagcagtttgcccagggtcacagctagagtgaggtgagcctcaatttagctgctggtcatccgacctctgagcccatgcttttttttttttttttttttgagacaagagtctccctctgtcgcccaggctggagtgcagtggtgcgatcttggttcactgcaacctccaccccctgggttcaggcaattctcctgcctcagcctcctaagtagctgggactacaggtgtgtgccaccacgcctggctaaattttttgtatttttagtagaggttttcaccatgttggccagactggttttgaacttctgatctcaagtgatccatccgcctccacctcccaaagtgttaggattacaggcgtgagccactgcacccagccaggagcccatactcttaaccagccatgaccttttgtaacctcctgacctactggtaaggtgcatgtggaggacatctaaaaacattaagtatctatgttcctcattcattatttgttccacaatgatgctaagaagaaaaatagaataacctctgactgtttaaagagcagcagttagtgagatggctgagcaaatgagacaaagtgagcccacctggagcctccctgcagctcctctttcctgtctttcattccacggcgattgaccagatggattctggccatacataaaagctcatctcagcctcctacagccagttccattttcacgccaccataaagcagaagcacttgcaggcagggagaaccaaaggtcaggatggccacctgagtctgctttccaagagaaaggatggttatggcggtcactgccttcctagctctgcacatccacagatggtcaggggcggacagagctggcctctgctctgcagctcaggctgcgctctgctcccttgatgttgtgtcgtaggatgtcgtccctggcactccggtcatgctggagtgaaacggcagctaccttcatgtaattctgtttcgttggtctttctgctcacctttgagccctggctcaaaactgtactttcaggaagttgatagcctctacttttgaagcagtcattgataccacatcccctttgcctttggcgttctgtgattactaagttaatctactgtctctctttcgtggatgtttgggatatgcccatacaagggtcttcgcctcatggaaccttggaagccttgcctcctacagccagagcgggcgcttggtcctcagggaatgctgaggca

SEQ ID NO: 78473 - DNA, 1349 bp, Homo sapiens
cactgttgttgttctgcattgtagagagagacactgaggctgagaggggcaagtagcttacaagacttagagctggaagagaaacctggcctgctgctcctcagcctgagctttttcccatggcctcattgcactgccaataagtgacagattagatttgaatacagctcttctgattttgttttttgactgaatatatgtttgcacttaggataaagaagagaactgtctaatatgaatttacttaatgacttgctttcttcctcatctgctttgtatgccttctagaactttagaccatatagagttatttgttcatatgagaatcattgagatcctggactgagttcttaaaaatccctttgaaagttcttaaagtctatcatttactgttcttgaccttggtatatgtacttctcaagatgttcactgtctcggttacattgccctttgtctttctgattaactacttctaacctgctgttccctaatcatgtaatcgtttagcttattatattgtgttaaaggactcatgagccagaagggggctgccttttgagtatactctgtgaggacatgggatttgaaatatccattttaactgttgggactgctcagatcctcagtaatcacagcagttagtaattattgaccttttagtcaagataagacttacatattctacttccttcataacattaatatttaaaaaggtgttccgtttgtcattcattatctgttaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgccgccagccatctctccgagcctgcaaagccagcgcattctcagaatcaatcaaatttttctagttattcttcaaagtaagctatttcacctggcttttaaaaataggatgcagcatattaatcccgtgcagttcaatatattttgaagaaaaataatttaagtgtaatatatgatttctgtaggctctagtggttcagcattgtacatactttttagttctgggatgtgtgttttgtttttaaagtctgctattagatgtacatagtttttgcattcacaaagatgctaacatcacagggttttgacggaagacagtgtcaaccacaaggaccctcatcgataggtaatcatcagtcttcacttctgtacacacacctaatgatgtcatgctggttctttttcttttctgtttttattttttaaatataaatacagatgtgaggaggatcctg

SEQ ID NO: 78474 - DNA, 1841 bp, Homo sapiens
agtgtcaaaatgaagtgtaatcaatagtgcattaattttctactaaatttaatatttatctttaactcactgtttatttagtacatgctgaaacataaaagcccctacctgcattataaattttgagctttcacttaaaccagctttttccactaatcttgtctatcctgataataaatggtaaaacataccattttcacatattaaatcgtagtttaatatttaatcacagtctaataaaatagactagaattagaaacaagactttgtccttaaatgtgaattttttatacaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaaggtaaatatgtctttagtgccttggatgcatgggcacaccgtttaaaaggcttcttggctctcccctccgccattacatgatatctattctgttaattatctgttccttaggcatatttgtcttttttttttttttttttttaaacagcctccagaagtagcatctaaaccttcaggtgctcccatcattggtcccaaacccacttctcagaatcaattcagtgaacatgacaaaactctgtacaggtgagtacactttgtgctctttgtggcatagaactgaccaggaatttaaccctcttagtcaataagaaaaccttttactgtgttagtagaggagaggtgtgaataggaggagtttgtccttaaataaaaactatcagctctcctaaacagtgattctagggggaaaaaaagtagaactttatttctgacaaatctgacaaatctttatacctttagcagactttcggaaagatattctccaagcagatgattaaataaacatttttaagctctgacatttgtattatgttttttagttttaaaagtgcttttcgacatgtgaactcttagtttccagtggtgaggaaacagactcagattggttaagataactaaatcatttagtgagcatgcataaggtgcttgcccttgtgctaagcacatcagca

SEQ ID NO: 78475 - DNA, 1383 bp, Homo sapiens
gaggcctcaggcaacttacaatcgtggcggaaggggaaggaagcatgtcttatatggctggagcaggaggaagagagttggggaggtgctgcacacttaaaaaaacagatcttgggagaattctatcacaagactgtgtgagggagatggtgctaaaccattagaaaccacccccatgatccagtcacctcccaccaggcccctcccccaacactggggattacaattcaacatgagatttgggtgggaacacaaatccaaaccatatcagttgtttcctaaacataaatatattagctcttattcaacttttgaactgttgggtttatttcataggtattcttccatgtgctattctgtcagtgtgtccttgtttctgtgagcttagtttggtaacattctccctcttccccttgcttaaaagggctgaagagctagtgagtaggttttataaatctgagcagtgtcagagtttcttcgttgtcttccagggctgggccctggagtctaactttgtcctggcttaccggccactgtttccttcatccatgcccttcagatctcaaggggtgctccatgtgtctgcgtgtgtgcttgtacaatcttcttgacttttccttaccagaagtttcaagaagtagatgtgacttctccagagaaagatatccttttcaatctgccttgtacgataaaggccatctcttaaagaactactgaataaaatttgtaatttacttttatttgacccaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacaggtaagcagcaagcattcaacgttttgtagatagaggtgcattattaaattttagaatgtggtgattgagttaaaaatatatatgttgtcctttctccagattaagaattaatcttcaatttcaatttgagagtaccaagggcttaattctaaattttgtgtgtttgtcttaacacagcaatgtactggattttttttttttcccaaaaagtttaggacatgaggtcataattttgttattcagcacacttaaaatgtatgtctaccaatcactataaattga

SEQ ID NO: 78476 - DNA, 1058 bp, Homo sapiens
aatagatccttcctggctttgaattttggttttctatacgtccaaatggccagctttaaaataactactttctattgtcagtctttctggttttatagcaatctttgatgggaaggtctgtttattttgtctggagagttaatcatttcctcagaatacaccattgagggaagctttttttttttaaatgtcttttacctttttcagatcagtgcagtaagttttggttattagggaagattgagagtatctctggtttttattttgttctttgtacttccttgttggtttggtttttgttgtgttttgcccccgcatggtccctaccttcctctgcctggctgtggctacagatgctctgacagtgcatgctgcatgcttaggaccccccatgtcctctacccagacatacacagcctctgcaaggagagctgttaacactgagaggcagtgtctattgttctcacctatagtaatgtgtcagaactatggtttttctcattatgaaccagtctgggggatggaccatgcatacgagagcctaagaccactctgaataacatgtcagctggaactggataggaaaatgaaggtggaaacaaaccacaccactttacatgaacacactattactaatttctacttttgcagcacttgaaaggattgtagtcttcatactaaccttctatagcaacacaattctgttaacatcctttggcaggtccaatgttaatagctttcactagtgaattcttaaaatgaaagtagtctataaatgttttcccaaaatgcacaaagtatacatttgtagtatctgagaggcttttttaaaatccacaaatcttaattttctataaagtattttagtgatagtcttgtgtgctttctttgcttggttttaaaataaaggtccaactttctagctttttatgtgaggaaaaataggttatttattatcaggctagactgatgcattttgtaagccagaaaaggttgttacaacttacagcttatcttcctgtcctcttctcttcaagtatatttcatagaatagattc

SEQ ID NO: 78477 - DNA, 1050 bp, Homo sapiens
caccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaagtgagtatgttaataaaggccttctttcagcttacaatgtctgggcaacattaagtaggccaaaatgttacggtgttcaaatactaaaacttacatgatactttcttggaaagcttcctgttgtgttaacacctgctgtttggttaaaagaaaatatacagtagcaaaatagaaatttcaaatgtttgcatcctcagataccatctttcagtaatgacgatttagctgtaagcagggttgaattaattctgacttttggcagtgctctaaccataaaactacatcgttaatttattttcagctacaattaacttaaattcaatgaatgatggttggtatggtgcgctgaaagaagcaattcaacaacagcaaaaccagctggtatgggtttccgagggaaaggtaagacatttcctattacttttttgacttgttcagtaaattatgtaactaatcagagatgcttttgagataccagtgctttctaattagatcaacatattggagaaatttggggaaagttagcttttaggtttttataatttgtgtgtaggggttatgaaagttgtttctgatggtaagagaattcttaaattttctcacctgttgaattaccactgcagtaggattgtctcctaaagaatcttaaattataatgaagagcaggttgagttctgatgctgcccctgtctggctatgaatgatgactttgagcctggcttcagtttcctcctctgaaaatgaggggatttggatggcctagatgagcatctcccaaagtgctgtcctcagcatgctcaattcaggacttgctctaagagagaaggcactatgaaggcaagcagcggatgggaaataaaccct

SEQ ID NO: 78478 - DNA, 2179 bp, Homo sapiens
tttcagaagaagttttgttttgttttgttttcttttgtttgagacaaggtcttactgtgttgcccaggttggagtgcactgacgcaatctcagctcactgcaacctccgcctcctgggttcaagcgattctcctgtctcagcctcccctagtggctgggattacaggcacctgccaccgcacctggctaagttatctgtagatgacatttcacctgaaggaagttggtggtaacccttacccataaccaaacttaggatttttagatatgggaaaagcaagtatgatgacttacaaagctctgccttaaagggtaatacattggtttaatcaggtttactccacaacagggaattcaggtagcttagttttatatcttctttgagtctaatgacagtcttttgagttgaggagttagtagcattttttttccagccaaaattcccagttgatctttcttcttaattctccagtgttcactagatttgaaattctgccctgcttgcccatggtgctttgtcttatggtagtctcattctccaaaatcatttatcttgaacctcagtgtgacttgtctttccagatctctgcctttgtctgatctctgaaacaccaaagctcttcctttcctttcaaactttccttgtgaccagagtcacaaacgttgctgtgctctgagatggttggttggaaaccagcccaagctgcatttggcacagtatacaccagtgaagacaggttgccaggatgaagccataggctgtctcacagttacagatgaacagcttcctgcccccaggttccccttctactgatgtaactaaggtctctaacccagaactccctaggcaatccactatagcaccattaccgatggttgatggacatgccaaggtattgacctcttaagccagtagtggctggttagagcttggcaaaggagcagccccctcagtttatctcagtgtgccatacaaataatattttctctggatgttacagtgtgaaaaagggtgggaagtagtgccctgttgagccatattagagccccaggcaaaagaaaaaaatgtgcattcctgtatattttttcttctttaatggctaagtttttttccagaatattaaagtagttgaaaaaatagtgaaaaaaaaaaagggaagtatgcatattaaaactcactttaagtactgcatgcataagacagtttccacaaacaaagtactatccagtccggcatatcagttgtggccagtagttgagaaactcctgtctaaccagtgaaaatttgatgtcttatttttgtcctgacataatgaatagagagtgaaccacgagacgctggaactgaccaacgtagctctggcattattcgcctgcatacaataaagcaaatcatagatcaagtaagttattaaaacttgacccatttcattatgttattgtggttttgagtgggatgggatttggttaatttgaaagtagaaggtagtttttctgagactattactgacatactataagaaaattaagcccttactgaaaagcattataatgattactttcaagagaatagttactgtaggcatcagaagatgatttttcattaccacaaaacaagtgtatgatttttagatgtaattaacagactgcttatatattatatcagtacaattcaagttgtagtttgttatttacattcataaggaatgtcaggaacattaaattcttaaacatttttattctaactgtacgtggataatactgtcagattgcggtgttagggctaagtcttaaaagtgagcttcatagaaaggtttttagaaatttggctagaaatggaattgagttaacttacaattagttttttaatatgtgctcctgagacattagaatacaaagagatctgttaccactgaaatatagtacagacttttgactttttctgaatgtgatggggtgttttgttttgttttggtttgtatttgtttttgtttttgaggtagggtcttgctgtgttgcccaggtgggactgcagtggcgtgatctcggctcactgtagcctctacctctcaggttcaagtgattcttgtgcctcagccacccaagtagctgggattacaggcgtgcaccaccatgcctggctagtttttgtatttttagtagagatagagtttctcca

SEQ ID NO: 78479 - DNA, 1052 bp, Homo sapiens
atttgtccgctcagcctgttcaaacaaagtttccagcttatgaaagagtggttcttcgagaaggtagtttattttctacagactaacctaataccctttaacgtcaatatgtttaagaaagaaaaggtataaaatatgctgtttttcatgtgaatttctctccagctggatttctgaggcctgtaaccatttttggaccaatagctgatgttgccagagaaaagctggcaagagaagaaccagatatttatcaaattgcaagtaagtagcctcaaggctaacttaaatgaggttgggagttacacctctaaagtgagtgagttctgattcactcattcaataaaaataagactttttgtcagtgaaaaattagcagtttatcccattcttttaatttggtgagaaaaccccagtgaccatgtccttgttccaccaattcttttaatgagaaaagtcaccgtttaggaaactcttggcttcatatgaaaattgcataacatacaatgtcattgaatcctcccagtcatgctctgaggtaaggagtataatatccatgttacagttgagtagcctgagacttggatggtcattgcgtggatcctttccagtttcttcagtctaaacttcctggtggccctcagtgaacaagtgacaagactcggctttgaccacagccctttcttgctccattccagctcttttagtcattaaactgacaaatacacaaatagttaaaaagggtaataaaacattgctaatattatcagctgttgttattgcagacatttataataagatagtaagtataagtattgaggctgcagtgctttgtatgccaaatacgttttgcttacagatccttgttttatttactttcttttttttttttccaagccaaactgtatccagctttattaaagatactttccataaacaatcatggtatttcaggcaggacatgggcagacaatcgttaacagtatacaacaactttcaaactcccttcttcaatggactaccaaaaatcagaaagccactataaaacccaatga

SEQ ID NO: 78480 - DNA, 1030 bp, Homo sapiens
ctcagcaacttgtaaaaagttaccttttttcatctaaactggttaaattttacacagatctttaatgtcaggacacactgaatactatttaaataaatttatacctttaactcactttatttgtttctgtttttttaaaattagagtgtattcttttctccaaagtaaaataaagtttttggtcttaaaagatgtgatattttcggccgggtgtggtgactcatgcctgtagtcccagcactttaggagaccaaagcgggcggatcacctgaggtcaggagtttgagaccaacctgcccaacatggtgaaaccccatctctactaaaaatataaaaaaattagctgggtgtggtggtgggcacctgcaatcccagctactcgggaggctgaggcaggagaatcacttgaacctgggaggtggaggttgcagtgagctgagatcgtgccattgcactccagcctgggcgacagagcgagactctgtctcaaaaaaaaaaaaagatgtgatattttcaaattaggtagactgagagtatctgtgtcctgcgtatgttattttcatattcttaaacagccaagaatgatttatgaaatcttatttattaggtaaacaacgtagattttacaaatatcataagagaagaagccgtccttttcctgcttgacctccctaaaggagaagaagtgaccatattggctcagaagaagaaggatggtgagatgctgtcagaaaatggaggagataaacctgtagagtttgaggacttacaaagggatttattccatttttaaaaaataagtcactcatagttgagtgatgaatgaatttgttaatctcaaagaaagttatgtaattctaagtcatttaggagcacagaatttcagatgattctcattagcagagcatgctaataggactaacctttatagtattctaatttaaataaaatgccatccaaccctttacaagtgatagaaagtgttgatttattagccatcagaaccatacaaaagtatatatgagcagct

SEQ ID NO: 78481 - DNA, 1033 bp, Homo sapiens
cttggagccttattttgagtccatcgtgttaggaaaattagccaatttatacttcaatttctacctttattttaaaaaatttgacttttcagttattaatagaaatgatgtgtgaattggggtggaaaaaatggaagatgtttttagccatttggaatgtaccataactctttgagagttgagaaaacattgttttacaaagtaattttataaattagttatgtaaaatagtacttgcatattaaatttgaatattccaaaactgttaatcagaaaatagtgttattaagtctgatttgaattctaacactaaattttatttagtaaaatagtggtatgagagaagttttagaaatgatggttctttatttaattctgaatatagttttcactgtagtgattgctataacgttttaagctcttcttaactgtttcaaatgaaatatctgttttaacaggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtatgtcagtattgcaacttatgtgggttaaaaagtatttggatcaccagaaaaaggtatcaaacaacaagcttactattgtaattagattgtaatctgtaagcagtctccattgagccagttaaactttgaaagtcaaaatccatcaggtctaccttatgctggacttctcacttcccattcttgtatcttgctcttgtttactgctatattttgtgttagtaaagaatgtaacatttcatttctaccactcgtgttcatggaaataaaagaaaataagtcttatatcccgatgataatatctaccaggtagtctttggaagttcaactaaacattcagactggcaggactctgccatgggccacaacttggcagcaagcaacatcaagtgttcctctcccatatgagtcatcttgaagcaat

SEQ ID NO: 78482 - DNA, 1026 bp, Homo sapiens
gtcagggttagaagaggatttccaaagtcctatcttttgtttttgtttttgttttgctttgttttaaagagacagggcctcactctgtcacccaggctagagtataatggtgtgatcattgctcaccataacctcaaactcctaggctcgaggaatcctcccacctcagccttcggagtagctaggactataggcaacgagccacgaaacccagctaattttttttttttttttttttttttttttagtagtgacagggtcttgctgtgttgatcagggctgggaacaaactcctaggctcaagcagtcctcctgcctcagtctcccaaagtgctggcattataggcttgagctgccacacccaactgagacctggagtcttaaggactttgaggaaatatttaaagaggtttcagtacaatgggtttaggagaggaatctatgagaatgcttttgacctggctaggataccactacaaccaaggggcttggaccatttgtagtaaagctggtaaatagtttcatggagggatcaaggatgccaccagccagtgagagacctcatctgatttctcaggctcttacttttatgactagctgatgttagttccaggtcaggtaacccaatcagaaatgaataaatagtaagttctgaaagttaaggcgatctctttagttggcttaaagagactagaaatctctccttcctcaacacatttcattcatttatttgactttttgttgttgttgttgttattgttatctattagtttctaataatttggttagtattacataataaagagtatagggatttttttctacacttcttgtcagaataggtaaaatagtgtattttcttgctaggaatgtgagagtacttatgaatccctagaagggaaatatagtgggtaatttttaattacagtctgtttctatccagtcagttcttagaaggcatcctttagtatttgttttaaggaatgtcacaaggtttcaacactacactgatgctagaggtgggtg

SEQ ID NO: 78483 - DNA, 1569 bp, Homo sapiens
ttctttgaagtttttgaaactgaaactcagctgctttccctcatgcctcattaaatttgataaaaaatggatctgactgtggcttgctccttctgtgggcatgcatgactgatcattttgatataaagggtgttacagttggaatattatcaagacttactttgatctgctttaccacttggcatatctcctaggtggtattccatacccccattcagtgaagtctcagtgaagttgtcaacatttgctgtttttacttcactacttacccctcaatcctctctggtctggtatcttttccgctctgcccccaaaaatgttcacactaaatctagtggaagtttttcagtctctagcttgcttgccttttcagtatcatttcacatggttaaccactccttattttcaaaaataatgtcttctttggtagtactgtatctttctgtttttttcccccacctttctgtatcttttgcaagctcattctcctcaccctgccctttataacgttctgtcagtttctctcctagaatctttttttccacttaaggtaactttttttttcttttcctcaggttgaataacaattaatttaggcaatctcatctgctcccctgcttccagtcactgctgatgatggcagaacctctttctccagcccaaatctttacactcttgtgttccaactgttaggcatattcacttagatgttcctgtaggtccctgaaacacagcacatctcaaatgaaactcatctccctcttaaaatttttctttgtatttctcatgaagtattcagttgaatgtgtttctattgatccagtttctcaggccattcccagatgacatggtagttacccttgccttctctttttttcccatgcatgatgaatgtcctcactcctgaataccactcttatccatcccactctttctccactgcctccacccttttccaagccactgtcatctcttacatagactcatttggtctcataggttgtctcttggatccctttaagttgattctgcagatttcttcatagatcctctgtgacacttctgtcttactcttttgcccctttctttattagttctcagtctcagctacactagacttatgacttcattaggtccaccaggtttttttcttcattactttgatgcatttgttttgaacttttcagccgtcactcaccccatgcatcccctcccccacaaacatacccttcaggtttaggtctttcttaggtaaagttttaactttagtatatcttcctcagggcggccttctccttccccctagtaagtgaagaacccttgtgtttctgccctctgaactcaccgcatttgggattaccatgctaacatcctttttttcactgactgcaaattgccagagtgcaggaactatctcatttgctgctttctccctaatgcctggtacctagttcatatataccccaagaaatatttagaatgaacgaacaaactaatatacaagaaatattttggggtcatctgtgtaatggtcatttataagtgtttaatcttgaagaacagtctttt

SEQ ID NO: 78484 - DNA, 1031 bp, Homo sapiens
gaggggaaatactgaaaaaatttaggaggggagggggagtaaaatggcactgatcttaaagcaggctgagtggctgggatcttgaagaatggttgtagaatacctacattagcgaattccacagagaggcaacaatatgtagatgaaaggattgctgaacaagagcaagacttctgtaaaatgaatttacagagggcctcatcagcaaagtgtggaagtgaaggtaataataggactggagtttgtcagggcagatgattgaggggtcaagaaaaagtcatttaaatatggcaacaggatgtctcatgcaaacttagggggaatgcgagtgaaaccaggatggaactgatgaactaagatgaaggaattggaaataagatagtgaaaagtttcagtagctcaaggtgtccgacatagaagacaaggagtgatacacaaggagatcctgtagaactacagtgaggtcaagtgtatactattgtgagaaggcaaagtgtagtccacagattacagggccattcagtcagcaggtgtaatacatgtagatcgtcagcttgcagagaatgaaggaaataagtggacaggcaatacagagccagttaccagaatcattgagaaaagaacgccagagggaagaatttgcacctagactgggagtacaaattgaagagatccagagactgaaagcagtttgtgttggtgaagtacggctgagttaattagctccaacatattattgaatgttagtgcggctatagaataaattatctcttagaggtctggggcaattgtgggctttgatattgatgcattctaaaatttttaaggaagcaagttgggcatggaagtttgctgtggttttggtagcacctagagtatatttgatggcattagagtacagtgctgtcctttttattcaaaccaccaacagttgttagtttccctgtaagcttgtgattattacaccaggaagatctttctgtgtgaagtaaataaagaggtttttaggcccactcgttcttatttgtgct

SEQ ID NO: 78485 - DNA, 1022 bp, Homo sapiens
aagctgagggaggaagttgttacctttgtcctcaggcagtttgaattgtacagttttatacaaaaacatacatttctggcttaatgattctgtagccttaagaaaatgtatattgtctctttaaactactcttaagtacttcatatcctttctagggaatagtgatttctttgagattaggtaattttttaacaacctggaaaatattttgaattttttctataccggcctgtcctgagtcattgtggtaaagattcttggctctttcagaagtgtgtagcttattataatttagttttttaaaaaggtaattttacaatgttagttcaatatggctaatgtacaccttctattgtatagtgtgcacaaggcattatattctacagagatttttaggagttggcagaagttgttgaaagaagttgaaataactaatacttgattttcaaagcaattgatatttatgtaaaatgacaaagggtgtgtatgctggataagtctgtcatcttctaaatcagttgccaggatggctgatgatcacactgggctctgccagtctcctcaggacctcttctgatcaaaaataaagtcaggatctcagtgttaataatttttaattgtcttttggtttttaaagaacatgtatatagttggcgatttttaatattctgttatgtccagtagttattagagcatgcattcttgtacaaggataattctaataggtaaccatgcaggtgagtgtttatggatcacagatatattaagattgtaatttttatattttggcttctctagattgtagagtatgatataacaattatttttgtccttaatagcaatattttactgtaatttttactttaggctcctggatttggatttggaattgcaatatctggtggacgagataatcctcattttcagagtggggaaacgtcaatagtgatttcagatgtgctgaaaggaggaccagctgaaggacagctacagtaagagtgctgcttatcgtgggcactgtg

SEQ ID NO: 78486 - DNA, 1022 bp, Homo sapiens
cgtgaacccaggaggcagagcttgcagtgagccgagatcatgccactgcactccagcctgggtgacagaggcgagactccctctcaaaaaaaaaaaaaaatttttttttctgataagatatagtcaactttttaatgtttcattattaaatggtgaaggaaatcattatctaatactaaccttaactttcataaacctgcaacatggccttcctttgtttgaaatgtattgataggtagcatatttaaatcagatacatatgattaaacatataaaataacttcttaccttatgactagtggcgatgtcaatgatttggtattttttttatcatattacatttatttttattaagacttttattgtttttattggtataatttacatacagtgaaattgacccttacagttctgagttttgacaagcatatacagtcatgtaaccaccacaattaaaatacaagacaacttcaatacaaaaactttctcttaacacctatttttaatcatcccggtcccctcacgtccacttaaccaatgatatggtttctttttgtacattcttgccttttctagaatgtcatgtaaatggactcatacaacatgtagccttttgaggctgacttcttacacttagcctaatgcatttgggatttctccatgatgttactctatcagtagtttctcttattgcatagtagcatttcattgtatgaatgtataattgtgtgttcgttctccagttgtggtatatttgtgttttgcagtttccattgattatgaacaaacctctagtgtacaggtttttgtatgaacataactttttatttcttttgggtaaatacttaggaaaagacttgctgtgggtcccatggtaattatttaagttttaaagaaatggtcaaattctctgtaccatctaacaccaccactggcagtgtataagagctcccgttgttgcgtatcctcatcagcacttgatatgggttgagcatcccagatctgaaatctaaaatgcaaaa

SEQ ID NO: 78487 - DNA, 2007 bp, Homo sapiens
ttatgtgtggcccaagacaattcttcttctttcaagtgtggcccagagaagccaaaagattggacacccctgccttagataataatttattttcggccgggcgcggtggctcacgcctgtaatcccagcactttgggaggccgaggcgggcggatcaggaggtcaggagatcgagaccatcccggctaaaacggtgaaaccccgtctgtactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaataataatttattttcctctctattgagaggctcatgacaggaggtaaaactgaagtacgctataatttgggcaggacctgtattggagctcttactgcttttattttatgatgattcttgggggagtttgggagattgttcttttttgtttttgtttcttgtgtgtatctacgtgtgtgatacatatactagaaaagctgttctttttcttttggttataaatgaagcttgagaagtaattctgtagcaaaactgaaactaggtagagtagtcatgtttgtgacgttaaagcagccatttgccaaacctattaatggttttatctgttttcctgtgacatgtatatttataattactgtgttcagaggcatttaactttcccttcgtttgtaaaacataagagatgcttttaaatgtttacgtgccattagatattttaagataataccgctccaacttttattcttttctaagtataaagttgcagaattagcttgaatactgatttcagcttgcatgaaatgaatatagagcagctgtccaaattaagttaaaaacaaaggaagttcctgtgtgtcgtttcctgtctcttaaaagcaaacaaaaaactttccataattattaaggtcctttcagagtgtctctaatattaactgtgaattttggtatttcagtgtgctgaattgttggatgttcttgctcaccttattaaggacattttcttaaaaggtaaatgatttgtttttcttttcctttatcagagcacagcaatggaggaaacagctatatgggaacaacatacagtgacgcttcacagggtaagtttgtgttgcagtaagtaatctgtgtataactcaggatactggcagctttgaaaacaatagaggaaagccagatgtcaggaagccagagggaggaggaaactttttctatattcttttgtttaaaattagagttacaataattttttattaaggtcaaaagtgagcatgattactttttcatatatccttttgagtatttgctgtttttattcctgacttaaaaagtgatttgcttttaaaattttgagtgatcagataaaagactctgtacattagtataaattattataaactgcttcaacctttctgagtatatatgcatccattgtgggagtgaagtttgaaattaaaccaggttgtatgcataataaaatcctaaaagatacttaattgatttcaaacatgttgacccaagctgttgcttaaacaattgcagatgcgagaagagagatgagtagtagtaagagatgagttcttacttggtgggactaagaactttgtccgaagtgagactgctatcaatttgaattctggttctgcctttctcttgctttagaaatggggaagtgattcagtcaccttcgaaaaccttggttttcacaagtttaaaatggaacaagttgacaccagttcatgctttaccaatttgtaaagttaagtgtctctcaaaattctctttcctctctttcaagagagctgaatctactgattactccctttcttagagaatgtatggaaagagagaatatttaaatactggccttgcactttacacttactatttctaccagc

SEQ ID NO: 78488 - DNA, 1041 bp, Homo sapiens
tatgaatatgctgctgtttagattatctttgctttcttgatagacatttgtttccaggattttgttcttggaatagtagcctttttatatctgtacacatatattactgtatatcagattcttaaaaatggaattaccgaggcaaaggctatgtgcagtttaaattctgatatatactactaaatgtttctctaaaaagactacctagaaataaatataacaaatattggtgagctactggaatcttaatgaaggacataaagtgagatctgaataaacgagatgaaacaatgtattttctggatggagacagtcactgttgtagaatttactaattttccccaagtcagtgtcttctagtgttgtattgtagaaaacttgacatattgataagaaaacctacatgataaaatgatagcgacaaaattttggaaaaagaaggccgtatcaggaaacttgttagaaattcacagtcatttaaagcagcccgtcagttcaggaaccagggaggtccagaaacatctgtgcatttatgggcttttagtaattatgatcatcagtattattgcatgtcaggtattgttctaagtgctcaatttatttaattctcacagtaaccctatgaagtgaactattatctctactttttggtgaagaaattgaaacacagagatacgataacttttaagttcatttagccagcaaggtggaaaactacgaatatgtggtaaaaaataatattgtagactattggagaaagtggcttgttcaatgtatggtgctaggactattggttatccattttttaaaaatgttttctgcctcataggctaaaaaaaatcaaaggaaatctaaatgacaaagagcaataaaaattctaaaatagaagaaaatgtagaatactacttaaaaatatgtatgtacctagattgaaaagaatcctccgtgcatgatactaaagaagtaataaaggcgggtgggtcacttgaggtcaggagttcgaggccagcctggccaacatggtgaaaccccgtctctact

SEQ ID NO: 78489 - DNA, 1082 bp, Homo sapiens
ttgcacatgtatgcttacaatataagtacctctctaaccctacagcatactagagtttgtaagagaaaaaacaagcagagctgactgtgttttggactggtaatgaaatggtatcaaggagtcttccagctgacagcctcataggccttcctgcagtcaccattgtgtcccccgctgcctacgaggtttcttcttccacagcccaccctgtgtaaatgcctggccttccttctgacagctgtgtgctgtgtgttcagacctgtactccttcaaaatacctcagaaaatatggaagtatttctaaggccttccattcaaagaagaggcataggcgctctgtaattgtttagtaacttttttttgtttatacttctcatgtcttatggcaataaatctattttaatgcttttgtacagcttggctagccaatggttcagttatctgttgctttgcaagaaactttgtggattgttgatcattctccctcttggttctgtgagtgggcagttctccctcgggtctctcttggggctgcagtccgatgacgttagggctggactcacgggaatgcccagtggggctgtatgcccaagacggctttttcacgtgcagcttggcgcctcagctgggtggccgggccagctggggccgtctcctacgtgactaacgcacttcctcataggaaggcctctccaggcggttgcgcctctcccacggcaagctttcccagaggcgcaggtggcagcagcaaggcttctgatgagcaagtctcagaaagccaatggcttcgcttctcctacgttcacagagagggggctacacgggcaaatcatagcaggttttgcccacgagggcatggtgggagtgaggggagctggaaggagatgtcatttttgattagctaccacagccggaaaaaccaactgtatatattttcccattttataacgtttgcacgtttattaatatgtctaattttatagttactctcagaatttttgaggtctcttttatctcacttcctgctttgcatacgtttttaggactgtgtgggtaatatcccaaaagttggttaaatgagc

SEQ ID NO: 78490 - DNA, 1344 bp, Homo sapiens
tgatttcttcctctatctataccacagttagaacaaacttcaaactaatgatactgggcgcgtagtctatattttttccaagcagttgaatctatactttcaccaccaagaggaagagaatgcagtggaaagttttaaaaagtgcatttctttatgaactatttctgttagtttttaattttccagttttctcacaaaataaactttcaaagttcttcatgattcaaattaaagaataaaatatgatagtaaaaatttcatttactatctggattttttcccctcttccaatttgtggaaatagagttgcattcagggttgatgacatgaactagagggttaatatttgtggcttcttttttcatattattctaaatgtttgtagtccttttatttcatcttactaagaaaataaaagcaaatgcagaattacgggctggtacaaagtatatgagaacagtatgaaaatacctgaatcataattgatgatgatgcagacatgtcatcaattgagtaatgttattaaaagtgacactttttttttttttttttgagatagagtctcgctctgttgcccaggctggaatgcagtggtgcaatcttggctcactgcatccttcacctcccaggttcaagcgattctcctgcctcagcctcctgagtagctgggattacaggcgcccgccaccaagctggctaatttttgtatttttagtagagatggggtttcaccatgttggccaggctggtcttgaactcctgacctcaggtgatccacccgccttggcctcacaaagtgttgggattacaggtgtgagccatggtgcctagtcagacgtgacacttgtttactgccaaggatcattggcagaacacaccagaagcatctgtggttttttggatctatggatagagaaggccccaaggagtggggatcaggacttgcctcctcaggcagctatacttttgcacaattttgctttggaggtgtacaaggtaatgttatattgctgactagagttgactggaccaaattataattgtgaaagcaggaacagtcaaacaaataactatgtagttgcagaatatttacaagaaactgtgtacacattgcgatcttcaggatgtcgtgcctacatctcaggattgtggtgttagaagagacacagtctctatcttcaacaataagtgatcatcattcagtagcgggtaagcgttccgtcaatgcccttctctatcacctttttcccagctgtgccattctcatcgattttcttcttgagaagtctagccactactgtcctctttatcacctttttcccagctgtgccagtcctcatcgat

SEQ ID NO: 78491 - DNA, 1060 bp, Homo sapiens
tctaaaaccagtgagctatagacaccttcaaggtcgtatccttttgtttacagctgagctagcatagctgtgtgtcctgataggacgagacagttcttaaagaaagcagaaaacaacaataatgaatactttatggaccttaatcttaaatgtcttctatccttgtcaattctctaaaggggttgaaaaatacaccatgaaaggtggtggtggagggggggttctgtgtgcgtatgtgcacacgtgcatgtgtgtgtattggcaggtggaagagtggattaagggtagggcttgaaaggaaatggctctatgatgtcacagctcactgttttgtagtggtttatcctaattgtttagttaatactgtataatgacatactaaaattaacttgagttagtttttaatctaatttatgatgaacatatattaacatttaggtacatttgctctataaatgtgggatccataagaaagaatcccatctttgaattgcaaccaaatattttagaacaagtaggtcaggttgtatggagctaatacaacttgagcaaaacttctaggactagaggaaattgtgtttgtgcaacaacgtttgcgtagggctttaaaattcatgaagctctggtagtttccattttggctttctattgtaggaagtaaatgtaattttaatagtacctttttttttcttttttaattaaggatgatgttagcctccagtgaattaaatgtaaaggagctcattacccattcaggaaatccagttctgtcttctcaagttgctctgttatgttgaatcctgtgtgtaaagatcaagtgccaacccagagcatttcatagggcttctgagaccttacaaaaatgctagagatatattatatactaatatattgatattttaagacactgaagaaagagctatgatctttttttttttttttttttgagacagagtcttgctcttgtcgcacaggctggagtacagtggcgcaatctcactgcaacctccacctcccgagttcaggtgattttgctgcctcagcctcccgagtaactggg

SEQ ID NO: 78492 - DNA, 1021 bp, Homo sapiens
attcatgtctttaggggttgtagcgtttagatacctagaaaagactacttgatgctatgtaagcctaaaagttctgcctaactattagggagcagttcgttagtattctttgggtctacaacagcatcaggaaatacacttgctattaattcagtttttttgttgttgtttttatttgtttgtttgtttgaggcagagtctccctctgtcccccaggctggagtgcaacggcccgatctcggctcactgcaagctccacctcctgggttcatgccattctccagccttagcctcccgagtagctgggactacaggcgcccgccaccacgcctggctaattttttgtacttttagtagaaacggggtttcaccgtgttagccaggatggtctcgatctcctgaccttgtgatctgcccgcctcagcctcccaaagtgctgggattacaggcgtgagccaccgcgcccagcctattaattcagttttttcagaagttacagcttttatttctgcttgttctgagctttccctttctgcatctttggtaggctctgcacacattattgttactcattcaaaactgaatgtgaagttaagggatgtaaagtgaatacaggaaaaatttcctaaatttttattattcaaatttgcattttgtgtagaaatacatataatacttataaactcacttgagtcacaaagtattaacatctcgttaaggcaaaatgaatctatttggtcctcgggaagaaagttcaatttcttttctttcttttttttttttttttttttttttttttgagacggagtcccgctctttcacccaggccggagtgcagtggcgccatctcggctcactgcaagctccgcctcccgggttcacgccattctcctgcctcagcctcccaagtagctgggactacaggcgcctgccaccacgcccggctaatttgttgtatttttcagtagagacggggtttcaccgtgttcgccaggatggtctcgatctcctgacctcgtga

SEQ ID NO: 78493 - DNA, 1039 bp, Homo sapiens
actagaatgtatgttcatgtggccgttctcggtgatgttctcggttagaagctgcgtgtgttttttcggtgatttcactagaatgtgcgttcgtgtgcctgttctctgtgatgttctcgggtaaggggtgctcttttagtctgtcatcccaagtctgttttgcaggatgttctcttgaattgcagtctgcagtgtttgttctgtagcattgcttagcagtcttttctagggacgcttggtaactctccatgcgttgcatacctcatgccttttagagttagtgttggttactttctctttcaagtactttttacctctgtttattttttaaaaacttcctctttttttcctatttgtcttaaggtagcatctactgtgtttatttgattttacactctgttttagtctccattggaatgtagttttgttttcattgtaattctgtcttcagctttatttagtttcttcattttcctaagtctgatttatgtggttctttcacgtcttgtatcatttttctaatttcactcaatttcttttgagatgatagattatagggttgacatgttttgggggcatatctttctggcctgcttttattgcctatagggatgttattttgttccttattctcactttgttttggagacacagtcttgctctgtcacccaggctgcagtgcagtggcatgattctgactcactgcagcctcgacctcccaggctcaagccatccttccccatcagccttctgagaagctgggactacaggcttgtgccaccacgcttggctaacttatttttattttttgtggagacgagtctctctatgttgcccagtcttgtctcaaactcctgggctcaagcgatcctcccagctgggcctcccaaagtgttgagaattacaggtgtgagccaccgtgcccagcctattccctttttctaacaataactttttattgtatttggtcttatacttgtatcttgctcatttttatgtgaaatcatttttcttgaacttttagaatgaggtgagattc

SEQ ID NO: 78494 - DNA, 1028 bp, Homo sapiens
aacttgccattttcccttcagtggttaatgcttttggtctaaaataagagagctattaaccctagatgcaaagattttctcctatgttttctgaagtttggtagtttcagttttgcatttaagtatataatccattttttagttaatttttgtaaaaatgtgaggttcaggctgaggttcaattttttggcctatggatgtccagttgcaccatcaccatttactgaaaaggctatccttcctctattgagctgcttttgcaactttgtcaaagatcaactggtttttgctcattttataattgcgttgcttaatttcttattgttgaattttaagagtcatttgtatattttgaacacaagtcttttgtgatttgaaaatatattctcagtctatgacttgccatttcagaatggtaatgatgtatttttctattcctaattaatagtttaaaaaatctttttatttcagtcgggtaaaagttccagaaatgtgaagtacaaagatttttttgatccagttgaaagtgatgaagacatagcaagtgatcatgatgatgatctgggttcaaacaagtggatgaaattgctgaagaagcagcagaagaactaagcatttctgaaatgtgagtatttgaaccatcctttacattgtgagctggaattgtccaatcatgtattggtacttgtggttttcacatatgtttgttttaagaagttagattctctcctatcagatattctcaagatagccagaggaaagtctgtggatttaaagggacattagagatcatttaatgaagaaaaatattactggcagtagcaatcaaacatttcttgccaggaaccttgatttggttttgtaccccaaaaatcctgttatttttgtgagattgatggtttgtattatcaattgatgaataatttattttctatatattggacacttttgttctgtttcttacatagcatgtcacttaaatgataccttctcttccgtaatacctgaatgattttggaacttctgag

SEQ ID NO: 78495 - DNA, 1001 bp, Homo sapiens
gttctggtgttttttttttttttccatgtcttaataaacaaacaaacaaaaagccctcttagccatttagaataagcatttggggccaaggggagcagagagaagtatgaagtttactttttctcttcagtagaataaaaattgctgtccattttttcaatgtgatttgtcagaataaatctttaacgtattacatgtaaataaaagaaaaaaaagtccctacaatccaaatggatatttggataattttacgaagtctatattaacactttagttctatcagcccacaataaagtcccatatccatgaagcagttgctaccctttactcactagccccagccccaacaatccccagtctgtgtcctatctttgtggatttgcctattttgcatatttgatataaatggagccttacaatacgcagcctttcatttctgacttcttgcatttagcatcatgttttcaagactgtagcatttgcttgtgcttcatttctttcttatggttgtatggtattccattgcgggaatgtaccatgctttatctgttcatccattgatggccattcaggctgtttccaccttttgactgttaatcgtgctgtgcacatgtatttgtttgagtacctgcttttaattctcttggttttacacctcggagtggttgctgggtcagatggtaattctctgtgtagctttttttttttttgagacggagtctcgctctgtcacccaggctagagtgcagtggtgcgatctcggctcactgcaacctccgcctcctgggttcacaccattctcctgcctcagcctcccgagaagctgggactacaggcacccgccaccacgcctggctaatttttatacttttagtagagacggggtttcaccatgttggccagaatggttttgatctcttgaacttgtgatccacccgcctcggcctcccagagtgctggtattacaggcgtgagccaccacgaccagccccaagctctat

SEQ ID NO: 78496 - DNA, 1049 bp, Homo sapiens
aataccattatttaatctaaatcatcactagaataaaaaattgagaattgcttcatgttgactaggcaatacttttctgaaagttttcctggtatttgaagcactcatgaccagggtaaaccccaacctactgtgcagccgaggaaggaagcacttgtatggagccaaaccatgtgtggaaccatttggagatgtacattcatttactcctgtgtatccctgggtgagctctcagccccagagcagttaagtaatgctccagtgtttaaaatagtgaatgtcatttctctttattttagatgaaaataatttgtaaaatctgacatccaaatgcttaaaaagctaaaagttatttctacattgtacatttttcagagccaaagccttggctggacagtcagtacgaatctgtaaaggccccagggctgtgttttcccgcatcttgctactgttttcgttgaccgactcaatggaagatgaagacgccgcttgtggaggtcagggacagctttcaacagtcctgttggtcaacctcggccgaatggagtttcctagttacaccatcaatcggaaaacccacatcttccaagacagagatgatcttatcaggtaagatgatgttagctcactataatgtctatatgtgtatttcacaatttagtaaaaggttttgttatttttttccagccaaagtagaaacattaagtccacagccaaaacagtttttaatctttttttgccccacttgtatacatttctatgactatagggaaaatgtagaagtgtgctgagattatggttgccaaaatccaaggaattttgagttagaactacaaaaacttctctggtttatgtttccaagtacctttggaagggagtattttttgtttgtttgtttgtcttaatttgagacaggatttcgcccaggctggagtgcggtggcatgatcaccgctcactgtagcctcaacctcctgggcccaagtgatcctcccacctcagcctcccaagtagctgggaccacaggcacatgccaccacactcagctaa

SEQ ID NO: 78497 - DNA, 1096 bp, Homo sapiens
aaattcattgatattaaaaccaaagccagatccagctcagcaaaccgacagccagaacagtgatacggagcagtattttagagaatggttttccaaacccgccaacctgcacggtgttattctgccacgtgtctctggaacacacataaaactgtggaaactgtgctacttccgctgggttcccgaggcccagatcagcctgggtggctccatcacagcctttcacaagctctccctcctggctgatgaagtcgacgtactgagcaggatgctgcggcaacagcgcagtggccccctggaggcctgctatggggagctgggccagagcaggatgtacttcaacgccagcggccctcaccacaccgacacctcggggacaccggagtttctctcctcctcatttccattttctcctgtagggaatctgtgcagacgaagcattttaggaacaccattaagcaaatttttaagtggggccaaaatatggttgtctactgagacattagcaaatgaagactaaaatagggtgttttctgaacattttgagggaagctgtcaacttttttcctctgaattaacattgctaacctaggcgtttgaatctctaataactttatatgtaagaataatagttggaatttgcactaatatttaaaaacatgttgaatcatgcttctttcacacttattttaagagagatgtaaattttgttcctgtcctctttctgtcattacaggtctggctcttgtaaccgtgatcaaactgttcatgttgtctgctacatttttgtctccatccatttttcctaccacctcctgaaggctatctgatagtcagtcacattagcagccccaggcagcagacaacaggaaagttaggaaatttgtgtttcgtgtcatttttaggagcatctgataaaacctccagcaggttttaggaagtattcatgtatttttctggttactttctgtcgtctctaattgaactcacctgatgaaggttcagtgttctggggccagaatttatgattttagatcaccttctttggaaccttagatcactgtgttttgaaatcatgagtttgcttttaacttca

SEQ ID NO: 78498 - DNA, 1050 bp, Homo sapiens
ggggcacctgaggtcaggagttcaagagcagcctagccaacatggtgaaaccctgtctctattaaaaatacaaaaattagctggacatggtgcatggtggcaggtgcctgtaatcccagctactcaagaggctgaggcaggagaatagcttgaacccggggggcggaggttgcagtcagccgagatcatgccagtgcattccagcctgggcgacagaacgagactccgtcaaaaaaaaaaaaaggagttatttttaaatggaaagggcaagacagttctcggagagacttggaaggtgaagcaggttagagacagcacatcagagtatgcatgtgacaggaggctcagagaagagggaatgctggggaaaatgtgactgttaaaattcataatgttgctttttcctacagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttggtaagtacaattttagcaatgttatatatggctggaagtcacttccctatgaataatcatcaaactctgttgtcattgatgactttcaagttgtggttaatggaatatttgtttttaataatgttttaataaatattttattttaaagatcaaggcttattaatataaattacggtatcccttaaaagaagttgatagtaattccttactgtcatcagtagtcagtgtttattgcattatatcttgtaactggtgttttacagttggtttgttcatatcaggatctaaagtcttcacattgaatttgcttaatatgtctcttaggccttttaatctacaacagtctcctcccacctcttttttacctactatttgttgacaaaccaggtcatttgttccctagaattttccacattgtagatattgcttgttttatccccagggtgt

SEQ ID NO: 78499 - DNA, 2206 bp, Homo sapiens
gtaagtttacttttgccgtttttttgagtcccgggaacataaagagggatatgttaataaattattttaaaaggaagatataaaatgtataacttttcatagtttctaggttttttgtcctctttttaattaaaattaatcattaaatgtgtctagatggtggttttatgcaaataatcatttaaaatatcttccaaagcaaagttaaaaccaacccccaagttctaggaattacaagtatgaaacattctagacaagcagagctcaaatgttgggtgaccttccaattattttcactaagaatttgtattaaagggtgagtaacaaataactgttacgcattttattttctctatttttttttcttttttagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaaggtaatactgttaaggtttatcaagttctgggttctgtactgtgtttactgatttcaattccgtatggcagttttcatttctcaattgctcagatgttttttaggggaagttatcagacatcttcttaagtaaagtcaaagccaagaatattaatagaactattttcttggattggtttatggctgttttaaagtgttctatataactttttatcagcttctcaaatattaaagactcttacgtggaaattagcatttttttacataaagatcattacttgtcagtttcttggttaaaaggttgaaaagttggtgatatactgtaattaaggtttggttaggcttttaattcagtactgcagaactttaccaacaaactgtaagctagacttatgttacataagatttaggtaaatatataattacgggaaaggcctagtaattattagtggtttaaagaaatattatgaattgagtgacactcaacaggggcaacacaaagctagtaactttttaactgccttatttttccacggccttccagataatgacttattaccctacttgtaagagtcaagggcatgttttccatgttttgctttgccagaggagtgaagctggtagacctaatatggcccccgttccagtctgtgctgcagcaaatgcagagtcacagactttccagtaggaagcttgcgcgtgtgtatgggaatagggcaacagtatcttagtataataggacgtggctttctctcagaatggaggcagtctttgcaccaccaagcaatgagtgcctttgttttccatggttagtcaactgactgcagtaaatcttctgttgataccaaaacaaggctggcaaaaatactgtaaggcagctgtcttcatatactttggtgaagaggtggtagatttgtttttagattgagaaccaacagtttcttcacaggaaggcaagcaggagatgaatatatgaaaatacatctgaaaatatgtgactgtctagcagagtagagtggttgtaggctcctctatgggtaaaagttttcaaatggtctgtataaccatctctcagcaagctgcattattgaaaattcaactagataactcttaaagcctctttcacctgttcgattgtgctgtttgtgattttggcattttactaatttaaagtgcctattatatagaaggactttagaattcatgatgtattagactgtacataaaatatttcagacaggttaattcctcaagcttatttatatttgtaatttaattgatcaaagcatcaaagacctgcttatgaaaaccttaagatgtgtagcatctcaagattagggacatcacagaacttgctagattgagttaggacagcatattcctaaggaagaaattgatgcaattgaccggatctctttcggaaagttcaattctccctcttttactgtatttttcagtttacactattttaatgagtggaaataataattatttggcctagttcttgaaccatctgtagtacttgttggtcatttttcatgttgaggcagtgtgctaaattttgcaagtagaaagaagggtaagatgcagtttcttgccctagagaacttaaatctagtgaagaagataaagcatgaacaaatgaaaagtaatggtacaaagtggcagcataaaatcaactacacaaatag

SEQ ID NO: 78500 - DNA, 1053 bp, Homo sapiens
taaaacacaaatattccatcaagtaatactctgaaggagcaggtgtagtttatttcttctccagaaagtcttccagcagataaataatgagaggtagtatggcataggaaaaaagtacactgaagtcagcctttctggttcaaccagctcagacccctgagctatttttgcctcagttttacgccttggagaacaatgccttgtcattactattcactttatgaccatacagtgcctggcacctggtgggcaattggtgaatgttttcactatcctcatccttgccctcatgaaacactccttctaggtcccacaaagaccgttggtattttatgacaaagtaccttacaaatatttttctttttttaaaggagaaattgtcgtaaatgaagtcaattttgtgagaaaatgcattgcaacagacacaagccagtacgatttgtggggaaagctgatatgcagtaacttcaaaatctcctttattacagatgacccaatgccattacaggtgtgttttattagtacactgtttcattctatcaggctttcaactctaagtggtacatattattatataaaacataggtatggaaaagttatagtagaagtattaggtaatgcaatgtttgggataaattatattaagatttaaagtaaagtttaagaagaatgttggaacttgctagaggagtattagtgagaggattgtaagtcaccttgctttatttatcctctgtgatcgttcattatatgtccttttcattaaggaagttattccctctgttgcagatcttttaacctgcttataaaaatgacataaagagaaaaggttgtttgctaaatgattttataaatgccacacattttagtgatttcataggtttttttgttgttgggtttttgatttttttgttttgagcctggatctcgctctgtcttgtctcccaggctggagtgcagtggcatgatgtcggctcactgcaacctctgtctgcttcctgggctcaagctatcctgccacctcagcctcctgagtagctgggactacaggtg

SEQ ID NO: 78501 - DNA, 1131 bp, Homo sapiens
tggcatgaactcgggaggcggagcttgcagtgagccgagatcctgccactgcagtccagcctgggcggcagagtgagacaccgtctcaaaaaaaaaaaaaacctgaaatcaaatactagtttgtgtggctactatcagcattgcaaaatctgactcattacttaaagccaaatcggtaaaataattagaattttgtaggtaaaaattgaacaaatgtggaaactttaaaattttaaatattatatagggacaaaatattaaaaacaccaaactttggttccatatgaaagtttaaaaagtgttttttaaactttactatgggagtcataaatattttcccttgattttgttagtgcttttcactcaacagtgtgtactaattaatcatttgtacttttcctcagagtgaacagtagaattactaagtaacccttgctccctgtgtgctctgttttagtcttagtcactctgagcatttaaaatgcagggacgaggaaacagtactcatcttgaatgagtgcctatgagctattgaactttgacttcgtttactctgaacaggcctggttcttaggctttgattcctccactctgcatactatgatttcacactcagaaacaacatggtcttagctgtaaatgtcagtgcttgctttttaattttttaaaattttttttaaatttttttttttttttttttgagacagagtctcactcttacttgggctggagtgcagtggcgtgatctcggctcactgcaacctctgcctcccaggttcaagcgattctcctgcctctgtctcccaagtagctgggattacaggagcccaccaccacacctggctaatttttcgtatttttagtagaaatggggtttctccatgttggccaggctggtcttgaactcctgccctcaggtgatccgcccgccttggcctcccaaagtgctgggattacaggcgtgagccactgcgcctggccacttttttaaaattagcttttaaatttaagatatgtgctaagaaaaggtgttactaagtatgcataaacttgaagaactttctcactgagggttatcaattctataaaatggctaaaagtcagagttttctggggaagttgtaaaccaag

SEQ ID NO: 78502 - DNA, 1050 bp, Homo sapiens
cccatcttttcttctaattcttccctttctccatttgcagttgtagttactaagggacatgtgtttatgggcaacaacagagaagaagcaagaaggatgaagagcagatgaagatagcaatgttctagaagacattctaggcataaagcattgcatggagtaggaaaaagccttcccagggatgggaagaaaggaagggaaagaggctttcttcgtcctaattaagcactcgtgaagtgcttaattggagacagcaatataatgagccagggtgaacttggcccacaagccaagacagtgagagacaaatgttctccttactcagatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagaccgtaagagtagaattcatagtaagattctcttccctgcttctgaggcagatgatcagttccaaattaatggaagaacatgtattaatttggaaataaaaaatatttgtcactccaccataggcatcaaattattttacaaagaaataagaacaaattatggaacatggattttcagacatcagtcatttcttttattctaaaaataattcactagaattcccttgagctggacctgatggacatcgtgtcacatgaatgcagttctaatgccaatagcctagtttttcttcaacccagtatctccccaccccaggataaggctgatagtgttttccagtagaatgaactagtgaacagagcagagtaactgatacttcccaccatcctcttcttaaagccatcagagcccattttccacatagctacccatttcatacccatttcatcttcactactagagtgctattttgtattatcaaaaataatctggatgttagtagaggaaatgggctatgatcctgcacagatttctggggaatgtaggcccagc

SEQ ID NO: 78503 - DNA, 1042 bp, Homo sapiens
atctccagggtccctgagtcactgggttcctgttctgtccctcccaaggagaccatgcacagctggcatgggaagaggctgcctccaccttcctccagggaagctctttcagctcggagcctttgtggtcattcagggcaagagcaaagccagcaatgcttagttctaggccagcagcccaagggaagcctgtgctcaccacccagcacctgccaaaccctggcggtccaggcgtggagtgaaaaatcattccggtttcttgcctttccaggaacaaacgtatctgctccagatcagctgagcttggcactggcttggaaccgcgtggacatagcacgaagccagatctttgtctttgggccccactggccggtgaaactgttttttttcgattcatatcattgatcttgactttgtacaagtgacctattagtatgttctcccttgtgacatggaattcaggaaattatgtggggtttctgatgatatgatatgtaatctattaggctcattagaagatgtcactgtttaacttcaaagaaccaacaagaagtaattccacattcaaaccagtactcctgaagaaattaatcaccaaatattttatcgttgctgatgaaagtgggtttttacctttttaaagaaaaagaagaagaaataaaatagcttattaaaatttaatgcaatgcttccatccagggcaatgatttttcaaactatgttccatgaaaccctggaggcctagagaactctgtgtgtgtgtgtgtttatgtgtgtgtgtctatgtgtgtgtctgtatgtgtgtatagggtgtctgtgtgcatgtgatatgtggtgtgcctgtatgtggtatgattttgtgtaggtgagtaatgtgtgtggccatgggtggtatagtgtgtatgtgggtgtcattgggagggtattgtgtgtgtgtgatatgggatgagcagtgtgtgtggagtgttgaggagtactaatgtgtgtgtgtgacatggggatgagcgtgtgtgtgtgtgaacacacataagtctgcatgata

SEQ ID NO: 78504 - DNA, 1201 bp, Homo sapiens
atcctagcactttgggaggccaaggcaggtggatcacttgagcccaggtgtttgagaccagcctgggcaacatggcaagacttcatctctaccaaaaattagccaggtgtggtggcatgtgcccatagtcccagctactcaggaggctgaggtgggaggattgcctgagctgagagggaggttgaggctgcagtgagccatgatcatgccactgcactccagcttgggggacagagtgtgattctgtctcaaaaaagaaaaaagaaaagaaaagaaaaagaaaattgttatcacatgcctgaattccttccagccagatagaacatcccccaagtcgtaatgtttttactcttccccatacttcaggagttaaaacgactgggtggacagtgcagggcacaggtggtatgggcgaatgtggtttgtgttgcaggactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcgggtaggatttctgacgcgcgaggaagggcgggttcgtaactccctctttgtcgggccaaggagaaaatctaaagtggtctgcttagacattccaaacgtgtttaaatcaggaagatttgctagatctcctctcccatttcctcaggtcagcatccaggggaaccatcagaggcagggtgttcctgatggaattctctctccctcatttccaacttcatttgcccttagaaagtttgcaacaaagctggaatttaggacaagtgagaatacgatgtttgactatggttactttttgtctcctgtgtcaggatatcctcccacagcaaagtctcaaatcaaagacagagatatgtctgactcattcatatatagatttaacttgccttgttttgttctcttgcattttctttgaacagaataataaatgagtccctcagggagcagcttctagttaccattcagaaaacatttaattataataaggcacaatcacatcagctgtttgcaattataatggagtgcatgaagaagaaagaactcgtaagtgtcttgaatttatttccaaacaagctctgtggagagaattatgtttcc

SEQ ID NO: 78505 - DNA, 2487 bp, Homo sapiens
ttcccttgttggtcttaacatccaagtcctgcaggtctgatttgcgctgtgcactttgtcaggtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagtaagtgctggcaaaggcacgcagtcctcctgggctgatgccatcacagtggaaacaaggctgagaaggagattgattgcccaaggggattagaagattaaccttgcttcttgttaggtcaacagaaaatgactcacctagatgtcttaccttagccacctaccaaatcacattcactgggctacatggggatgctttgccccaggttcacaagttagcacgaaataaccctcagtgctcgccatggtgatggccttgcccaccctgttgcccagtggttcttgttccctgtaattagttgttattttttaagtgttttaacaggaaaacaatttctcaaagatttagtaggattctttctatttgctgataagtattatgtgattattaaatatctctgtaatgctgggcctttcatgtagactaagatggccaggtggggacatatctggagagggctgcaggagccatctgctcctgaaggggcatcatccttgctggtcctgagggggagctgtcactgtcagacgaaagctgaggtcgaactagagagaaagacgcaaacctcaaccagaagaaacaatgataacaactggttagaattacaataactggtataatctcttggagcatgtttatactccagtaattcttaacgtcaaacaattgttaaatgatctgaaagagcagtttgtttttcccattactggcaagatttttgtgggagaccatctagtcctggcgaatggtcattgggaatcatcatgtatgggactgtgatgctgcagagtgggtagaatggggatggcctactaggaaaagttgtagatttccgagaatcagatctcgaagaatacattggtcgatgactgaatgttttttgttctcacatctctaatttttctggacttgtaagtttttacaacaccccatttcacctggccatgtgacttgtgggcttccctttgtcatccttcgcctagggctctgagcagggcagggacagcaaaggggtgctcagttgtcacttcccacagcacggagcttcgaggactccagcctaagccaagaagaacctgttctactctgttgctcgaaaagaaggtgatttggccaccatattcctaaagattgaaaatatcaatccttgcttgggttggaaatctcaaaggcggagtccaggatatcttagttcatttttccaatatctcctggtcagggctttgcacaaagcagaccctcaatgcatgtctgctgaaatgaacttagctgtaattactctggtggacacagcagagttattcaacatatgtaagagtccctgactgtagaaacacctcatggaagcaaattagaaactctgaaatggctcatttgaaattctccaatcttctcttaaccaatgctggcagatttttatctgaagcccttcagagctgagaccaacgatacttccacttgcctttagttaatatcgatcaactaattcccatcacaactaatggacagctggtgaaataggctcagagtgtgatctgtcatggccagtgtggcataaaattaggaagtaggcaaatgtgcctccactcccatttccttcccattccagaatcccaacttcctggaatcttcctgccacctcttgcttcccagagccatgcctgcaggttctgccaccaaaagttagttggtacccactgtgttcttgaagagtcctattaactgatagagacagagggaggactctgggaacaggtcattaactgatgggccactagtggtccaagtggctgcgtccaagatctgcactttattccagccactgaagacagaaacgtcaacaagaacagtgtacctcatttgtatgctacttaacgtttacaaaattatttgctagccaaacacatattctgatatttttacaactgcaggagttaaaggaagcactgtgattgttcaccttttacaaatggctgtctaaggctcttggtgatttggtgattggcccagtgtcataagggagaagccaggaattgaactgcaatttccctggctggtccagatcccctttcatcatcttattcttcagggacagccatcagggtgggaatttcagaccataggctaggacagccagggggatatttttccagccaggaataccttccaatatttctcagtggtcaccttgaagtagccccaacatcaggtgggtgggttattcaggagtttaaccatatgtgagtcagaaag

SEQ ID NO: 78506 - DNA, 1039 bp, Homo sapiens
atccttttcctgttataggacaggaaactgaggcacaaagacattaaggaacataccaggcagtatggctctcaattttcactgaaggcagccaaggaatgccaaaaagactccagttatttccagctttaggccttagacatctgtaaaggaaatccctacacagttgctttggtttctgtttttgttttcccgtttctagagttaatgcaagattgctcgttatcatgagctcagactttcagtgtactttgttttaatgataaagatgagtgtgtctcacccctgatctgtagggaatgtagggactcagggcaagtgtccctaaatttcatgaatgatggtgtgctgggaagtaaaagagcctaaaatatgaccaatggctgctcacaggtgttatcagccacgtaggggatgccttgaaagaccactcctccaagtccagaggccgggtttgtgctataggaattgctccatggggcatcgtggagaataaggaagacctggttggaaaggatgtaagtgttttctctgcaaatgttggcagttttttaaaattaatgattgattttgaggtaaccgttgattcagatgcagttgtaagaataataagagagctcccttgcagcctttcccattcctccaatggtaacatcttgcaaaaccataatgcaagatcacaacccggatactgtcattgataaggtcaaggtgcagaatgtttccatcaacacgaggatccctcctgttgccctttcatatacatatacctcactccttcctacccccacctcttccttaacccctggaaacaactaatctgcaccaccccgcatttcaagaaggttctgtaaatggaatcatacagtaatgtaacctttggggattggcttttttttcactccacatagttctctgaacacgcgtccaggttgccatatgtattggtcttcattcctttttactgctggctgacatcccatgatatggaggcaccagtttctttaaccatttgtctgttgaggaacagtttggctgt

SEQ ID NO: 78507 - DNA, 1034 bp, Homo sapiens
gggcctccacaggggatttccctcccacctccttctgctccaggtggcctccctgagccacacccctaacgtgccatttccagatggtaaacaacacttgcactgcagtttatctccttggaaatccccacagctcccaccccagaaccgtgcacaaaaaatatcttcaacaggtggatatggatgaattaaggtgcaaaatgagaaccattaaatacatacttgcaagccatttctcttaaaaggtactagagctaagatccttaaagacttgcatccaccattattgcagatgactattcagatgttgtgggcagacatattgttttataaaggtataagaatggactctgatgatggcttgggaatgtattggtccaatatccacttctctctctcttccagggtcagaaatcttggatagagaaaaccttttgcaaacgggaatgtatctttgtaattcctagcatgaaagactctaacaggtaaattgaaatccacgattaagacattatccaaaccagtgcttgtctgccactattctcatgtttgtaagaggcagaaagaggagtccagaagggtggccagaatccattccccatgggagtcactaacaagggagtcactggggctccttgttactccattaacatgcaaatggcttcagaaaagagtttgtgtccaccacccaccctaatgcgaactctcatagccaactgggcccacatcattcctcttagtctcagcaagatcaaggagttgagggctttcaacaggtttccaggatattttccaggcctcttcaatagagtttcataatgtatttagatgaaaaggaatttccatcacaggaaagatctgagcggttgaatgaactagctataactttattaaaggatttggcttgtacacaaaacatccaacaattttattcacctacattaaaatgcatctgttataagctgaacagaggccttgtaaagtcatgtaagtagagattaatttaactaaaatgtctcatctctaagggcaaa

SEQ ID NO: 78508 - DNA, 1043 bp, Homo sapiens
agttccagctatgcaggaggctgaggcggggaatcacttgaacccaggaggtggagtttgcagtgagccaagatcgcgccactgcactccagcctaggcgacagagtgagactctgtctcaaaaaaaaaaaaaaagaaaagaaaaaagaaagaaagagagaaaaaatgtcttactgatagcactattcacaatagccaaaagtggaaacaacccaaattcatcaactgatgaattcatgtaatggaatattacagaggcatagaaaagagtaaagtcctgatctgcgctacctggatgacccttgaaaacatgacgccgagcaaaaggagccagacacaaaaggccacacgttgaatgattccattcatatagagtgcccagaataggcaaatccatagagacagaaagtggatttgtggttgccaggagctgggcagggtcagggaggaatgaggagtgactgctaatgggtaccggctttttttaggagtgatcaaagtgctctggaattaggtagtggtgatggtttcacagtcttggaactatatgtaaaacactgaactgcagactttaataggtgaattttagggtatgtggattatatctcgatttttaaaaaagaaagtacaaagaaaaatatcactgtctttaaagatccagctctgtttcctggactctagtctagaggaggatctctcagtgtccccagaggagagcccctgggagagaagaaggctagaaacccggaggaaagggaaccctggcccaggagaggggtcggctgtgacgacctccagcatttcctgcaagccagccctgtcaccttcctgcggatagtgatgatgaagcagaggacaataggtttcaaaggtcttccaagcatggtgtcactaggctctcacaccagcctgtggggcagatgtgaggggtatcattgtcctcattttgcaggtgacgttccacaagatgggactgaggtgaccctcagctgggccctcctacctgtgctctctgcagctaggggcaggaggctgcatctgac

SEQ ID NO: 78509 - DNA, 3342 bp, Homo sapiens
ttcttcgctctcttcttcctgtaatttttccagcgctctaaggtttaatttgtcgtaaccaaagtcagcggcggcgcttggcgatgcggggggcggtcccgggtcccgctccccgcctgcggctctttgtgggagcccccgcccatccggcccggcgggggcgcgcccggccctaggctcctcggcctcgaggctctctccggaaaggaatgccctggccgctgcccatcctccgtgctgccctctcgcctgcccacctctcacctgccctgggccggtgcggggcgggcggcacctgcaccagggcgggcgctgagcctccagcctggggatcaccgcccgcccccgccagcccagcggcaacagttcccacgcgcggcccgatactttgtagttgattcatctgtggcggttccctcccccctttttgtttcgtttttaacataaagatgaaaatattttaatggacggcaatccttccccattttggtgtaaagaattgtatgcttcctctgagctcacgtgagttcttctgtgacactcacctcttctaccttgggggcaggctcaaaacccgtctactgaatactgttgtcttgtgaccaagggtggtggtctctcatttgtaaaatagttcacatagtgattaaaaggcataaaaagaagctgcagccttggataccctagagctgaaggccccttttttttaccatttggaactgaaagggcccaaggtctgcaggtgaggctttcagatctcggactaactttccccagggaggcttttgtggccgctccaaaccacgtggcaggtgatggggtagagggtgagagcggggccatttctaggcattcggggtcagttaagggtgtgggggctcaggttgggggtgggagtcagtgtgggctcagagttcagctcgggacgcggctgcagggtgggtgtggccctgggggaggggccaggctaggctcagctcggctccaggtggatcctgagtatcgggtgggggcagcgattggggcgtggctggggttgagatccgctttgggggatgatgcccgtgctgggcaggatacttaatgtttgggaaatttttctacggcctctgtcagggtggcctgccactcggcagcaccggtagcggggaattgaggaggggggtggccgaggggaggggctcgccgtcgtgggcggggccggcttgtcagggcctcagccttgggatgtcttcctggtgggttcatctcccgcttcaggctctggccccgcgcgagcctcttgactagaatattggcgcaggggctctggagacccgggcctcccgctgtaggtggggccagtttcctcggagcgcctggaaaccgaaggcaggcaaaagagcacgggaccaaccctttgagtgtctgcagtgtgctacagtgctcgttcttgaagcagagaaactattccacccttcaggtgtgcagacatcagaagtcctacctccagggtggaagccggcctccaagttggaagtgcacagggctccggcagcggggtggcggggagttgggaagaatgcagatttccgggcccctgatgccgacctagtacacacagttccagcgtgcagttgggagtgcatgttaccggtaccccaggtgacccattatgagagttgaactgcccagaaacctgcctctggagggagtctggttcagcatctggtggagggcacccctgggaagcccatttccagccccttcccaggtgtgcagagcataagtaactggtgttcctcaagggagaagaggagcttgctgttgggggagaaaagagcatcttgcagaagggagaaacccaggcaggcctcagggatgactgagaaggcagggcacaaggtgatggctttgctgcagccgtgggctctgaggtgtccgtggtttgtgggcctctagcagcattgtggggtctctgcagtcagtgactgaggtcatgccgggccccgtactccattaggctcgggaaggtgcccccgccccacttcccgcatttccaggatccacagtaatttcatggcagagggtgaatatcacaaccaggaaggtggccagctgctctgtgctgttcctctatgtgaccagggaccggttcccagatctccctgcaacttggtgatgtctgccctgaccacctgcaaagtcttcagggacatgaggtcaagtatgtgaagaccctttgagaagtgcaagggtcagccttgactctggaggcacttgtggtcccttggccgtggctctgctctgattttccacccccactctctgaacagctgcatgctaagagctttctgtcctggttagctgtgtagcagtgtggtttcccactcccactcttccaggagttatcctgtggacacattggtctctgtcacatttaggtaattgttgatattataacaatgcgtaataacacaaaaccaagaaaaacatctttgcagctcgtgctactttattatttggccaattagaacttccgagtccagacctggaaagtttgctaagaggggcttaggggagcagcaagaccaggagcagattttcttggaacctgaggtgctttgatgcaggaattcaaggactcaccttcgataggtcaggctggggccctcttgagggcagactggttgcccagatcctgcctctggagagtcctgcgtgttgtcctgaatggggagacttggcaggcccccagcagaatggccacttggtctttcttggcagagagaccctgaatacatttctacctatttgttcccacagagaattgttttcaaaactgctctgtgccctgttttccctccagcgctggagtcaaaacatctctctgcatgctgggccctttctgggttctgggggtcccatggaaaggtgggcacagtggcgtgcccagccttccctcctgcagaacccgaggcatgtttgtggtcacctggccctgtttggggtggaggagggaagtagagtaagatcacattctgtcagccatttcctgtgataatttgggtggggttcacctgaaatttatctttacccactgaagcaaggatttgatcctgacagattattgcgacccctcccccagggcacactctggctttagagacttgtttccaagcacaccgccccttgggctccctgcaggtcctccctgatgctgctgcctgggaaagcagagcagagggcatctggcagagcagagggcatctgggtgggatctcctttacccagggcaaagccaggcttgttggtggcctgtgctttgttcagagacacacacaggccagtggctcagcacgc

SEQ ID NO: 78510 - DNA, 1057 bp, Homo sapiens
aaaccactgttaccccgcgttggtgtttttctttacagaccttctagatggatttgcacatatgcatatgtgtgtgtccacgtagacattttgaaacatacttaaataggatcctagcaagtatctcactgctggcattttgttccatgtgtttgcttaaatgaggcatcttcattctttttcacagccgcatggtattccaagatgtggttatatggctgcattgtaacttatttacccttcacttatggaaaggacagctacattgccttttttttgttttttctgctattacaagttgtgtagtagtggactctggtgtgtgtgtgtcttggtgcagaggagctggcatttctgtaggattgagacctagtggtggtattgacagggttgataagtgttggttaaatgtgttgtggagttactgtgttatgtttttcaaggaaagagaccacacttgttagtccccgctctgagggagagacctattgtgtcacgactccaccttcttgaaaatgtttccttctcccaattctccttttgcatgtgtgagaacattgagaacgtttaaaacagtaccagcaaaaccactgtcactcccgcacgcctggtggctggctctcttggccatcttcagttctggttttacagagattggaaagtgtgtggtgggcgctcagccctggagcagtaggatgggggctggtgtggcgccatctccactccccccttccccctcgctgaaagaaggctggaagctgtgctgcctgagcaaactgataggacgcagttcattaaaccagtagcctgtgtctggggcttcacatgtctggaacacagcagagatgggggcctgatccttctgagtaggtgccctgaagcccaattctcaagcttctgacagcctcctgcccttagatcctgtgtgctcccactttacacatagctttaatctgattggttactggggaagggcaaaagacatggatggcagctaaaggcaggggaagaaacaaaccagcaggttgttaacatatgcatgtgtaagtgtgtgtgt

SEQ ID NO: 78511 - DNA, 1037 bp, Homo sapiens
aggatccagttaatcacacattgcatttggttgtcctctctagtttcccttagtttaggatagtttcccatcttttggtcctttattatgttacgctggcatttgaaggcccaaagccagttgtcttgtagaacaactcacaatgtggattggtctgattgtttcccgtgatcaggtctggtttaaacaaattttggtccaaaatatggcacaggtgatactgggcacttccatcgcctcatgggggggggagggcatgggatattagcctgtcctactgcaggatcacatggttaaggtgggcggccaggctcagccccttctgtccacctggttggtttctactccatcttccagcttccttgactggagagatgttgggggttgggttcagctttggaaggcttttgaagtcaaaggaccacctggaggaggcctaggtgctcctttccccaaacagacaagacaccctgattttcttttgaatgaaaatggctccagatggtattaatagccagctcaagggtaactgtgagtgtgttcttggtcagcccacctgaatgccggccctgtggccacaggcagcctgtctcctagggctggggagggcctacggcgggtgacactctctaagtcctggtgagtctttatgtgctttcaagaaataaacaaaaattgtcctaagtccacacacctgaacctgtttttcttttctttctttcttttttttttttgagacgaagtcttgctcttgtcccccaggctggagtgcaatggcacaatctcggctcactgcaacctccgcctcccgggttcaagtgattctcctgcctcagcctcccaagtagctgggattacaggcgcctgccaccgtgcccagctaatttttgtatttttagtagagacggggtttcaccatgttggccaggctggtttcgaactcctgacctcaggtgatctgcccacctcggcctcccaaagtgctgggattacaggcatgagccaccacacccgaccttttctttcctttcaaagcc

SEQ ID NO: 78512 - DNA, 2760 bp, Homo sapiens
aatctgggatatgtaaatgtgacacacagtctgagcatttggcaggctctccatggtcttgctttgcatagtttggcctatctgctctccagacttactgccccgttgtcctcacctgcatgactgtccatgtctggtttgtttactcgtcattgaaggcatccacaggggtgccatctgcccccatgtccctctcccactaggcatgctaagtggcctgcggcagggcaggcagggactcagattccctccatcccatcgctgaggtcttacttccttcttccgcccgccttacacgtggaaggtttctcctgtgcttgtccaccagttgttgtttttgtcttctagcacggatggtgtggcagaaggaggccttggacagcagcacgttaggacccacaggggctctggccccttgcagctgtgtgttctgagggaagatgcccaaggttttattatcttttccagagcgccctttttttctgcttgcatggcaggccctttctaaaattacagtcataggttgcttaatgacgggtgcgttctgagaagtgtgttgttaggcagtttcgtccttatgtgaacatcatagaatgcacttactatgcacacctaaatggcatagcctactgcacacctaggctgtatggtgtagcctcttgcttctaggctgcaagccggtacagtatagtactgtcctgaatactgtaggcaactgtaacacaatggtaagcattttgtatctaaatatagaaaaaggtacaattaaaatggggtgtcgtcttatgggaccagcctctcgtcccacgtggactgtcattgtttgaaacgtcattatgtggtgcatgactgtactttgctgcttggcctaaggtgccagggcattctctgggtaagcctgaggggctttgcaggataccatcttttatcaaggttgaaattagttttagcactttattctgtgtcccctttgcggctgacagagcaggagcctgtcagtgtctactgtcacaggtgtagagctgctgtgttggcgagcaggtaggtggttttcctgaattactgtcaggctttagagtcttacaggaaatacagccttggctacttatagcttgtgatttgaagtttccctaatgatgggctgggtagtacacttcagcagtttgctttggacaaattgtatcattcttaagttcactcactttagcctttgagaaatttcaaagtttgtttccctgatcttcctagttgccctggattatgagccaagcgtttgaattcctttgcacatctagcactgcacatggccttggaagatggacatttatgtgagtgtgtgcacgtgtatgtgtatgtgtgtgtgtatatatgcccgtatttgcagcatgtgtgtatgtgcttgtatatgcgcatgcacacgtggtcagccatgcagccaagtctcagaacaatcgttccactggaagtaacccagtcttgaggcatctggccaggtggtgcgggctgcagcacaatgtttgtttctcccagccctatgaaccccagtggggctgcatcacttaaaggccggtctctacaagagcagggtaggaagcagcagtgcgtgcccagccgtggctgtgtaggcagaaccagccttcaggatggagggtgggaccctggagccaagccagagggtgtgtacccttggtccctgatgaggtactccatcttgggccattctgccccctggtctctctgctcctcctctgcaaaccaggggggccagcagcctgctgggatcctggccctggccgggttaatggatgggaactgagctccttggctgccaagctgaggttcagtctggccccattctcacttcctctactcccccttgtactgtgggatctgagcatttctttaacagccttcaggggtttccagcccttaggacaagcagcaggtgggtatacaggggagcagaccccaggggggcctgaggagggagggtgaaggcaccccttctttgtgctgtctgtagctgctcatcctgggagacactgtgggggaggctgtggcttccttcttccgccctctggggatgccctggcggcctgtcccttgggtgttgggaggaggtggcttggctgactgtccctgctcatggtcagggtcctcctacacagcagaactggaggtaaacactgggttgccttggcaactgggctgtgccatggctccaagtgctcctggctagagaagttcccattgtctcaagtttctaggatgggtttctattttgatttttttttttttaaattagcaagaatgactaagataccaaaatgtctgacctggtttctataatttcttaataaacatttgtcttccctttataggaggaatgttttagtgattcattgacttttcttttagacggtggcaaggccctggtgaggcagtgcgggggcagcacagaggaccccccactgccgacagctggcacgggaggctgggagagcactggccacgatccagggaccaggcatgcttacgtagacaccacacgaggattttattggctttgaggctaattaagttccatggaaaattttggggagatgcctctcccctgtggggggttcagatacccacaactggtgcttccagaagctgtctgaaggctgatgcgtctgactgagcccgaggagcgccctcccacccagtgctgcactctcccgccagaggcctggccccctccctgcaggtcagggcatg

SEQ ID NO: 78513 - DNA, 1739 bp, Homo sapiens
caacctcaaggtgaaagactcagtcaccagtcatcagaacagttctggacaagtccacctctctgaggtgggcttgaaagttgccctgcaccctgtgtcagtagtcttgggcagtcttacagggacaggagagattgtgcctgcaggtggccatgctagtcctgccgagtgaccccaccccaaggaaaggactttcggagaccaggcattctctgggtgagactccccacactgggcagtcttgggtgaggatgccggctgccctcccagggacgcagtgccctgctgggtgccccgccttccctcctgagacccaggcaccatgacaggtttcttaactgacagctctttagtagagaacagaaatcctgtttgcagcaaaacttgcctcactggatcgcttcataacagctccttcaagtggggcgagctcatcgctgcggtcggcatctcagccatcagcagcccggagaatcccactcaggacttaggtttgctatttttgtgtctcgcctgggcttcgctcgtttccacaggcattccacttcttgtttacaggagtaattgccttcatgagctttgggccatctgcggatatatgtatttttttctttattttctttcttttttggggcagcagttctatgtttgcaaatatgaggattgtttcctaaagggaagcatgaggccttcttgaggctggcctcttggctgctgagctgggccttcgcacccctttcctgctttatttccgtcttcctgtgagtgtattttgttgtatagaggcgcttcctgtggtcggaggtgaacatttggagtgactaaggagagcatggccttcctcgctctcccggcgtctgattgctccgtggacacttgtgcctgttccccaggcagggcctgcttgctggagggggtcggggccactcctggccatggagtttccgcatccccctgctggccaggctcctgtgcttggggagaggaggacgccgaggcacatactgtctccgtgctctgctcttgtggtcatgagtggcctcttctctcttctgctttgagtgactgggtgtagagtggcgcctgagctggggactgtcttgcacccttgcacagggcccgccggctcaggtgtgcagcagacaccatcctgggagaaacagcagcaaggtctggggtggccacatttgcatgttctgcagaggcagttgccttcgggatttcagacttgcccccagccgtaaggcgggatgcagtgcccacagacaaggctgggtgcacacagcctcccaaacagcatcctgcagtcttaagtctgcacacctcccaccaggtgtcggcccccagcagtgggaaggagaccagccttcaggctgctcacctgaagggagaaggcaaggaggcatgaggggtgcatccagcctccagtggggacccacaggtggcctgggtgctgatgggccctggcagagtctgtgtgcccacccatgccgtcagtctcctgaaccgcaggagcaagaactggatttcatgttaggagatgatttccaacttcaagaaatgacctggaaaagttttctacttaaactgcctgttgttgttaagagctggccagctctggctttccaacagcacgcacagccctcgggccaggctgagtcctgatgtggggatgtgcccactgactgcgggtcaccatgactccatggggaaggtctccttggagaggtctgaggctc

SEQ ID NO: 78514 - DNA, 2561 bp, Homo sapiens
cttcctgcactttcaggggggtttatttctgaaggcggaaggcaggcctcgaaccccaggtgttcttgctggtggaggaaagtggaaaacacgcaggctttgtgggaagaaaggacgccactcctcctcccgtggattgcctgtggagctgggacaggcagcttgccactcttgtcaggatgactgtggaaggtgatgtctagaagagagagcaggagcacaggcgcccctcttcagcttggttttgcactaaagggacagcagaacccagagggcctggctctgtcagcccagcctccagtgccttccgaaaggaaaaaccacgcgtggtacgtaggcacacacgcacgccgcaccacatgctttttattgaagtatacgtgtgctacagaccatttaagtacagaaaagctaaaagaagaaattaagtggcacccacagttttacctcccagacaggactgttgcttggcctggttctcactgaaaagctgccagcatagagcccaggaagcccctcctggcagccaagggtgtgaccctgcagtcacggcagcctgcctgctctggccactgatgtccgcattttttagaccctggggtcctgactgcatctcaggccgcagtgccttgggctccagtggggtgtctcggtgctggcattgtagagtttaagcaccgccccagagctgtggtggaggctcagtgtgctgctgtaacagaaatactggagatgggtggcaaataaacaacaagtttattttcatagttctggaggctggaagtccaagattaaggcgctggcagattattctgtatctggtgaggaccctcttcctggttcgtagacagctgtcttcttactataatgtcacatagtagagggagcaaagggattttctggggtctcctttctaagggtactaatcccataaggagggccctacagcctcatgacattatcaccttccagaggccccaattcctaagaccatccatcaagctgggagttagggcttcagggtatgggttttcaggaggcacaaacattcagcctatagtgcccagcgttcttgcctaaccacggaaggcagatggcgaggtagggtggggtactgtatcctctgcaggcctactcccccaactcatggcagcttttttgccccttaactttgtagggccgaagcctgtgactgtcattccatctgggggaatcccaggacccagggcaatgctgctgctgcccatttagggaggggaggctgacactgctttccccatgagccgccacctgtgcagattatgacatgtttccccagagtgtgggatggaccaatgcccgctgggccacatgggaggcgggtgccctgtcaggcagtagtggtacagcagcgctgtcttcgatggaacagccaccatgccgaggacctggggatctggagggcacttgcctcgttctgcactgacccttaacatgagtctctgggacccagtctgctccagctggtgccagcctgtggttagtcagcttgcctctgatacttcactgccctggctgcatgagtgcaagggcagtgctgtgttcttagtgcctagcatgcagtggggaggaattaggctggtgtctgcaggagaagtcctccgggcccatgtgaggcgagtatgggccaagcctgtgcccctgtgcctgtgacccaggctgggagcagggggcttcaggtcctcaggctgctttaagcctgtttctcctgggcctggagggcttcctggggagggggttcacagcttccaggtcccctcctgccactttgaacttgggtgtgaattaatgaaaagcagatgagctcagatgtccctggaattccacatgaagttgaatggtataaagtaaccagccatgtgttcttggcggaaccaaaagtactcagagtgttgctgaagctgccaagtcctcagagtagcctagcctttgccgaatttgtgcttcatgggatgaatcccatttcatgagatgatgtgcttttctccattgagtgaagccctagagaaaatggcccctaaccctcggccattccagacatggagagtagtacagcatgcggcccctgcttttaagccaatatgcccattacagggcaggaagcagccagggtctgccgcagttatggtaggatattgggcatcctggacccacggatcctggacagaaggatgaagctttgggattggggagggaggggatgagccgagcaggccccccagcgtgcagggcacctggatgccgaccacattggtccgttgttcggaacctcgccttagctctcttctgccagggcctaatgagaacaatggtctctcagctgagcaggtggacacctgtgaacttcatctcattacagatctcaaaggagggagtctatgtggttctgggcaaggatgctccactttgcttccgtcttcaccaaactcttaaaatatgaagtgtaggaaattatgcccctgcagggttcaggataaaggaaatgacacccaagccttggttctttgtacctgttccatcca

SEQ ID NO: 78515 - DNA, 2680 bp, Homo sapiens
tgtaagaagttgccttgccaaaagatcatcatttgagtgcctggcatttgtttttatttctatttgtgaaagtcaagcatgttaattaaggatgatttgagaaacaggaaagtatcaaggaaaattaatgaagaggaaaatcaataactttaatcccaccactcacaagtcaccactgttaaaacgtgggatcattccatacaagtcattttctgttctacattttcctgctttaacatcctgttaggctcataaccccaaggcactgactggtttctaacctggtctgagtggttgccccgtgtgcgcttgtcttgcactgagagctccagtgattggctgtcctgggacagccgtccacctcattattttcagggggagttcccaggagcctgcaaaggaatgtgcattttcagggcaggttgcttcttttcagaaaggaaggatgagtgtgctacccgcaagcaaggcatgagagcgcccaggtatgcaccctggcagggagagtgggcgggtggctgttggatgtctaaaagggttttgcacaccgggcgcggtggctcatgcctataatcccagcactttgggaggctgaggtgggcagatcttgaggtcaggagttcaagactactggcctggccaacatggtgaaacactgtctctactaaaaatacaaaaattagctgggtgtggtggcggacgcctgtaatcccagctactgaggaggctgaggcagagaattgcttgaacccaggaggtggaggttgcagtgagctgagatcacgccactgcactccagcctgagcaacagagtgagactccgtgtcaaaaaaaaaaaagggaggcggggggagttttgcagtgaacagaagtcactgtttaagtagagtttacacacaacaacaaaaaaagggttttgcagtgaacaaaagtcactgttggagtttacacaacagaggggtcgccacgctgccccgtacctgggagcttcagactgttccgaataggcctcccctggacactgagatcttggaggctttgtgatccagccttggatgccgggtcctgagatcttgcagtccagggaaaggtgagattgtctcacagcagaggcttgcctgctgcaggccacgctcaggggtttctacctccctcagtcccagtgtctgccctacaggctcccttggtcccgctcagaatgcacagacctgaccgtaccagtgagaaaggacaggctgtgtgagctctgcctggcccaggtgtgggctggccacgggctccatgcctgccttctccatgggccatgacgtcggccagcagcctcagcagctgctgagattagcgtctgtatgtggtgccacttggtgtgcctctggctcctggccctgtgctggccccgtggaagggcctgtcagcatgtactctctcctggggacaggagcagtatcttcagggctgggtctaccaacccggtctgtgcatttccagcctcctgtgtgcttcccagctctgaattatgaccactgggctgatttatttcttctgacatttgcaagctgttaggtggcagagatcagtgaataaaaacttaataaaaggctgtatttaatcccatgcatcctaggctgagccaagttcccttaggattgagcatcaccagatagaacccagagcccactggcattgggacctccagggtggctacttggagtttttgtggggagggcagtttcttgaccgtggagcatgacgaggctggacccacctccccgtctgtatgcagccaccatgcagcccacctaggctgtgggctctgttgatgccgccttggagtgtgcggcttgctctgggtgggccttccaggggaggagggactgcagaggtagtgacagggaagggaccctgggccagggggctgggctcaagggtggctccacatctgactttgtggcctcatttcctggtctgtcacttagggagttttgctggggcctgttaaagggggagtgcctggaggtatcaaagcaggggcttgtggccctggtcatccagtagttactgggggtgtttacagccgcctgtgctgggcctcccctggagaggaagtcacgcccacgttaagtgcgtgggaaacctgtcccaggcgttctgtaaccgtagctgcaggtgctctgggtgttgcctcctggctgtagagggcccccttgtgaagaggggagccccaggttggggggcctgggctggcaaagtccctgccatctggcctgcccacttggggctggctgtgttgggcctggtcccaccagggcttgggctgcttccagatctgttttcattttcaattccctttattgctataaaaccacttcggggctgcagagaacaagctgttgtcctcagctgacctcagattcctggcctcaattgtttgcctcttgctaattttagcttctgatcatttccactcttatcctccccccaaagggagacacagaccaagaatagctgctgggaaggggggctgtggtggctgtggccagagttccaacagtgagctggcagggctgtggagtggctcgctgtggccaagcctggggcagggggctctcggcaggcaacccccacacccttcccctctctcaccgaggactctatactgcaggcatgggcctcagaggag

SEQ ID NO: 78516 - DNA, 1020 bp, Homo sapiens
gctctcatgagtccacaggtagcaccgttcatctggagaaggccttcacttgcacaatccatgatctggaagcttctgtggcaaggggccgatatacgtctccctacttatccattgaggagcaataagggttgtgactcgggtgtgcgtgaaggagagaagctccagagcccttgtctcaggtggcttctggccttctgttggcagaaaccattggtattctattatttctgtttttaaaagggaccttgagaacggaaattttcaagtgtgttttgtaacccttagcaaaaggagagcaaacacctttatgaaattctggcatgtggtccttttaacctttccaggcagtgtactggttcatgcaaactagtgctattcccttcttagggattggggtgctgggttctgtggaagcagtcccagtggtgagctggagcttgggtgaaaggtacgtgtgtgtacatacaccactttgttacatagtgttattgcattaattctgactgtccaaagtgattcatttgatgaaggcagaaatgcagaaaggacagtcacacacaaatcccatcttcctgaggtaacctctgtttccttcctgcaattagagctctggcatatgcatttcatgtgtgcatttgagggtggggctcagccacttggtagtctgttttcttccctgtccacgttcccaggggctgtttatcagcagctcacattggtggttcagaagaacattcgagagagacagctgggctggctccgtgtgcttactctccctcgtctaccccatccaacagattgtgaagcctggttccagtaaccttggggatgacaccaaggagcgctgagccctccaccccgcatgttgtggtcttgggggagggaggcaggtaggacacagaacagggttcctgccccagtggctcctcccagctcttgctagccctcccttggcatcaggcagacctaggtagcctcaggtcttggagtcccgtacagagctgttgcagagggggt

SEQ ID NO: 78517 - DNA, 1104 bp, Homo sapiens
gtgagattctgcagatctcccctgtgactgtcaaggctggtgccccccaccccccaccccagacgtcacagccagaggcaggcccaagaggcctttccatactgtgtccctttccctacccaccacgtgctctgccctctttcttccctccctccctccttccttttctcttggtgcaagagaaaaccctttcccagtagtccacagattccctggttcctactcctcatgagcccctacagtggcacttgggatctgcatcctagtggctggatggacttggctctcctagctgccatccacctgggctaattttcagcccacagtggtgtcacaaagtggtcttatggcaggagtgtggtattcaggagcctgaagggggcttctgacgtggaattacaactctggaactgcttctgtttaaatcctttgctgaatatttgtcacccatagccttttaggtctgacccgttctaaactgctgggcctatcaaacaatttatcagggagggcccttctccaataggacagtttgcagcgtgacccaggggctctaaagccctggagccctgccctgggaacatctcctacaaagctagattggactttattgctatttttgagtttctcatcctggaagccactgcccagcacattctgaggagaatctgcctgggcgaccattgttattttaagagagctcttggggtaatatgaggaactgtgctttgaaatagggaatacagaatggggccagtaatgtgcccagagtgttgaatgtctgatttttaaattggcattattgatggctagcattttctagtttgctatggattttttgttttgaatttaactttttgaataggaaatgcatttgtgtgttttagaatctaaaagatttaagtagtttccccagggaaaattctgtcaaccttccctgttctccatctgctcagtgttcccctgggtgatctctgttcctactttcctagggaccctctctctgcacatacaggccaaggcgcacgtagatccttgctggtcatctctcctcaaccttgttttcctcactcagcttggagatctttccatatcagtttgtaa

SEQ ID NO: 78518 - DNA, 1025 bp, Homo sapiens
tgactgagaaacaggctggatgacaatccctgaggcatcaacaaaggagtggaggtagagcaggctgcttccttgccccaggcaggttccagctgcggctctagctctggcgccagccagctgaatgacagctcactctctcctcctgggcctcacttcccttacctgctcagtgggtgggtaagagcttccaacctggacttcctgcgaagccatgtgcatgtcagctccatgtggcttaataaaccactaacatttctagagacgagcaggacagtcaaatggcctcctaaggagttaggaagtccaccccccaccacagaggccaggcctttctgctacccctgaggctgtatgcctgagtttcattggaggccagcagttgatcagcccctgtgtttggccatgctgacctgctccagaacaggagggtgaacagtcttcctggagtgaaaaacattgcagtcttgaggttgggagctagaagtggccccaaaccagtgcccacagggcagagctgtccatcagtgaatgacagcccactcactggtggggaatacctggagactggggacagtggcctgggagcctgagggcaagcaatttctctttggaagcctctccctgtgcctccctttgagtctgaccagcgctgcccctgccattgcctccagatacacacccacatggacccttgcgctccagaggtctgttgtatccaagacatccctgtgagggtgatggctcatttgcctttccaggacctcccggtaggagttgcatttcttcccttctcccttccatgaaggggagctcagcgaggcttcctagagaagacccagcaggaggccggcagaagaggcccttgcggcagacgctgctctggccccagcttggtaccgggcattggaaacattgcaaaaatgaccactcaacaggcttcccacaggaggttcgcagacagaaagatctgcagtgtggtttatacaggtgcagctggagccgggtggggtgggggggcccac

SEQ ID NO: 78519 - DNA, 1056 bp, Homo sapiens
cttggggatagtggagggggccttcagccctctgcaccctgcctgcctcacaccccgccttcaggagccctctcctacggcgctagggagcactggaagcagagatgccagccctggctgagcgtagcactgcaccgtccgacctccgaggcaggggccggggtcacacctgccaggactccgcttctccgtgtcccagcagaaggcatgcaggaccctgtcactactatacctgggcctctgatggggaattctggtcttctaaaaagatgttagaaattcctggtggcacatccagttccgagtttgcccgcacgggcacttttgttggaaacagtgggcaggtcatggggcctcctcatcagagggtctgtgtgagcggctgtgcatgtggcagcgcaccatgcttcacagagaccattctgtagcaagagaccggaacattgtgacttggaccttttcaggagtggcgcggatgttacaggaaatgctgtcggagagcgcgcattctatttcctccgcagggaatgccagatagaaagttgcgggcaacacttttctcagacccaccatgtccccaactcagacttagcaaacctccagcctctccgtttcccctggactcctcctcccttttcctcctgcttctccttgtcctgcctggaggctccaggccacacccagctggtggggctgctccagtgccccatcaccggccttctcctggcaggagaggaggagcagagagctgggtcctgggctgggattcgagccctgggcgggggtcagtcaagccgtggtccagcaaactcctctgcagatggctggagtgttgacccaggcttgtggcccaggtatcaccttcccttcctcctgagagttgaggcctgtaaatacaagggcccaggacagagtgtgtgcgtgcgtgtgggtgtgtgcgcgcgtgagcacacacgcgtgtgttggggggggtggggggattggggtggactcagggtatcttgccagagatacctgttttgatgagtacctattttgatgcaaaggaacggccct

SEQ ID NO: 78520 - DNA, 1228 bp, Homo sapiens
cctactggatcctacagccatacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgcctcactcctaaccctgactttattcccaggccccacaccgaggcaggtgcaggattcgccatggtgcagcctccgggtacaaacatctgaggcactggcgatcccagtccttgcagcaccctgaacacagctcagaccagtgaggggtgattcagaggtggggatgggcagagagggctggccactctgcctcaggacttgacctcaagtgttctgtctccccacccggtgtgtccagaagaccagcctctttcttgccagaagcaggtgctaagatggactgcacagggtcccggcactccctcgggacccattcaggatctcagctgggcaggggtgccacccaacaggaagatgtgatctgagcaatagtgtggccttgtttctccgcttctggttgtggctgtgtgtacagggctacctattttgacttctgacaggtgtcactgattttctttcccccatttaaaaaaggtcatttagtcaaagacacagtgctagaggtttaaagggtgtaatgtgttggtcacatcacaaccagtaagaaacgcttggtaggttatccacatcttttgctgactgtttccatatacaattctggtcaccatattttccaaagctaaaatctgaggcgtgggctgatggtttttgaaatcaggattaccccaggaagaaccaggtcctattactaattttcctgattctgaggctctgaaggcttgtctgagacacattccggagacctttgtaccagaacttggatgcatagtccaccttactactgatacacgcctgagcaccctttagggcgaggcgccgcctcctgcctgctgtcctgtccctcagcatcagaagagttgaattcagcaggagacgggagcccggtgtccatgagggaagaggggtcgcgcttggtttctactgacccccatgaagatttcagacttgcagtgcggccacctggccctgccctgcctctctctttctcatacagctttaaaactttactacttttatttaaaaatgaactggatgggag

SEQ ID NO: 78521 - DNA, 1011 bp, Homo sapiens
tagatggaaccatgtgcccctgaaactcatatgttgagtttcaccccactgtgatggtattaggaggaggaaactttgggaggtgactaggtcatgcgagcagagctctcatgaatgaggttagtgccttagaaaacaagagcctgcgtagtggtgtgcgcctgtaattccagctactctggaggctgaggcaggagaattgcatgaagccgggaggcagcgattgcagtgagccgagatcgcaccactgcactccagtctggccaacaaaacgagactccgtctcaaaaaaacagaaggaaaaaaaaagaaaagagcttggagaaccccctctcctcttctgccaggtgaggccacagcaagaagactgcggtctacgaaccaggaagaggccttcaccagtcaccaaatatgctggcgccttaattttagactttccagtttctggaactgtgagaaatgaatttctgctgtttataaccaaccctggctgtgtgattctattgtaacaacctgaactgatgaaaacatcttgctaggaaatagaagtgaacttaggaggagggttagtatatgctggagtaaagccttcggtagtttggtctttttgtaaagatgaggaagctgggtaccctctggtgagggctgccaggtgtgactcacccgactaagcagaagtcaagccagccttcccaggaaggggagaggcctgctgagtaaacagaccccggaaccacaaaggggacccttggcagctatctgtatgcataagtcttatctttcatctgtgtacatgataggcaaacaaggaaaacagtcacaagacagaaggacgaagaggaacaaaagtaacagttgtccctggaagaaatagatactaaaggcaatgaatagaataagagtcataattaacatctcaagagatgtttgaggagatgttgcatccacaaaacaagaacaggaaactagagaaaggacaaatcagggaatcaaaaaagtttagagacatta

SEQ ID NO: 78522 - DNA, 1080 bp, Homo sapiens
cccagaaaagccttttgtcatctctcagatgggttccaaaaagaagcccaaaattatccagcaaaacaaaaaagagatctcgcctcaagtgaagggagaggaaatgctggcgggaaaagaccaagaggccagcaggggctctgttccttcaggctccaagatggacaggaaggcgccagtacctcgcaccaaggccggcggagcagagcacaataagaaaggaaccaaggaaaggacaaatggtgatattgttccagaatgaggggacatcaagcataagaagcagaaagctaaggaggcagaccctgccccacccaccgaggaagacatgtggtttgacgacgtggacccggcggatatcgaagctgccataggtccagaggtggccaagatagcgaggaaacagttgagtcacagtgagggcagcgtcagcctcagactcgtggaagagccggccttcggcggcctgacaagagccttagccttggactgtgagatggtgggcgtgagtcctaaaggggaggagagcgtggccgcccgtgtatccatcatgaaccagtaggggaagtgcgtttatgacaagtagtcaaaccaaccgagcccgtgacggactataggacagcggtcagtgggattcagcctgagaacctcaagcagggagaagagcttgaagttgttcagaaggaacaactgtcagaaggaacaacggtactgtcaccgcttatcttcagtgacaccctggggtgaggggctcagcaccttcctctcggggagccacattttcctcctttgtcttaggggacataacaagctctgctgggcttgagggacccagaccaggtgtctgcagtcagctcctgagacacggctggccggcacaacaggtgttacatcaggggtttcctgtggccgtttggactttgagcgtttatctaaattaaattggcccagggttggctggtgggtcacccagcagaggcttctccccatagcacgaggatgtgtcgtctgggcacggtgaccgcggttattcctggaggtcggcagacatgccgaccttgggctatttgagctggagaa

SEQ ID NO: 78523 - DNA, 1031 bp, Homo sapiens
caaggggagcatgaaaatgaagtggggcctcagaggctactctggggaggttaggaaggagagggaatcccgggatgccgctggagggcagggagggaggcagcaacagacacctgcgggcctggctttcctggcagagggagtctaacatcaaagtcttggcatatttaaggaagccagtgtcacctgagctggtggagcgagggtgagaggatttggaaaggagggcaggagaatgggagccgggcgctagggagcctcgtcctttaggcttcactgaaggtagataagcagcccctggagggttttgagccgggggctgacgcgtcttgattcacatctgacagattctggctgctggagaatggactatggggtggtaagagaagaagctggaagagcagggagaggcagttgctccagaccagggcagagagagacggctggcagggtcgtgggggtggtagtgcaggtgaggggcagtagagagacacggctatggggtacgttttgaaggcagacctacaggccttgatgatggagggctggggctctggcaggcagggaagagtccagcatggccctaagaatgttaccctgaatatgggggtagataatgttgcctgaggagatgcagacccctggaggaagggcaagaagaagaggccagcactgtcaggcaaagcccgagactgtagtgagacttgtaaagttgctgcccagatgaacatgagggtctggagtcagagagagccctgcgttggggatgcagatgtggagttagtgccctaaagtgaaacccgtgggatcccggagtgagctcctcgtaggaccctcccaccatgcccccaacctggctccatgcagtggtgagcatgagttggacacacttgtctggagcatggacagaaaacaagctttccaaagactcaggctggggccctacagtattgagggctgaggaacagaagaaggagccagcagaagagactgggaatgtgcgggcctgggaatcagggcgaaccagcggt

SEQ ID NO: 78524 - DNA, 1059 bp, Homo sapiens
cccttggtcgttcagtttcccagcagggcagggacttcatctcctactctcctggccttagctcctctttggagaatagggcactaaagagaccatggcatccttgcaagctcgcagctttctcagcctgcttcctacctgtagtcatgtggggggctctgggctcattttgtgtctggagcagtcccaggtctctgctacatgaggctcccgatccctctgccccgcaatcactcacagcccagaggcttggaatctggtgggtccctatcagctgcaggtgccagttgccatccacattcctcttggagatttcagataagtggcatttctttgctttcgtgccccccacccctgcccctctcttgacttaattgtagctggcttcaacaggaggacctacccttaagctcttttccctaaaacatcgtgtctagtttttccactgtgtgtgagtcagccttcaaacaaccataatccagggaacattccttcaggtaaaggctggatggtcctttcacattggtttcaggaccccagcactcctgcccttgtattctgactgtgaaagatgcgatctcaggtgtgtgagagcaactgcatggctcagcttctatgtatgcccccattctgtgagtagcagaaacaatcccagttccttgaagccccactccagcttctatcacccattcctatctccttaggattgcatcagaggcatattgtgtatgataaatgtggtatttcaaatcattgatgaagcacagatcatgtaactgtgtagtaacacttggtcatccatgtgaaagcaattcactagggaaaccctttaccatttgcaaatgttacttccagatgcattaaagtgtgaacatttaggagaaaaataaccccaagaactattacaaggagatatcagagaatagtatttattttacgggaagaattttctaagcaaacccaaaaccccacaagccatagaagagaaacagcacagattttatttcattaaattttcaacttctgtagggaaaatcgtttttgtaaatgaaaagacaa

SEQ ID NO: 78525 - DNA, 1067 bp, Homo sapiens
ttctccgaggctcgatttcacctgcaaaatgggaacggtgttattgactctattgagcttataaggggattccatgaggccatgtttataaaaagactagtacattgccaggcacataggaactgacaaataagggagaattgaacagattgaattgaaatagcccagaggcttacaacatctccagatgggagagggaagagtggtagagtggcacatgtggccaaggccaccccacttcttggaaaagtgaatgagtacacatccccaggacgtcaggtgatggcttaggatggggacagtgtcagggcactatgtgtctgctgccttcatccccagggttgcagaccacatgtccatagtggatgccccagaggcagagcacggacggcagaatacctttcctgtgagatactcagttctcctgcttaccatttatattggattgtgaaatgctctgtggtcacttttgttgataacatattttgataaattctctctttttagctagagggaactgttttctatacataatcctgggacaagagactttggctgtgctacttgatggagggacagtggctgaaggatgggatgatcagcctttgacccccaggaccagcagtggtcattgggggtccttgttggctttgcagcaacccactagaccctccacgaggggtctgcatggaaggatggggtttaagtaaaaattgtaacaggcctttttaatgacagaagtcttgaatgtctggttcaatatattaaacagactacattctgctttgactcattttccagtgattataagaggctggcttggatgatctcttcttaaatgtgttgccaataacattggtagccctactgattcatgaggaatctctcattagtgcaaatgtacttctgaaaggcacataaatgacactccagggaaaagtcctgtccagagatgcaccaattattgcaagatgagccatgtgctttttgcattgaatgagacccagaaaatgatatcaactgaagcaaaaatcttaccctaatgcttaacagtagaaaatgatctt

SEQ ID NO: 78526 - DNA, 1138 bp, Homo sapiens
caggctgatcatgtgtcttagaattaaggcattacagtaattcctctggtggttttccataattcccagttaaggaatcttttcaagcattctcaggtgaacgtaagtagagcctcctgactgttgtccaggtgtcactgcggaggcaggaattgggcctggatattctaggagattgatatttacagaaacattttgaaaactagaaagctttgtgaaatgctgaaactggaagtttcccaagttatgtttcatgatgttaaaatatcttccattacaaaataaaggttctttgactcaataagcttgaatgttatgtactatttttttcttaaagatgcacaatgtccattagcatgtcaaaggctctgagaaggcctgcaacatagaaattgtttatttcagtggaatccagtattcttcaaacttatttgaccaaagaatgtcctcctttacccctgacctcccccacacatttatcagacccagtgtttatggggagggtaagacacgaatgtggcatttgctgaatcttggagcagtagaatagttcttcatgtcagaaagctatatggtgtgtcatgcagtaaatcatcgtgacctaagacactttacataattacttccttttctagtcttttaaccaaaatttattgagtttctactgtacagaagcctaacaatgctggatggtagtgagtggaacactctgtgcctgatccatggacccaggtatcagcatctgcatcagcaacggcattggcatggggagggcatgcgtatacctgcacgtgcttggcctggaccattacctgctgaatggaactctattaacatgaggctggaggatctctattgagcacatgctaccagcaattcccgggctccccggcgtttgacagctgccgcatcaggtgtcttgcttctaccttctctgtgttttgggttgggttccgaaagtggccagggaagggcctggccttgagaatccatcctgagggagaatagatgatgtggcatgacctcatacctgtgtgtgtgtgcggagcttagtgcccttagaaatgacagctaaacccttatattttagaagatgtttatcacttgcatgttaagatcaagggtcctgaggaccaag

SEQ ID NO: 78527 - DNA, 1015 bp, Homo sapiens
acagcaccggctttgtgtgcgaaagaggtgtcctggggagacatcgaggagcagagctttatgtgtatggtattttttgtctttgaaacacaggctgcagagaggctgacaaagttttcagcatgtagctggaacatcctttgaacattattctccaaccccttgaaatgcatgccccacaggccaaattttttttgccccattttactctctgtagtttttacatggaaccatacgtcttgtaggttttattctgagaatttataaaattaagagtgtctttttaagtagttattgtctatggagatcttagagtcctccgttagggtacgcagccttcccctccactttgaggtcaagtctatacaaagatatttccagaaatgtgtgttacagtgcatttcccaagtgatttgccctcttggtcctgaggggtctgcctggattagagatgaagtctcttcaggctctacaattgctgatctctcttatgtaagaaagtcccggcaactgacacttgcagtgtgctatttaaagaaagttttctgtgaatctctttgcaagtgaagagaagcttgtctggttatttgtgatgtttcttctctgcccacaaagaggcagggtggccaggctgggggtgcaggctggggaatcacagtccctccacagcacctgctttgttgactggaccttcttggaacctgttttctcatctgtaaactaggtacgctggtcgaatttcttgttttctttgttgcttctttgtctgtttcctaataaataacagaaactggagggagctagggtgcggggtccgtgatgcccaagggttcccagtcaggtgcagctgggtctagggtatgcctgcccccagagagcagcgctttgggaagcccatgcctgtgtctgcctacatggctccgtttctcactatgccattttctgtctccctactgagttcctcatacacatgggagcagatgaccaccagtagctgcctcacttcagagagcta

SEQ ID NO: 78528 - DNA, 1044 bp, Homo sapiens
aaaatccagccaaaatagaagtgaataaaagtacagagcttagtataaatgggtggcaaaccttggatatgtataaacataaaaataagacaggccatctgcatgaattacagtgaaagtatgtgatgtaaatgatgtaaaccttgcaaatagtattataacttaggagagtctttggctgggtgaagggagcggatgtgtgaatatctaatggcttcatctttcttagcaaaacagttgacgatcactatgtcgaagaggctattttaaaaaatgagggtgataacttcaagacttttcataatgtttttgttatctttagaacaatcatttaggaagacatttcttacagtaaagaggcatttctctgaaatttagcagctctttctgtttggctgtcttgtctttcctttcctttcattatctttgtagtgaaaaatatgacttgccgaatgctcagtgtgttgtgggcatggaggatacctggtgagctggcattcatgcatggagcatccttgcaaagcggcaggtgttgctatggtaataaaacaggtgaagtgatggagggtcgggggtgagatgtggctcaggaaggcctctctgaggagtgcttggataagacccagatgctgagctggagccagcctggcataaggagcaggcttcagtgtcctgagcatgaaggagtctgttccagaaactgaacaaaggccttggttcagtgtccctgctttgctggtgctctaacaggtgatctgcctagtggctagtgctgcccctactatgctcttcatgccttggactgtgtcttcgtcttttcgcctacctaaccagcctgtaagattgtctggaagatgttcaatgaatgtataaagatgcattatgaatgaaataacccatgaatgaatggattctttcagggtgtcaggttaatgacatatgacagtttatgccatgaactgtttcttatttttaagtttgacattgttgaagtagacctccttttggaaacacaatgaaatccaaattttccagcatgggatt

SEQ ID NO: 78529 - DNA, 1050 bp, Homo sapiens
caaaagttgttattgtttgtttttaaatgttgctgaagtccaatttattacttttaacgtacttttaaaaaaagtgactagcgtcacatctaagaccttttcatgtagtgctaggtacaaaacatattctcctacaatttcttctaaacttttgtagttttgcattttatgtaaagctgtgatccatttttgattattttttataagacatgatatttagatcaaagttcacttttttgcttatggatgtgcaattgctccagcactgtttttggaaaggtgattcttccattgaattgctttttctactttgtcaagtatcagttggctgtacttgtatggatctatttatgttgtttaattctgttccattgatctatgtgtctgttcctctaccaatactacactgtcttgattactatagttacttaataagccttaaaatcaggtataatgatttgtctcatttaattcctctttttcaaagttattttagctattccaacttctttgcctttccataaatattttagattaagcttgtccatatttacaaaaacaccttgctgggattttgataagaatttggaaataattgacatctttattatgttgagtcatctaatctatgaatatggtatgtttctccattcatttattcttctatatctttcatcattgctttgtgactttcaatatacaagtccaatacatgttttgttccatttatacctaaacattgtattttattttatttatttttttttgagatggagtcttgctctgtcacccaggctggagtgcagtggcacaatcttgccccactgcaacctctgcctcctgggttcaagcgattctcctgcctcagcctcctgagtagctgggattacaggcacacaccaccacacctggctaattttttttttttttttttttttttgtatttttagtagagatggggtttcaccatgttggccaggctggtctcgaactcttgacctcatgatccacccacctcagcctcccaaagtgctgagattacaggtgtga

SEQ ID NO: 78530 - DNA, 1030 bp, Homo sapiens
aaattgtacagattgtcatttcaaaatgatacatttttaaaggaagagctggaaaagtagcataggtgtggaaaaatcactgtcaaaagaaataaggatcactgccagaacatgttttcaagaagactgactgtgttaaggcttaatggttggggttttttttttttttttttggagaaaaaatattttaaaaattgtcttgagttataatgctatgatcagaaaaaaaaaatgtcttgtcactgggaagactaaaccttctaagagaaattcccccagaagttggggaggtaactgttcccagcgtccaggccaccttcctagggaattttgccccttggacctcaggaaagcaatccagtgggatagacttcccgactcctcacatatgctgtgaggacagagcacaagggcagccaggcctggctgtcctccttctcatttctattgtgggatggggactagggtctgcatagcagtggtgtgagcctggatgtgtgcaggaagggagcagtgcttctaggaggcttgtgcacagcagtttctcgtccattccctcagcccttggcttcctggaaccgagagcattaattaggatgcatgtcacactggcatttggggtttttggagcaggtagcaaatataagcccatcttttggaattctgggcccaacagtggatttgggattttcttctgttctactatggcttaagtcatgagagacatgctttaaatagggaggcagcgatgtgatttacaggcactttcccagccctaagtaggtcagggttttgtcacagttttgaggagatcacaggtgagtcacagtaaatttggagagtcacgaatcttgtcagaattcagagtgcgtttgtgatattgttaaatagcataccttaattactggcctgtgcagtgtcctctctgtcccccaccagcccccattccctggagtagatagtacagtctccattgaaaccagccatcagagggattcagcttcacttccggctgtgaaaatctgatctc

SEQ ID NO: 78531 - DNA, 1075 bp, Homo sapiens
acttgaagaattcttgcaagcttgaaaataactcttgcctgattataaaggtcttgagttgcataatttcctttaaaactatatagagatatttctcctgtcttttagcacagagttatgagaaatttgaagtcagcctgttttgcctagatgttcatgtgattcttttaattcggttaatttacttgaatgtttctggatgctggtattgctgtatcactttcttttaaactaagtaaagtaaaacccttgtaattgacagagataagtcagtttatttcagaagttttcttgtattatatctatgaccttttttctgttaacaattcaagaatgttaattatatgcacattgtttcttttgtcttatatttgtcatctctttgataaagttgatatttcatattcttctccatttcatttgcttatctctggggttgattgcctttattctattatttagttgcatctaatatggttttcatccctattccatttattttaatttttatttcttcatttcttttccatgctctgattctctttctgttggtttatgatctcttctttgttgttgttgtttttttttttcctttttaggaaagtgtggtaggcaggaagacaacccctcaaagatgtcagtatcctaatcccccaaacctgtgaatatgttaccatgcatggcaggaaattggaactgaaaaatgaaatgaagttgagcatggaattaaggttgctagtcagctgactttaaaatacggagactattcctggattgtctgcataggcacaatataatcagtagggtctttcttaaaagtggaaggagggaggcagaaagatgagaaccagagtgatggcagcttcaggactttgcctgacatcattggaggtgggggaccaagagctgaagcatatgggggtttcagaagctgtaaaagaagagggaaacgtttctctttatggtgggcagaataatgaccccccagagatgttcctgtcctaattctcagaacctctgcatatgtcatcttatgtggcaagagggagttttcaggtgtgattaagtgaaggtc

SEQ ID NO: 78532 - DNA, 1048 bp, Homo sapiens
aaaatgcccattcagtcactgaatttggcaataggataggaagcagagcaggagggtatattacttcaattgtgaagcaaatgtattattcattggcacaagaaaggcatttgggaaggtgatcaaatgcatatgctttataaagtcacatgctccaaaaactttgaagagcaggtattttccgctttttgaaactattttataacagtataaacagctgaaaggaatgagctcagtctaatgtgtacccactttcatacactaacttagcgagagaaggttgaattcatttatttacttattttgtaaagtcaataaatttttattcaaggaatttcatgttttgatttcttccactgcccatcaaggtcactttagatcctctgaagagctggagtcaaaatttattttcaaaaattaccttcaagttagccctttcaaatgaaactgacatttattttaatccagttgtcctgtcaacccataattcttttattttggcttctgtcatctccttttaatatggatatactgacgaagacttcaaaattcaccagtagtctttgggatctgatttcttccaccaatttactttagggtcatttttagtgtaggtggatctgcctggttctcaatttgacaccctctctaaacatgaatgagttccaatcatattcgttcctaagtgatcaaattcaagaatagtacagatgtgtggaatatgccaatacctaaggtaaaaaagtaaattatcaggtctttactaagacagttactgaactaaagacagtttagtaactgtctttttcatacttcagcaactgtcttgtggttccttcccacagatgtaacaatagtcctgtaagtaaagtaaaatcacagagttactctatgaggcatttccaacaacgtgcaggctacaggaaaagacctatcgggatagacctcaacggaatgttgaatttaaaaagcaagtcaccaaatatcacttaagtaaaatttataaatatactaaacagcaaactacatcaatgtttctctttttcgg

SEQ ID NO: 78533 - DNA, 1009 bp, Homo sapiens
gtcacgtggagaggcgcgcgggggcgggcggggcgggggcgcgcgcccggctccttaaaggcgcgcgagccgagcggcgaggtgcctctgtggccgcaggcgcaggcccgggcgacagccgagacgtggagcgcgccggctcgctgcagctccgggactcaacatgcgctgctcgccgggaggcgtctggctggcgctggccgcgtcgctcctgcacggtaaagccactgcctccccgccctccactcctccgtgggatcccgggcacatcccgggcgcctctgtgcgccccgcgcctgggccaggtttgggatctccccgccgccggggaggggcagcgggggcgctgcgggggctgcttgtctgggctgcaccgggtgggcggcgggggacgccggcaggagggagtcgggggtacccccgccggcctgccctgagccccctgcccgggtcttctctccttaagtgtccctgcaaggcgagttccagaggaagctttacaaggagctggtcaagaactacaatcccttggagaggcccgtggccaatgactcgcaaccactcaccgtctacttctccctgagcctcctgcagatcatggacgtggtgagtcccgcctggctacagggctgccctctccccttcctgggctccgaggggctttttagacagcgtcgggcggccaggcggtggagctcggctggggcactctagttggccccaagctaggcagggccatgctctgagtctgtccccagcctgccctctcctgagtgtctcatttctcggtttcccctccagccaaggagggacctggtaaagcttattccatcaccctggccacctgtgcatggttacttgggtcccacctttctctcaggttagaaactcaagcatcctgagctgggactcagtagcaagaacaggtgaagttcactttttaatctcccttatggtgtaagtgttgacttgcattccagcattgtcaatttagccacttctagacttt

SEQ ID NO: 78534 - DNA, 1056 bp, Homo sapiens
gttagccaatctgtgtaaacttgcctattgttcctctatgctgctttggatattcaatattcatggtatattctccatacaatacaaatacttcacacaagtgtttaattcattataagtgggtttggtgtcttgtctatacggagtatcggattctattgtggagcaccctggagtgtggcagggtggggcacagggataataatgttcattgggagggagagcatgatgggaaagaggtgagagaatagccacaattactggttaaaaaagaaatagtgctaagagctacctggcaaagtggaaaaaggtaagaggtgatatttcataatcctacaaataaacagttacccgcactatcatgttgatgaatggtatatcacttaacctagttaaaattgccatcatacattgcctcctttccaacgctacactcgcctcaaatgtgttcttcctcctacagacagaatcatgctttaaaatattgaatgtatatgtgatgatgtggaaaagttatcatgagaagagctgtaggggaaggcaggttcagtctcatgtgttgcagagcagcaaaagttgctgtttatggagcagttcctcagttgctttaaagagctcaggatttgtacttgggatcttcggtgggttctgtctgtgttggtttctggatggctgctgttaggtaagtttcttaagcatcttgagccttggctttccggctaataaaatgcacactgtcagtcattgtgatcaactaaagaatatggaaacaacttgaagagaccttaaagctagatatgtgattatggtcattttcatgcagaaaccacatgaaaaaggaccaggcagcagagctaacacaccccgcaagtggtgtgtgacagggtgagaaagggacagtagccccctcttcccccatttgtccagggtcaactccagccaggctgtcacactgtttgtgtctgctccacagctgtctctcttggagtgggtgaccctgtattgcctggatgggggtgatggtgtagtagcccctcagtagaggaacaggaggaa

SEQ ID NO: 78535 - DNA, 1464 bp, Homo sapiens
cattagtccattcaggagggtggggccttcatgacctaagcatctcttataggttctgtctcccaataccatcctagtggaaattaaatttcagcatgagttttggaggggtcaaacattcaaaccattgcagttggccaggcgtggtggctcatgcctgtaatcccagcactttgggaggccgaggcgggcggatcacgaggtcaggagatcgagaccatcctggctaacacagtgaaaccctgtctctactaaaaatacaaaaaattagccgggcgtggtagcaggcgcctgtagtcccagctgctcaggaggctgaggcaggagaatggcgtgaacccgggaggcggagcttgcagtgagctgagatcatgccgctgcactccagcctgggtgacagagcgagactctgtatcaaaaaaaaaaaccaaaaaacaaaaccattgcagttatatgttttgcaggtatcttagactctttggcttattgttttactttttgacattctttcttttctccttttgtaaactttcaattgaagtatgacatgcttacagattaatggtgtcttttggtgaacagaaattcttaattttagtgtggcctagtttagaaatcctttcttctacatttagtgcttacagtgtcatattttaaaagtctttcccttccccaagttcatgaagatatttttctgtattttttagaagctttccattgttgttttagtgaatttttgttactgttttacctctcatgtttgtttataacccacctagaattgatttttgtgtataaagtgtatcacttttaagcagttttatggaaattggactggtgactaatttattttgtttttcaagagttgtgaaagggttgttagtggaattaatgcatgattgtttaactgtatcacatttggacattgtattgtccactatgcctgtgccctaatggacattttaattatttaatgtgtgtatgatatgaaaataatgtatgggtaatggaaatttttaatatttaaaaatgttgacatcacacacattatttacaaagtcagtagtaaagaagggcttatgagaagccctagcccctggccccaggtttcccatcaccatcctaagacaggtacttttaacaggctctgtttcaggtcatcactaatattttaacattctgcttatgtttctatttcttgattgattaaaatatcaaattctctggacctttactgaaattaaaatgcctttaattaaatatcttcagtatggatgttcttatttttaggagggattttgttaacaaagaaaacattaggcaaattcaatttagcagacgttatatgagcaaagaacaattcatgaatcaagcagcactcaggaccagaagaggttcagagagcttgactcagtagtgtgagcaaccagcttttataggctgaacacagaagcaaattagata

SEQ ID NO: 78536 - DNA, 1048 bp, Homo sapiens
tctattggattgcctgcccttttctgattgattttttggagtttatttcttattctggatatgagtcttttgtcagacctactatcttgctgactcagggaaaacctcagtttgttatgctgtaaaactaagaaaaaaatatggttggtgtaaagattaaattagataaaagaagtcaccgtttataaactttagactgctacacaaatatgaatttatattatccagctattttctctgcaaacaagaatttagaaatggtggtggttaggtctattgttatgtttttgcttttttttttttctcagcatctacacaaaggaaaaagaaataatgtgatgggagctctgtaaaatcacatggaatgatgttacccagtaattcacgaaagaataattgctgcagaaatgcaagatagcacattacgcattaccacgacagttgtactctaaaccagatagacgattattcagagagattgattttaaaaagcacgatcacttaaatcaaagcatgctctcaactgaagagctcagatggaaaaagaatgaagggagttaggcgcgttgactcgagggtgccttgccacaccggccttctgggattctgtggcgggctggggaccctgcctcctcctgtcttcatcccagagggagaggggagtgtagatcttgcaggagagccgtgtgtgtgagtagccacgtggtgacagccattggcactgagtgacatcgcacagattgcagcatgctcctcctcttcccacctgctgtagcagacagggcagctgtttgcatccctgtttcggaggagagaacattgaaatgcacagaagccaattgcctgctgagtcgggagcccccagggtcttttgcctgtgtggactctgctcctccatgccctcctgcccagttggggagggcaggaatagccaggggggcagcttgaggatctggaattgctgaaacccactttcacagtgcaatggtctgaatgtttttttcccccactaaatgcatatgttgagatctgaatccccaaggcgatg

SEQ ID NO: 78537 - DNA, 1029 bp, Homo sapiens
gtgcataggcttagctggaggcagaactcagggaggtgttttggaaatgtaggaaaataagctctggagtcagaaagatccaagtttgaatggctgcttctaaagtcacctcatctttctcacctttagtttatcacctgggtaggctttaccttcaggtgtatttcaagagcccgatgtgcctcctagaagttagaggttgagagaaaagcccagatctgcagggacaaggcagagtcatggccctcatggcaccactcacacagggtgcagcagctccacacagggccatggcccctttcctgggggagggaggcataacatacttgtatttgtttaaaagcatatatattttggaaacaaacctgactttaaaaacttgtattttcacctacttttatgtttttttttaagcatatgaattatttaaaaatacaaagataaatagctaaatcattagcaggcatcatttctggatggtaaggttgcagagttttaattttcttctttatacttttccatcttttttaagtgctgtataataaatgtgtcttactttggaataaatagaaaagcttaactctagggaaatgctgcttgcatatattggaagtgcttggtgcattctaatttccacacacaacaacgctctcgacagtcagatccccatgtgaataattgtctcattctttcttttgtaaaccatattatttatgctgctgctttttttttttttttgaaggatgagaagaaccaagttttaaccaccaacatttggctgcaaatggtaagttaagagaatgacaatctctcccatgggctgcaagatcttgcacccaagattcttgttctgatacctgagatgcttgcttctgagaggtcctgtttaggaaaaaaaaccaaaaaaacaaaaggccatggctgtcacaccaactccacacctgccaacaatgaatgctggctgtatgacactacagtctgcagtgctcaacacatgcacaagatcaacacataggacaaggtaatgtg

SEQ ID NO: 78538 - DNA, 1055 bp, Homo sapiens
agagagtccccaccagcaagaagccctcaccagatgcagctccttgacctcggactcccagcatccatactgtaagaaatgaattcttttctttataaattacccagtttcaggcatcctgttataagcaacagaaaacaaactaagacagtagtagttccaggtgagcagaggtaattttgctgctggagatctcagagaaggagttttgaggatgtgctgttacagcttctgtattaatcagatattcacacctgagctggagggaggctgtttctaaatcatgtgttgtgggaagagggggagcagcagcttgttttaaagcagtgagtggagccagccaacctatgtttgcatcttcaaagtcatcctccgaactgtccatctcactctcccaggtctcatcatggtcgctcttgctgtttgtttttaatttgttcattcactcaaccaatatttagtgaaggctccctcagcataatcacacactgttctgggaactaaggattcagcagtgatccagccagacccaaacccaccagagaaacagagatggggaagagaggagggaggcatgggccagattgtaggtgatcccagaaaaatgaagcaggaaagggaatagtgagggctgagccagaggtcagggagagaccaggagacagactagagggctgcaaaggaacaggccctgtgatatcaagtggagagagtgttcctgacagaaggaacagccagtgcaggggccctgtcaagaaggcttgtgaaagacttcgaaatgcaaaaaaaaaaaaaaaatagtgagggaagagaaaaaaagacacctcggttcctacagaatactaggcatggtcacaggcaccttcctggtcatctgagtctgtagtggactgtgcctgtcatggtcttcaaactagttttcaactctaacttctagaaaactgatggcaaaaccaatgattctagtccacggagaagcaaatgtgttttgctggtggaccaattcccctgttgacagattcagatcagtgtgcctggttgtctttgtatgtgtc

SEQ ID NO: 78539 - DNA, 1034 bp, Homo sapiens
taaaaagagacatatgtcttgaatatcttgctgcgattttaaaacactcatgataaaggcaaaacccttataagctctcaaagcaaaaaaaaaaaaaaaatcacaatagcaagaaacagtagcctagtagaggactactttcaaatattgaagggcaattatttttaaaataaaatattttgttgaactgaactttctgggcaaaaatgaaagcagttttaaatatgtaaagactcaagtctgaaagaattactcagaattgtattccagcaaaatgagaagaaaccaagaaagaggcaaacctggaatataatcagcactcgtgagtgatggaatcactaaaaggcatagttcagtctaattatttgatgatgttgttaaatggtttttgttggcaggggactaagaagtagaagaagtaacagcagacgtttggtgtcggccttctttggttcatgcatgataaagataaacctcgttaaatgcacaaaatgaaaaaaagtacaagtaaatatgtatgttaaatatttgaatagctatcagagtaacagaaatagtgtcataacttccagaccactagagataaaataagggaccaaaacctgaagtcgatacctctaatgcaagaacagaaaactgagaaacagtgtaagtatgaggtctctcatggatccctggcatgggtatgaacattattttaaactgaagacatttgagattaaacagatagggaaagaagctttttcagagcttacttatcagactacagcaaaaacttctgggagcgagcctggcataaatctcctttctaggggagtctttactggctggaaagaagatggaaaagaccagttgcacctgcataaacaaaactttcccacagaccttcttatctcccatttgctcccctagaaaccgatttgttcttttcatagaagcccttcctctcccctctctctccgctgtgcagtatataatctcacctttagctgtttgaagagttgcatttttctttgtgcccctgtgcccatgta

SEQ ID NO: 78540 - DNA, 1028 bp, Homo sapiens
agcatgtcatacatattgatacattgcatttttattcagttcagtgtatttttttccatttccttgagactttctctttgactcatggattatttagcaatttggcattcagtttccaagtgtttggagattttcttgtcatcttaatgctattcatgtctagtttgattccattgtgggcaaatatcacactttgtgtggtttcacttcttttaaatgtattgaggtttttcttaggctcaggatatggtctatcttggtatatgctccatgagtacttgttggtagacagtttcctaaatgccaattaagtcctgttgtttgatggtgtaagttcttttatatccttgctgattttctgtctagttgccctgtcatgaattattgagagaggagtgttgaaacctccaaatatagttgtgaacttgtctatatcttttgaaaatttccatcagttctggggtcatgtattttgaagctttcttgtttgagaaaggatttatgattgctgcatcttcttggtagactgagcttttatcattatgtaaatttatatctatctttcataattttcttttctctaagatctgctttatctgataataatatagttactcttgtgttttttgagtaatgtttgcagggtatgtgtgtctgtgatatatatatattatatatatatattcttcgttttttctttcctgcctatgatgtacttaacttttttttagaatttcttttttagaatttttagaatcttttttatttatagtgtttttgagtatgtctctttgtacacctatttcatggttgctcttgatattacattttatgtatgtaacttattacgttactgactactgatataaacatcttactggttcaagtaaagtagataaattttctcttccttcttttattgtttttttctctctttcaagaacttccttgagccatacttcttgggtgattctgctggtcactatttctcttagttttttcttcatctgaaaatgtcttgacatttc

SEQ ID NO: 78541 - DNA, 1077 bp, Homo sapiens
tggcatacttgtacatacatcttgacatagttttgtgactaaaacggtataaattccaacttagaaatggaattgctgggtttaaggctacatgtatttaaaattttgatagctattgccagattatcttctagaaactgatcgaaggatgtaactccatcaagagtacaataaaaggcccaatttctcagctttctataatagcactgggtattttcaaacttaatgtttttcccaatataattggtgaaacatgatatttacgaatattattctgattttggtttattttgtgtataaaatgggacatcttttaaaatttttttgtagttttaattttgatacatttatatattttacccagttcctaattgggttatttggctttttcttaatttgctcatgcactttgggacatttttgtcttatgtctttaaaatatttttatcatttgtctttcgatgttatttattgatttccttatttattggcatagagtttaaatttttatgttgtcaatttgtgagtatttttctttgtcgatcgtgggatttgtttccagtttttaaaagccttcctcattctgagattataaatagacttactcgcattttcttctgaaactttatggttttattggtttaccttcacatcttcagactccctggaattcatttgttgcaggacatgagggaaaaatccatactttttcctcgaaatggtggtcagcagtatcaataaatatgtaataatgcatttctaaaatacagtcatagtgttttccccagttgttcaaaatgcagccttatttgtaaactaaatttctttaagtgtttggttctgtttctgttctatttatctctatgaatgcctttcatttctaaagcattattcatactaatatcagtattttcaagtcaacactcccatcaactctgaatctctctctcatatgaatcttttttcaattagagtcacaatgaatttacagattgagtcttcctattcaaaagcatgaaatcttgtgtttaagtctaattttatgtaacttagtagtgttttatgattttgttcact

SEQ ID NO: 78542 - DNA, 1032 bp, Homo sapiens
gattataatcgttaatataattgctgtgactattcaaccttcagaaagctggtttccatccagccctggctctggggctcacaggctctgttgccacataaggaagcagcactgggcaagttcctggaccacttgcaccagcaccatagggagcatgaatccactggtgatttgtggttgttcatttatttcgtataatgagaacaaactccctgccacatttaaataaaagcctaattacatctccattgctacagatgctattactacctttctgactggctataaaagttaatgagttttttattgctttgcagagtttcaaaataaaatgcaaagtttagagatagatgctatataaggtgaggtccactctgctttgctctttttgagggaacctagaaccttaatttaatgcttttcattttagaatatggcctgctttgcattatttcccatttttttggacataagtatggcacagggattaaatataactaagcaccattgaagaaaattgcatcaaatcagctgaagataagtgaagaatgtttttatgagctacacgtttttgaaagagatacacaaggctgacaacctaataaaagtttaataatgtgtgctcacccatttgctgtgctttcaaggtcctctgcaacactgatgtgcttgggaacttccaggatggatttccaactgttagtcaccaactagcagaggttagttgtattgtgctgccagtctcatatatgtaaacctgaatttgtttttattccttcctgcattgcttgatttttaaaaattcagttactctaggaaaagaaaagccaaaataagccagaaatttatattttttattcatatttcaagaatcattctaaaagcaagtgataaagttaactaatttctctctgcatttagtacagttactttatcttcccaaagaggaaaccaaggcctggaatcaatgccatgtaggcacgtgcaggtctgtgtgctacactgtggtggcaccgcacagggcacctggaa

SEQ ID NO: 78543 - DNA, 1032 bp, Homo sapiens
tggattcaaaaactgttgagtgtgtgggttggggtcagtgcctttcctttcttttttaaaaattatttttaagttgtgaatacacataaaaactcatcatcttagtcatttctaagtatatagtccagtggcattaaatgcattcacctttttgtgcaactatcaccaccaaccatctataaaactttcatcttcttaaaatgaaattttgtacctattaaatgcaaacatgctatccccaactccttatcccctggcaaccaccattctattttctgtctccatgagactgagcactccagacacctcatgtaagtggaatcacacagtgtctgttcttttgtgcctggcttatttcactcagcataatgtcctcgaggttcatccatgttctggcgtatagaagatgtccttcctttccgaggttgggtaatgtttcattatacacatggaccacattttgcttatccattcatccacacaaggacacctgggtgacttcactttttggctattgtgaataacgccactatgaacatggagtcccctgtatttctaatcataggtattggtcttcggtttggggactcatgaaattccactcctacttctctgttcttctactgctcctccacatctttgttcttaccatgagtggtattttgtttctaataaatgaaaaagtatgatagatatgatacttcatttaatgaaatgatcaacacaaacctcgggcaaatcacttaatttcttcacaatgtggccttctcatctgtaaaacagtaatgtcattctttacctctttggcttatgaggaagataaaatgagaccatgtctgtaaagagcttagcacttagactgtcacgtagcatctgcccagcaagttgaggttggtacttggttccccacagtggggagcagggattgaggcagaactcattcatgtgggcatagggaacagatagagccacaagctcagagccagagggactgtgagggcaggtgcacccttaaagatctttaggagaaaa

SEQ ID NO: 78544 - DNA, 1599 bp, Homo sapiens
ggttgctgaacactgaaccgttagtgaggaaataaatgtttttcaagaatcacagtggaagtgaggctgaaggcccacatttcattagacagaagagcacactcctcccgtgcccctatgaaatgtaatgtctgatgaagcccagcaagaattttactgaccctttggggctttgcaatttggctgaaacaggttgtgaagtcagcagccattttcttcagccttcacaacctgaaaatctttcactcaatccagaaaggataggaatgagagggtgaggatttgtgagcgagcttctcaatcatagcaagttaaccagattcgaaatggaggaacgtgagtctctcacgcaccagtcttaggtacagattttgcatctggcttttcaacaactgtgcagaacttcagaggtcccttctctcttctgtaagccacgggtcttccagcaccagctgaccaagagccactgaatttttatatttctgatatctcatttttgataaattttttgcctttggagggttatttatgtgtttattatttctatggtgacaaaagtgatgaaggatcttatgggattttaaaagaatgccctttggaggctattctgattaccaaaaagattgaacaggagaatgggctgtttaagaaaagcccaaaagttctcatggtaactagagctgttattgacagaaggggattggagatggaggtatctctgcccaaattaacccattaacatatcaaatcctttaaaagaaaaaaaaagtcctacatgattcaatatttgagaatattttctcatacagatggtataggagggttcgggtaaaataaacagaacaacagcgaagccccaggaacccggacctcatggcgaaattcacaccctttttgagtttttgtccattctgcagctctgagggcccccccacctccacgcgcctctgtcaggttagaaagcagaagggtcttccaaggccagggcttggctggacttcagctgtgcggggatgcggagctgcaggagaggggcgccctctggtggccgctacgggctgtgctgaggccgagtggatgggaaatgggcaaaggggcctagaaaacccttcctgcagactcgcggaaggaggaaagtagggaggcatgatgagagcgctcatgagagatgagtggtaaccacagctgtggccaagccgcttttttacaagactgagattcccccagggcctcgggtcaccctggctttcctcaagacacccccgacccagccctactccctgaggtcctgaagggacctctggggtcctggttggtacggattctgcttgattcgtgtcggggttgatgcttgtcccatgtggtggttaaggatttgggacgtgaatccctggggaagttggtgtttgggacagattggaagaggtgaagaaggaaggagaggaactgttacactcagaaagggaggcagacagagtagtaaaaagaaccgggcgctcccaagctgagctgagacctggcctctgtgtgtggcgctggctatgctcccagcgaggatggagagcctgcccttggcactctctggacacttccaagggg

SEQ ID NO: 78545 - DNA, 1085 bp, Homo sapiens
tcccagcactgctgttttaatgaatgcaggatgattcagttcagatgtaccatgatttgattatcctaaagaaattacaataaccatctttacatctatatatctgtacacatccttatttatttagaaggaattcttagaaactgaattgctgaataaaggcacgttttatacgtactgcaaaatggctaagttttttgggtaatctacttcatggataataaactgcaatatggtatactaaacctgacttcttcccagcatgtcacagatccgcctccacaagttaccattctgacttcaaatgacttgcttgaacaaactcacgtgcctgatgttgactcacctatgttattgcaccatgaaagatgtggagcgcatcatgttttcacacgaattagcatggaaaggtggtaactttatagttttaccacctcaagcttttaatacctttcttgctgcaatgtattgccaaccaatgtgaaccataatagcaccgagagaaaacaggatgcaggagggaaggaagaaaagtaatattccttaaaatgtgcagcaccatgttctctaaattttgaaatactgaacaaaaagcattaacaggtttgtaaacctttaacacaaattgagttctatttcctctgctggcccctgggaagggtatgtggcccagtggtggggacctgagagttggctggaaagtcagggctctgggtctttttccatactttaaagctcagtgagcaaatttgagatcaattaagttccccatctggaaccggatgaaaaagcttgccagatccacctcacgtgataccacaatttcctatgaagattactattaaattaaggaactatgatgaagaccaactggcgtaactgcttgggtttagttatcttccagaaatgattcatgctatacgtatttaattagtttttttcagttatttgaaaggctcctttcaggaggatgttggaacacaattacatgtgacatttggctgagagcagtgactcctaggtcgtgacctgtccacctgcgtgtgcccgtagcagcattgagcaggtcttcccagaaaagccaa

SEQ ID NO: 78546 - DNA, 1940 bp, Homo sapiens
ggggtcctgattttgaaaagaggagtggaccaatcagatgtggagcgctgtttcgcgctgccatttgagcctgggctgaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaataggggtaagttctgtgaaaagggatttaggtttaaaagaaagggcacaccctttatcatcacttactaccagatcgtgctaaaatgttcactctgtgtatcaaaaagaatggttaggtgtgtaattcagttcagatggtcgattgctgatatttaaaaagtgacattcttgttttttttcccccaaggatttttgatcattgagagaaagttgcaggattttccaacttcagcactattgacattttggattagataatttttgttaggggaagacgaaatgctgttctgtgaattgtgggatgtttagcgggatgtctgtcttttacccactagatgctggtagcatctctcagttgtgacaattaaaaatgtctccggatattgccagcttactgtatttggaacaggtagtacgttgggagggacaaaaactctacccctccacccttgttttagagtaaggttgtagagggacaagggagaccagtgcattttctacatgaatctgtagatgaagaagtatgacagaacattagaaataggcttcaaatgatgactgcatattcactaatttgggaaacagatttgctgcttggccatgtcatacttttgggacagtaaatttttttttgtatgagtaaattgagaagccagagtggaataattgagaagttgttgatgttttggtggttgaaataaagggattttgaatgagattttaatagctctgccacataatcaggaattccattgtgaaaaataagctgaatgtaaagcattttattttaaatttatgtgcctaatttatatggtacttcctagtacttggagacaagctaataaaattaatatacgttgcttttaatagtttatggtttcttaaaaaaagtgcttggagaagaaaaccactaacaaaagtaatatgtgtgcctcttaatcgctgataaactttggagaagttatttttgttggtagcaaattaatggcaatacatgtacttacatttaaaaagct

SEQ ID NO: 78547 - DNA, 2403 bp, Homo sapiens
tctgtgtgaggataccgaggaacagaatgttaatttgatccaggtcactcagctgttaagcaagagttaagatgtaaagcctggcatttttgtgtgtgcgatggctcacgcctgtaatcccagcattttgggaggccgaggcgggtggataacgaggtcaggagatcgagaccatcctagctaacacggtgaaacccccccccccccgccccacgtctctactaaaaatacaaaaaaattagccaggtgtggtggcgggcgcctgtagtcccagctactcgggaagctgaggcaggagaatgggtgaacccgggaggcggagcttgcagtgagccgagattgcgccactgcactccagcctgggccacaaagtgagactccctctcaaaaaaaatacacctgtcatttttgccttcaggagcctactctcttaagcacttactatactatactgtcttttcagcttacaatatttgtaaattaattggagccaggtgcttgaaagggaattagtaaaattttgttactgtgttgcgtcattgacaatgctgagtggtttttattgtaaatataaagttaaatataatgctcataaaacataaatacttcttggttgataacttgtgacatcaaaaaaagtacttcagcattcacagagcagatgcatgtaaactaaattaacatgtgagattatgcatacccacttaagtttgaataaccagacatttacaggcttgaatttacctttcagtgctgtggaaagcgacacatttttaagaggttcgaatgcatgcacaaagatagtggcagattctttattcttcagtgtgcaaaaacattcaagttaaccaacacacagctttactcttgggatcttcagtgtattaaaatttgaatgtgaggttttaaaaatgggtttccagctagttaaatgaagtttgacttaaatatttgcacactcctgccttgcttactgcagggcatggtttgaaaagcactcttctatagaaggtggaaaatgtattaggtataaaaataacttcttctgatgtaattttaggaagactcaatgaatgacaggaattagtgttttgcttttcaattgacttagtcttttgtgtaagtatttataaggtgaccaaaagaaagtatctagtaagtatttataaggtcattaaagcaacctatagtattttggggtaaatgttagtgttttggaccaaattctgttttaagaatttactgactaaccactaaccaaattgactttatgatcagattggaaacttgagtttactagattatttgaggggaatgacattatcttggccatctttgtactcccagcactcagcatactgtctaatatagtaattatttgttatcaaatgcacttgaaatgattatttttgtcttgatagatagtttatcatttatttctgatttttttttaatttcctgagttctttaatttgcctaaagtttaagaaaactgatattatgcctaatatttgtgttagagtaactgaatttgtcattttagggtaaaatatttggagtaccttttaatgcactgccccattctgctgtaccagaatatggacacattccaaggtaagcagagtttgaaatgaagaaggccgggtgcagtggcatatgcctgtaaccccagcattttgagaggccgaggtgggcaaatcacttgagtccaggagcttaagaccagcctgggcaacatggtgagaccttgtcgcaaaagatagaaaaattagcttggcggagcacacttgtagtcccagctactcaggggcctggggtgggaggattgcttgagcccaggaggtggaggctgcagtgagccttctagccagggaaatgaagaagaagagagtaagcatttcaaactggttttagagagtttaaaagaaatagttgattaaaacataattgtttcaaaccagcaaatgatttaatctctcataatgttaaaaatatttttttaacttttacatattttaaatttataatttgtactcattcccaggattgaattttaaagtccagtaatgagtaaatgttagaaatcacaaaaaatttttgttctgttaagtcagttttcagttctatgtgaattcttttgccacaactcagattaagtaatatactgacttaccaattcagtaataattttgacttttttttgtttgttaaaaaaatattggccaggcacagtagctcatgcctataatcccagcattttgagggccgaggcaggaggatcgcttgagcccaggattttgagaccagtctgggcaacaaagcaagactccatgtataaaaaaaattttaaagaaaaatcagctgggcaaggtggtgtgcacctgtagtcccagctacctctga

SEQ ID NO: 78548 - DNA, 1323 bp, Homo sapiens
tgttggggtgaggaaaaaaaaacctcgccctgtttttgggtgatgtaggagatgagaaaatcacccatgaagagatagtagataaaagaaggtggccttggacagagccctgggttgttccagcatgtagaggtttcacataagaggagtgagaaaaggaatttgagaaggagcaggcagggagatagcaggaaaactaaaagagtagtgaaaaagtatttttgagatgaacagggaagggatcaggtgtgtcaaatggtgatagatcgagcaatacgaggacaacacactgaccatggatttggcaaggcagaggctgttagtgagcttgaagagagctatttctttggagtaatgaggtatgagaatgattggataggggtgagtagagactgagatatgaagaagtagaggcagaaaaaaaagacaagtcttacgctctgaagggaagcagaaatgaagtaggattgagaaagataaaatttagtgtgcacattggagttgttagaagtaaaaagatgggccttggagaagaatttgggaagccagtagacaactaaaagtaacatttcatctcaaagactacagagatttgtggctttagagcctctgaaaggtacgtagtgcttggcctgctcatgtatgttagcagaggaataggatgtgatatgtatgtctagccacctgaaaaaatctctctttcagctttcttgtcgatgcttgcacatctttagaagaccatattcataccgaagggctttttcggaaatcaggatctgtgattcgcctaaaagcactaaaggtgagcatattgttgaactattaatttttcatttgagccattttctgatttggtttttaaaactgaaatatttagaactattaatatgaatagttgacagaaattgaatttgcatttttttcatggcagaagattttttttttccaaaagaaatggtatattatttctatcatgctttaaaaatttaatagggtacttttaaattcatggtccttatttctatcaagtattatgtaaaatgaaaaaaatgtgttaagttatattgttgttagccttctagaaggagtgatagagctgagtgtggtggcacatgcttgtagtcccagctacttgggaggctaaggcaggaagattgcttgagcctgggagtttgaagccagcccaggccacatagtctgtgccacatttctataaaaataaaaataaattcaaaaatcattaaaaataaagtagtgacatatattaaaataagagttaagagaaatttattaaagaaaagtgtaattagagtataacaaaag

SEQ ID NO: 78549 - DNA, 1050 bp, Homo sapiens
aaagcctttgtttactgggtttttaaaatatttctgttttgcttttcaaaatttccctctccctgctgtcagtgagcctgcttattctagacatacttgctgccttctgatacttccaactttttatgtgtaggtctgaaaatcagataaagatgttcaatttgtgtggaaaagcaaagtatgaactctaagattagcatggtttttagaatacatatttaaatatagagaggctatatatttctggttctttcttgtgttcaagccaatcatgtagatgaagggtaactattttgacttgtgtatgactgataataaggtcttcaaaatgtactacatacgttattttaactcttctgtattttcacgtttggctccatctaataaagcgtttattcacttaagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattggtaagatgtagttgcattattaacagaatttgtttaaatgaggaaaatctctgtttctttcaaaggaactatgaaggcaactgttagaaagttggtatattactgacctcacccccaccctacagtaccggcccctcctgcaaagaaaaaaagaaaagaaattggtatattagtatctaaacatttttggggaagagtggaggaaggataataattgtcttacttgtgaacattttcatttagggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggaggtaagtggcggtcccattttatggaggtacagtgatttgctttaatcgaaagtacatttcacataaagaagcatgaactgtggtatgtgcc

SEQ ID NO: 78550 - DNA, 1903 bp, Homo sapiens
ctctactgatcttttaaatacttttattcgtgcctccatttccatggttcttgcctcagttcagaccttcatcttttgccttaacatgtaatgatttctttttccctacccttactgtacattatatgtatttgtattacatttctttctgtattgtgtcttttttattttagggatatggaagtataagtggggaatggaataaaaatatatcctttagtatttttcctattttgaaataattcctcttaaataacttaaaatttataagccgatgtaaagttacatgttgaaagaagactgcaaatattaatatgaattattggtgaaagacaagtaaatgtgaagttgtaattgcttatgccttgcatttcagattttgttagtggagcactaaataaatttaaacctaacagaacaccttctattacacctcaagaagaaagaattggtaggtatttattatatgcatttatttaaattaaaatttgtatagtattctataaaatacaattacaataataattacctaacttagtaatcaaatttagtttaatcaaatcaaatattatttttaatagtcatactgtactatacacactatgttgtgacattgctaattacataggctataatgaacccaaaattgtaggcaaaaatttttttagtctcctgtctttaatcttcttaatcatgcttttctgtttgtaatttagatgctattaagcgtgtgaaaatagttcaacctcatttttatcttaggactagaagttcattattgtatatttcaattttttattctaatttgcttgtggctgaaattattcagccagtaagagtcaacatgatcttctgttttctagagtgaagaaatgaactggttaatactcacttatgatgaaaagcaaaaataatatttagattagtttttgtttcaactccttgattgtaatttcttccttacattaatattctttaatgtatatcatatgcatcttttagtctgttagatttaagtaactgctgtctcttaagagtcttgcctctgcgacttccttattttcatttaagtaattgcagagtgttttagttaaacaacatctacttaactgatgatgtaaatatattctcattttttgtttagctctaagtaatagctttataagaagaaattatgtaaagcttttatatgttgtcaactctgcagtagaaacaagttggttttgttttgatattttttcagcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcaggtagcaaatagaatttatataaatggattgtaaagattaaaatgagtgcctattctgggcacagtgcaatttcatattaataataccacccttaggaactagaactttattctgttttatccaacctatgaatttttataaaaccccctgccttttaaaatagacactgtttcaatatagtgtgtgtgtgtgtgtgtgtgtgtgtgtgtgtgttatgacaacatctattgaaagttgtgataacccagagtagtagtttgggcttctggtgatagcattgatgcttaggttttatgtgattagacatcctgaatcctgctatagttacatctgggtctatagctgtggctttattgctgtcatttgttgaattgaggttgccagatgtttgatcatgtctgattcccaagtgggagcgttactattgcaggttatggtttgaaaatgagggtatttttaaagttttagactcaagtaccttttgtaaaagct

SEQ ID NO: 78551 - DNA, 1859 bp, Homo sapiens
tttctttgaccctactttctcagccacaattcaacaaattccatttgcaaaattgaaaatagattgatttctaagtttagattataacaaatatgatgcttttaaaaatatataaaggcaacattagtctgtagtccatagagtatctattcataattgtctcttttttttttttttgagacagagttttgctcttgttgcccaggctagagtgcaatggcacaatctcggctcactgcagccaccacctctcaggttcaagcgattttcctgcctcagcctcccaggtagctgggattataggtggccaccaccacacctggctaattttcttttgcatttttagtagagacggggtttcaccacgttggccaggctggtcttgaactcccgacattagctgatcaacctgccttggtcttccaaagtgctgggattacaggtgtgagccaccatgcctggccataattttcttacagatgtgataaatttgcattgttccatatattctgactgtgcctcctgcgaccattgacacattttttatttttattttttgagacggagtctcgctctgtctcccaggctggagtacagtggcatgatcttggctcactacaacatccacctccgatgttcaagtgattcttgtgcctcagcctcctgagtagttgggattacaggcatgcaccaccacacccagctaatttttgtatttttagtagagatgggatttcaccatgttggccaggctggtttgaactcctggcctcaagcaatccgcccacctcagcctcccaaaatactgggattacagacgtgagtcacggtgcctggccggacacatttttaaagtgactagactgcagccctagaataaagctacttatgtcactttagatgtataatattggcttccaaaattttctttagctaaatgcacccaaaagtttctaaggtggttgtattttttccgttttcataattgaaaaaatgtgaatgtctctgggaaactttgtgaattctttattaataactcagatgaattgagagggttcatgtttgttgaatgtgtcctgggcgtgattcaaacataaatgtatatggagcctttgttcataactattttacttctttcgtaattgtttactatagttgatttcataatataaatggtgttaaataattgagcttctgttgtaccagtaattatttgcatggaacacagcagcagccaagggattaggaatgtgttatagaataattagtttttgtttacttgccaaaaatattgaacaaattacattccggagtcaggtgggtagcagttggccagcaggtatatctcaaatactcagattccaacttgtttgccaatagcttattttttataataccattaattggtattatgtactagatactgactaaatattttatatagataacagtaatattcatcatagaagtccgttttcagagcctaaagccatttagtaagtgatggagcaaactcaagcctgtctccaaatcttgttctttttccagtctgcaatggtgcctatccctgccttgtattattaacagagtttaaagaaaagctctaatataaaagtaatgcttaagctgacctttaattggcaagtcaaaagtaaaaaatgaatgctttttcttagctgagttgggttatttgacacttgaagtttctaaccagaaattaagtgatttcggttgttgcttgggatagaaattaaggctttgaatctaattgctgctattactattttatactttaaaaggaaaatagatatgtgtggtatattacatgtggttatttttgtagttcacatcgatacaag

SEQ ID NO: 78552 - DNA, 1111 bp, Homo sapiens
caaatactttattagaattaaatgcttagtgacttatttgccatgtgcttgggtattatttcaaaacaaggttaaatacaaaggattaagcactgaactgctttattttaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaa

SEQ ID NO: 78553 - DNA, 1115 bp, Homo sapiens
aaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgacgttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttcta

SEQ ID NO: 78554 - DNA, 1052 bp, Homo sapiens
ttggaataatgtgcttaacatagcaatttttttttcttctttttgagacagagtctcactctgtcacccaggctggagtgcagtggtgcaatcttggctcactgcaagctctgcctcccgggttcacaccattctcctgcctcagcctcctgagtagctgtttacaggcgcccgccaccacgcccggctaattttttgtatttttagtagagatggggtttcaccgtgttagccaggatggtctccatctgacctcatgatccgcctgcctcggcctcccagagtgctgggatcacaggcgtgagccaccacacccggcctaacatagcaatcttaagtctcccctatcagtatctgtggaagggatgaatactgacttgaattttagttttctattactgtataacaaattaccacaaatttagcagtttcacacagcattcatttattatttgagttttccactgctcaggagtttggtgcggattagtgttcaggtgctgaccagaggtgtcgtcttggctgcagcttgcgtcctcttccaagctcgttaaggctgttggcagaattccatttgaattatattgtaggactgagttccctttctcttgctggctgtcagccaaccaaagcccctctcagctcttagaggccgcctcaggttgtaagccacatgccttctcatagctggaaggagaatatctctttagtcttctaattataatgtaatatgatcctgggagtgactatcccatgacctttttcggataacaagggactgatatctcattatattcccagcaggtgggaatcttgggagtcttcctagaattgtatactatagctaggatgaaaactaacaaagaaaatagtccaaagatacttggggcaaaaacaacaaaataaaaagcctgggtttttcccagtctgggaccttggcattgaatttgttgggtggtctgatcatttattcatgtgagttagttattgtttcacctcatccatttatttgcattatctttgctcacactccctgatgctaattccctctg

SEQ ID NO: 78555 - DNA, 1054 bp, Homo sapiens
gaggctgaggcaggagaatcgcttgaaccctaaaggcagagattgcagtgagccaagatcgcccattgcactccagcgtgggcaacaagagcgaaactctgtctcagaaaaataaaataaaataaaatacgttcttttttataacactgactgttggacttcaaatttttcacttagaaatagagacccaaggttattttcttaataaatatcaagtggagaaagagtcctgtggatgataggctacttgaagaggcagatcctaggagcctctactctgccaagctttggccttggtaaaggagctgcagtgcctccgctttgccacagggtggcaacagttgcttcccatttgaggatggcggggtgaagcaaaccttgaactgtaggggacactccgtttctggctagtctctctctgcagttggagaaagcagtgcagctgactcttatgtgtcttgactaaaatctgtttctaggttatcctcaccctggaggaaccaatgagaacattgggcttgtaggccatctatgaatggactgggaccgcccaatgggcccatgcctttggggttgcattttgtccaccttgaacttcaatccttaaagtctctggatgattttcagtttttctctgttgagcaattgcatggatagtaatgagaaattcaaaagaaacggggaggttctttttgggaggggaaaaggataggaaagatgaacacgatgacatgtttgtgtatgtttacagtgtcctgggtatccagaaggcacttagatgtatatggcacaggagagaagtctgggagaaggaagggtttcagagtcatccccgtgttagtggtggctgatactgtaggggtggatggggtcaccctgggtgggtattgagaacaacagggcacctaagacaaaggccaggtagatgaagaagaatccacaaaggaaactgggataaatcggccagaaaggagaagaaccagaaagatagagtgtaatgaaaacaaggaaatagtgttctgagaaggggcagtggttaccactgtcaggatca

SEQ ID NO: 78556 - DNA, 1185 bp, Homo sapiens
ggcatgactacatcgagtcattctacttcttctccccttactaaaagcaggttttagttatgtaaccatgtttagagcggtctagggagtttttatccttatgccttcctcctgattggacaatggtttgcaagaacttgttaggagctgtggaaacacaaatattgggcaaaaaacttgtgtttctatataaatatttacaaacatactagactataaattctttgaggtgagggcctgtgtttatcctatccacgatggttataccctcagcatttggttcagctgacaatcttagtgggaatgtgctcaacattctcaatccacaactatttattgaatctgagtgctgtgttagacaatctatattctatgtgcttcatgtaatcaaagtgacctagacaaaatccctgcccttatgaaccttacattctagtggcaggaaatactataatgccagggagaagggagagagaaatgagaatgaagaaaaatgatgcagtgatgcatagccctctctatctctttgggatacagagagggggcgtgtgttgtggggaggaggtgggggctctattataaaaaatatggcctgagaaactgcatgaggaagagtcatcatgatttgatacatggagatagagaaaaccacagtgtcagggctccaaaaaaaaaaaatcacttccattttgggaggtaatttcagcttctttgtatttgatttggggcagtatataagtcttgggaaaaaaagaagtgactaaagcttttattttagatgaggaggacttaatgaatttgtaaaatatgctcccttttgtggggagaagtacagcagtttgcacgttgggagaacagctggctccaatacagcttggtggtgggcttcgactgaactggtcatcgcctaagtattttgtgtatttctgattacctatctctccaggagcccacgtgagcaagacaggtcttcaagctggttcaatgctcccattctgtaggcaactacaaactgtggctcactgcatgacttaacaacaactgattgagaattgtaaagtgcagcctcgagttcatgtgtagaaactgccatctgcacaaacaaaacattgagaggactaagattttaaggatactaatgcagacgtccttcttgcttcatttatttaaaaatatctatttcac

SEQ ID NO: 78557 - DNA, 3810 bp, Homo sapiens
gttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacctcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaacggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttctgtgtgtgtgagcgtgcgtttgtgtttggtagtgttcctagggcagaggtggagcagggatgcacttatcatgggaagggaggtagaaaagagaattggatagcctgtgatctttggtggaatttattccttttgcctaggcctttcagaccctgcttgatttccgtaggacacttcaggttgtggcaagggagagctggtctgcaatcggaagtaccagcctcttccctagagcacaact

SEQ ID NO: 78558 - DNA, 1071 bp, Homo sapiens
ctctccatgtatagtgtgagctgccaatgcattatcttaatacatcaagaaggaaatcagatttcaggcacacattagcaattgtttgttaatgtccttggcaaacgtgtacctgctttccttcattgttctcttcaggggctttcttccactttcctcttatgaaacgaatgtgtttttgactgttaactgggttcgctttccagatctgtctttcccaaatgaaaggttagtcccatagaccactggctattcagggaaattactctctacctccccatgacatggatgataagtgttgagggatgaacactctggaaactcttagcatggattttgaattccagatttctttataggagatgtataaaaaggagtttatagcatacaaaaattatactgctcttcccagtaagggactaaaaggacatttgaaatctttacattttagatgtttttgtgaattataaatatctcctttttcctcgcttcatgctaacttgtctctagataaaatcttatttcttcatacattggaccacaaggcataaagaaggtagctcagcgccactgagattgtgttctgcataatatttggaaggcttccatttccattgaaaacaaatccatgagtgagagggaaagtctagtatcaattcttctgtttgctcgcaatgacacaaataggttttggggatctacctaagggataggtctactccaaaattattaaatttataattgtgcaattctgtaatttcccaaggcataagtaatatgaccctactgtcagctagatgtcttatcttcaaagagagtatgcattaataaaaagaacttccctttaaagaaccaatctaaaatactaaaaaggcagaaacttttaaaattagaaattggataatttttaagaatctttagagaaaacattggtttatcatagtctttttctttcattgagttttcatttagactagcatggcaagcagggtggccttggactttgatttaggggatcgtgctttggcctggaaaataagcactggcctgcatgcctagaacctgagtgaa

SEQ ID NO: 78559 - DNA, 1028 bp, Homo sapiens
attacttcagtggatggatggtcctcttactgttttccattccagagttttgcacttccaatgtgatgaccgtagtccctacatgacagtgacaggcaccgttctagcttgcatggagccagccacctctgcagagtggtacagaaaatggttttatttccaaaatctctccccttcatctctcccattgtggtacaacccattttgtaccaaaaacagtttgaccactaatatcaagaattctacaaaggtttttcctttttacctataatttcatttcttgtatcttttatctttgtatcttgtatctttaggtcatttcctaaagaaatgaccctcaacctagaataagtttgtatggacacagatgtggctcaagcctgactccccatgagaataaggtagaaaggatttcactatccaactacaggagaattaagtgagctatggcatgcctacctgatgaaattttatatggctgttaaacatgcttgtggagtttgtgaaataacaggagaatgtgtgcatgatatgttaatagaaagaatcaaaatacaaaaaaattctttatcaaatataagtaaggcaacccccataaaatgatggaggggcaaggagcgcgataccgaggcccagaccctgaaagagaaagtatgcaagtcttagatggtgactgtgttttggtcatggtgtcatgaccgatttgttttttctgctgttttaaaaatgtttttcaaatgtctttgtgtgtatatgttaccttcctaatactttttagaagttagtcgctgctctcctcccgaagatgagttcccttccccttcagaggcccggtacctccatgcctgggctgcctgcctaggacccctgccacacagtccacctcgatgccagagcttgcagtatgtgcctttttcttccatgttaacacaactttcctacctattgtttttgaaatcccctacctcctaaaccaatcttagaaatacatttctactaaagcattaaattattcttgacaatgtttt

SEQ ID NO: 78560 - DNA, 1063 bp, Homo sapiens
atccagcaccttctgattcacacccattggtatgccccaaagatgacttgtctaattgctagcatgtgtaaatcaaatggggacttcaaatgtaagtactttcatgtgttcccctcttccatttttcatgggagtggagtgtccaagatcaggacgacctgacaattttctctttgattcatgaggcaaaatagaacctggcccatgccatagccgacctcattgccaataagtccaaaaagagattgtgaaagacaagaaagcacttcaaagtcacaagtccaaatttaggaatagcagaggagcattgctatgattcttactcagacatccaataaaaaagcttttttttttctcattgatgctttggaatttcaactgaaagtgacaattgggaagtataatgtacttttgtttaccatatctcttaggaagctggaacagaaaagagtgttttccccttgccggaaccacaggatttctttctggcctcccaagtcaagtttgaagacctcataaaagatttgagaaaactgaagaggcaactagaaggtaataggaactgttctgctattatgataatagctaagattacttttaaaaaatgttttaagaggattatttaggtctggttcatagagtgggattggtgcagagttcagcaatggtacactacagctttcaggaaactttccttctctacacagtgtgtagaggcactgtattttcaaattcttctcttttattagtgttgatcatttgtttcttatatccatatctcgttatatctacattttctaacatttagtagttataacattattaatgataatagcagtaaccatttactagatgcttactgttgtctcatataacaatcttaataagctggaactacactaaacccattttacagatgagaaaaatgaggcttagagaagttaagttcacacagccagtaatagacagatttactgagctctaatcaagtctaatcaagtctgtctaattagaactcacattttctagtttctagtttctagaacttacacattagctagtt

SEQ ID NO: 78561 - DNA, 1090 bp, Homo sapiens
tctttcggtatagaaagaagtaggcttcagctttgttcctatgtaaaaccatttttggtgagagatggcaaaattccttggtaatgacgttatgagttgaccaagactttcagaaatatcagttaatcatcatctcaacaccaaaatgaaataaatggctgttagtagattttctccttttctgaattcatgtccaactgtttccacccattttcatttataccccttcctctggtggttggcctggagagtatgtcgctctttccaacttagttttgcaaagggaacaagtgcccaaccactcagacagtgagctactgtgtgtaggtcagtactcacctttagcttttaagatctgtcttgccacatttttaaggaaactttaggttgtctacttaatgagtgcctgctttgttctaaatactgagttgtaaactatgtctatgtgtgtaagttaatgtgaaaaagtaaacaaatatctggagaatgtgatcattatagaccattatgtaactcactgagcaaaaatagtagcaatatcactttagtaagagatttttttttaaatcacttgtctgtagacatttgcctcaagtcttcagtttgcttagcctgtataaatacacctttagagaatgctgcattatgagggagtttattgcataatttttctcgtgtgttaaagactggggctttccatttgggtttagtctcttgtttgggcagcaggagatagataacttgtttagtatacttgtgttaactttctgttcccgaaggaatttctataccatgcatttattcatcatgctagaactcctttaaaaaacagccctgttgtcaacaatggaaaccatgcccttggaattccttgagtctacctatgtgacaccttttataattgttgagattgttaggtaaggaatgttcccaaagtgggtctttttcagctgtctttttattttccttgtgattatatgtgaaggtagatgacacattttcttttttacagatttttacatgagttagcccagattcctaattttgctgaacgtgcccagtgcataatcttcagatctgtcttttctga

SEQ ID NO: 78562 - DNA, 1135 bp, Homo sapiens
ggattatagtaggctctgattttttttttttagtcaaatgaggatttaatatatgtagcagtagcaatgtattttgaaagtcaacaggactgtacacatataaggtttttgatttgggttttaagtggacataaccagcagaattgtcaggctctcttgagaagacaacacaggagagtcagaattcccatgattgttcattgttttggttcactgactgttaggctacaaaaacatagattgaaccacattctcttaagtaatggtatttcccaggaagctgtctagggctctatagtgtactgtggtcaccagttcaaaagatgattcgtttcatatttatgtcccctgggaccttaagtttcttacagaagatttccatagtctaatagtctaggcttggtggcatcaccaattccttgctcattttcacatctttatatgtatcaggagctacttagtacaagtgggtcggaacttctcacgtttccactagtaaagctttcgttaataaaccagaaagtacacaaataccaggccattgggagctaattatgcacttgaatacttggaggtcagcaaggtatagaggcagaaagagggagttccaagtctgaagctctttaacagttgcttagtacaagcctcagtggaataatctgtaaaatgaggatacagtggttcatgttaaagaactttgtcaaaggcagtaccttccagatgctttgtgttgttaccatgagctcaggactaagcacatggttgccgcttgttagctcacagtagagataagcttcattcaactgaaatagttggataaattgagaaagtaagtgactcaatgccaaaataagtggtacagacaatgagtgcttacgaaatttggaaaaagggacgttgttgactagaaatgaaagagctgcgagttcatataatttagggctgttctaagagtaaggaaacaaattctaagaacaatattcccccagcctccttacagaggaagagatgggggattcaaaagtagagctcaaatagctgtacttctgtgtccagctgcgtgtacttgttaggtccatttgcattgaatctcaaacttgagcatgcatcagaatcacccagtgggcttgcatcc

SEQ ID NO: 78563 - DNA, 1140 bp, Homo sapiens
gcttgtatttgttggttcagtttatgagcggtgtgcctgtgtgcacacacatgcgtggaagagacagagacagaaagtgagtgttttcaaagtataaaatggagggagcgatctgatcttgggtgacgccgaaaatagtttagttgaagactgacttctttccacattgtgatcattatgattacaaattagttaactaattaattgggcttatgtaatggctaataagtttaatggtaagtgcttgcaagaatgacttaatcggagagcattcattgattctctaatacgttgttccagtattttgagaatagaattatcaggtgtggattctggctctctaggaacctaaactatatttggtgactaagacatgggattatgtacatgtaaggcagttctcttaggcatcctaggacttggtaggcctttttatttttcagacttctggctgataccctaaccttcccaggccaatattattagaaataatacaactaatttaatctccataagttctaggctcagtatcaatctcttgatattgcttctgctacctctgaattttcttttactttttagattttatttttaagatccttccgtggaagaggagaaacttcagtggaatacttggcattggccctaagttcatctgtttatctacttcttttacctgtcctttcctctctactccattcctttcccagtccctgggggacagatcagtagtcatgctcacctcttagactcctctgcctgtttctggggggatggtacaaagctcttcccctaaacctaggctcaaagcctcagagtggtttcaggctaagtccccagagctagttagcaatgtcactataatagtgctctgtagtgtctttcttttttgccctatcctttctgtccacactattcaagtttttgctacctcttgcccattacaatagattctaaattagtcttttcaaattttgactttttgtgtgtgtaatataattttgtccaatttactcctccattcataactgctcaacagctctctcctgtataacaagtgtattacaggttcatcgtggcattcaaaattctacaaggttttaccccaaactatgtttggagtgtatctttctagtccct

SEQ ID NO: 78564 - DNA, 1095 bp, Homo sapiens
agtcaagtaatcctatcaaactttgctttcctgggctggaccagactatatctagtccatttgcaaaacattattacatacccgctttgtgcaagaggcttacatcagtcacttaaggaaataaaaagaagaataaaacaggctacgtacaaatcattctcaaaaccaccgtcagccgaaacctggtgagccaacccaaccctacctacctgtggcatctcccacacttcggatgaccagatttactttggctaatcttaacagactatacaaggtatgcctttctcaccaccgtgtcccatgcttcttgctcagaggtgctccctcagtcaaagagaacaactcccttaaataactctgcctgtctttttactcattagaagcccttcgaacagcaagtgcattctttgtttatatgggcatggtacacttggagagagaagtgttcagggttgaaaaatggctggagagctgagagaatcctgcatgttctttctacttaaccctggtcttgtgaaaagccatctcttacccggagggggaattttccctgttgtatgagaccctgaccccttgcatgtgccctaaagcaggcacatagtttttatgtgtgcctgttagtttgaatttgtgatactgatctgctttttgtccctgctgacggttattatatcttaatgggcgaaacactactctaatgatccttgtgtatataattcttgtggtacagagcaggcaccagaggaccacataaaaatgtttgcctcaatttccctgcaaaaaagaagcccagaaaccagacttgaccaagtaacagatttttaaaggtaaaggaatctaataaaattaccagcttttcacagcgtgtgtctacttccttttgacatattgtgaggtgtaggtgaaatattctaaccgaactgacagtgtgagtgggacaactaaggagggaaggagataaaagtaaaaaccaccagcagtgattgatattgcagtagcaatgagctgttggggtctcccctttgtggacttgacacttcacctttctgacaccatctgcaggagtgttagtataatgagacctatacagatgga

SEQ ID NO: 78565 - DNA, 1112 bp, Homo sapiens
tctaaggccccttcgtacagttttctcatctgtaaagaaagagtaatattaatgtctgcttcaaaggtggttgtgaaaattaaaatgtagtatgtgaaatgtttggcctggggcttggcacatcaatggtgctttcactatgctattaccaccatcattgccaccatgagaactgggaataagaataatgaaacatcctccagtgtcatcccaaaggaaagcaagaggttgaattttaaccagaagcctcatctctcattcacttatggttcctggaccccaggggctgctagttacaatccatttcccctatttgtgtgtgcgtggatgtgtgtgtgtgtgtgtgtgtgtgtgtgtgtgtcccactggggcgcagctatgcagttaaagcaaatgaattttagccagattctcagagatgaattccttcagtgtgtaccaagaaaaaaccacccaatgcaaggaaaagtttaaaatgtatctccattttctagttctatttgtattttgctttcatggtaacctgtgtttgtgatacaattttaagaatgccagctattggcaggtaacataatatcacctttttaaatctttggagagcatgatagtctataaataaataaacatatgtagaatgaccgattttggtaatgtgaggctcttaaaatatgaagttattttaggttggtttctttattaacaaatagactgcattaactttcatacagtacttgattaaattttatcaacataatgcatgaatagaatttaaaaagtcaagcaatattaagactttaaaaaaaaaagcaaaagttctccaaatctcaataaaatttcaaggaatttttcatacagatcacatctgctgatcaaaatgaaattaagttaggaatcgtgtcaataacaaaaagataactaacagtattgaaaactacattttttaaacttttaagtccaggggtacacgtgcaggtttttacatagataaagttgtgtcatgggggtttgttgcatagattatttcgtcacccaggtattaagcctagtacccattggttatttttcctgatactcaacctcctcccaccctccaccttctaataggccccagt

SEQ ID NO: 78566 - DNA, 1039 bp, Homo sapiens
tagtaagttccagacaaatccgggcaaaaaaaggtcagctgatttacatagaatgtattcccatgcaattagattcatatgagatggaggtaagcctgctttgtagccaggctggctttttaaatgccatctatagaagcagaagacttgtttctacctgaatggcaaaaggaaaatctgtatattccaaagccaacttcagtttgcctctttcaggaaggcttgcctgaactcaccagaatctcctctgaatgctttcttatgcaggatcgtattaaatttacttttgttctttattgcttcttagattgctattactctttttgtttctctccagatgcttgaaaacatgttgtttactcatagaactattcacttctgttttggtgaatgaatatttgtttttaaacatcaaagcatttggtcatttattatttcttttcttataatagtttgcctgttcaacaaaggagtttaaggcagttagtacttgataacatttattttgtttctctgtctgagggggaaaataacacttcatttaaactctttaagttttctgaacagggtggttgccattgccccatggaatccgtgcacttgtgtagtgcttgcttttctctgtaagtggaggcaaaaaattgggtctactgagctttgtggtaatatgcagcttagagttttcagtgagctttgtgtcctaccttagagctgaggttttaagttttaaagaaaatagcaagctgaattgatgccagaaaactccaaacctgcctcctataatctttgctccatgcctgtggccagatttccaacatcaagatggatcccttggtctcttctgagagtcagatgtttgttttctttcctcttgaaaatgaaagtggttttagaggtggtgagcagctgaggagtttcagcattgaaggccaactccttcagctggatcatggaatggttcccatatgagaagaccaggaggatacttgccagataggtctttttataatgactgaacaagagaaagtgctgggtacat

SEQ ID NO: 78567 - DNA, 1016 bp, Homo sapiens
cctgtcacagtctcaaattggttatcttctcagcctttatatgatgcccatttttacacatcatggaaatgccacaggctgagggaggagcagcttgggtgcccccaggaatccgaatcccaggatttctagtcctaaggagtttctgtagagctctatctttgatcgtagctaatgacaattacttttttggaaatacgtctgtgtgtgttttaatgttctatagtatattttgactttaacaaatgcgtaacataaaaagcttttctccaagcattattagagttttatgtgtttttttagaaaaatgaaattaaaaaatggattagagaaagatttcattgtattacattccttcctgttttggttcttatggttaacttgtcattttctcttttaagccaaaatgctacaccaaccttatgggactccttagaagaacctgacattcgggaccccagtgaatttgagtatttattctccaaagacacaactcaacagaagaaaaaacctctgtcagagacttatgagaagaaaaacaaggtcaaaaaggtactgagtgattatggcaaagctgtaattatatattatacagggaaatggtatatatgtgtgtgtgtgtgtgtgtgtgtgtgtgtgtgtatcgtatatacacacacacacatacctatacatatatgtgtgtgtatcataggaatttattacatattctgtgtgtgtgtgtgtgtgtgtgtgattcataggaattcattacatgctgttggtgctttccctggtttcatgaaatgtttcagaaggttttgagtggcagatggcaaagggagccaatagttcatgaaatctgtgcctgctattttggccatatcttctgaattttcaaaatttaatctggactttttcagccattaattctgttgaaataaaaataaaatttaatttgtagttagtgaaagtagtctacaggttatatggaaaataggttttatttataaattcattcatttaacaagtatttc

SEQ ID NO: 78568 - DNA, 1010 bp, Homo sapiens
aagagacattctggaagactgggagaacagctctaagccagaggagctctaaacctatttttttctttatagttttcttttttgaaaccaacccgaaaagttgtaaaacagatagatattcaagcatgtccaaaactttattaaaagttttgtgtttgatatgcaaattgggtaagagttcttaagtaatagatgtactttaagccttaatccatgaaaattatctcccgtgagctcaggctggttgaaattgtgctttgactcctgcctgtttaggtccctggaaaattcagagtgcaatttacacctttatggattcttaaaagaatgtctctgtatttccctgcatttatgtgggccatgctacagtggcaccatgatggtattattgagtttctaaattcttaagtttgttcttaataaactcattactttctttccctctgaattttcctataggcacagtttgaacttcgggcatttcatatccggggcgagcatgcaatgataacagcgagactagaagaaaccattgaaaatctgaaacacgagctagaacacagatggcgagggggttgtgaagagaggaaagatgtgtgcatttccaccgatgatgactgccctccaaagaccttcagaaatgtgtgcgtccagacagacagagagaccttcctcaagccctgtgaaagtgaaagcaagacaaccagaagtaatcaattagtacccaaaaagctgaatatctcctctttaagccagctctcacccccaaatgaccacaaagacatccatgcagcactccagccaatggagggcatggcatcaaatcagcagaaggcattgcctccgcctcccgcatccatccctccccctccgcccctcccctcaggacttggatctttgtctcccgcacctccaatgccacctgtgagtgctgggccaccgctaccacctccgcctcctccaccgccacctctacctccaccttcaagtgctggacctccaccaccccc

SEQ ID NO: 78569 - DNA, 1021 bp, Homo sapiens
gtgtaattccacatgcatcttgatgttccaagtatcattaaacatctagtaatcagaacaaatgttctgccaaattccgtttattattttaactggttaaggcattgagcactctagatttatacatgtataattaaaatttctattaaaaaataaacctagatgggagatttacatttttcttaatctatgtttacacaaagaagagatctgtttttaaatattacatcagatctttgtgaattcaaataaatcagtgtgacactttgccaaaactatttgtaaaaatgatgggtattgatgccctgtggtcagggaatcttctctgtggggttttagaatttgcttgttactcaaaaatacccttattccggttctcactgttgttttcaagcatataagcttagcctcaacggatacactttatcatttgtacactgtcagcccttatatgtcctcaattgcaagtattccacatgaaacaagtgcagctccagaaacttctgcctcttcctggatagatccataactggatatttttggtaagcttaattgcctgtatacaggaactcaaaaagagccttgccaccacaaagaataaatctataacccctattatcgtgggtgctgtttcaaggctctttttgttgctcagcgtattttcatgacccctcttcccatcatcttgttgtctctcagtgaaaaataactcctaacatttggatgcacatggacgaaaacacctgcattggccccttaatgttattgaagtgggaatatatttagaactataaaaattcttaccaattaaaatgtgatgtgcattcacagttatggcaatattaatatctttattttgacccatttgagatcaattgatcgactgtcatctgggccctgtccatattgtaagataagtcagttgggaggggcactaaacaaaacaaacttccatgtctgtgtggagatagacctgtcaatttggacttaagagtgccagatttgttgaaaagaatgtagt

SEQ ID NO: 78570 - DNA, 1055 bp, Homo sapiens
gacagattgttgtatctgtttttaactaatgttctttgggttgtgggatgcaagacaaagaaccagccaatagtgacatttcctttacgggaatctttttcgtttaccccatttatcacatgcatatttcctaattgaggggaaacttcactgagcgatggcctctggcaggccccctgctcattgtgcaatgcagtcacatttctagtttggtaactcccactgcaaaatgatccagggatcaatgccaaactgaaaattaacttacattgtacctttttgtccccaagagaatgaaatggtatgctggcctccattaagacttgtagacttcctcattttactgtggccaacacattccactcatccatttctaatagtttacacattgctgttgaaacagaattgagtgcagactctatttgagctgatacaacgaaatttataaaggcataaatcccaagcctgttccatttttttgtattcttcattatcaacacaatacatttaaatctcttaattcccagataatactgtgagggaaagggaataatttgtaggccaataaacaaaactttcacaagtatgaaatgtgatgatttcataaaacccttatggtattcccctaagtgctgatattagtgtaattcattactgagatgccaaaaaggaaaaaatagacaatattgagaaatatgttaattcatcattttagtgtgactgtgaaatgttgtgaggttactagatttactggtttactagtgttgagattcctcttgggcgactggctacctagaatccggtaggtacatttggacttgaattttcatggaaaaggagccctttgtctcagccttcaagatactgtcttgccttcagacaattcagatatagaaggaggctgttgtagaatgttgattgctcatttgtatcatgggggccaatgatggttttagacatttccttcatgcaccatcagccttcaatcatttctgctgagtcttaacccctgaacatgagtcaatacaggtggaccaagacagttttctttttat

SEQ ID NO: 78571 - DNA, 1005 bp, Homo sapiens
gacctaccttactttcccaccaggcatgtactttttgggagaaaattgtttaatacatgcctgggttaaaaaattttcttcttttaaagcacaattacatggttacttgaatttgcggaacacaacaacgttttacggagtagaaacacaaaattggaatatgacaagaataaataagacttagcttattcactttttttggtgactataggtcagagttttcaatcttttaggtttcacctaagaacattgcacttaattccgtggacaagggataatttgtttcactgtgtagttaactgtaaaagttcccaggccctttcctgcacttccagagtagtattctttatttgtctgttctttgtctattggcctgactgtattgtgctccttgaaagtagagatcgtgtcctcttcatattgtttgcttgcagtacacttttggtaaatgaataaatgaattaattggtaacacaatgagagagacctaattaagttctagatttttcttattgtggctctaagtctactgctttctttttgttttcaaattcctaaaattcaaacaaacagaaaaacaaaaatttggccgggtgtggtggctcacgcctataatcctagcactttgggaggctgaggcaggcggatcacttgaggggtcaggagattgagaccatcctggccaacatggtgaaatcttgtctctactaaacatacaaaaagaagctgggcatggtggctgacacctgtaatcccagctactcaggaggctgaggcacgagaatcagttgaacccgggaggtggaggttgcagtgagccaagattgcgccactgcactctaccctggcgacagagcaagactatctaaaaaacaaaacaaacaaaacaaaaccaacttgtcaactatgtactttactgggaaatggtgtaatagacaaatgatttctacctttgtatcatatagaactacatgtaatactggaaatgagggaatgagtttctcc

SEQ ID NO: 78572 - DNA, 1091 bp, Homo sapiens
acacttggtatatctgccacattgtactaataaaaggaaaaatgtaaaggagctttgttggatgagtcctgctacagtgagtctcccggtgctgcaaacagtggacgataaggcatcctcattcagaatgagaaggaagctctttcccgacactgatgcagcctgcacctaacctttccagagcaggctcttctcgctcactgccctgtactttactgagggatcagatagctcaggggtatctcctgtttctgttctaggattccagtcagatcgagctgctgaaggaactcttggatctccttcaggacatggtggtgatgcttctgtccctcctggaaggttgggctgtttggtataactaggccttcacacaactgtaattggtctgagcactaaccttactgatcatgcagattatccttctggcaggtcactgatgccatatgacattggtcagaaagccaaattttcagaaacgaaaaataaaatgaggggcacctggtctgacggacgaagcctgaaatcaattgattttctatcaataggaaagccagaatgaactggggaaaacctccaagctttgctcttccctatcctctccctctccccattgcttttcaacacatctggctgccagtgtgtatgccagccatctagttgggcaccctcctaggtctaaggggatcaaagggacaccatgtatccctatgtgtccctgataatctaataatgaaaccacttcccaggccccaggccatgttaaaggcagtggtgtggccacctccttcttccctttgtttctttcccccttggctcctagtggtgtagtctttatggcttgctgctccctcctacatcatcacggtcagagaagagctgactaatttggcacaaaagtcttctaaaaatagctacctgacaagtgacatgatagcttgggtttatttgtatatttgtatgtctttttgaacctgcctcacagggaatgtggtaaatggcaccattggcaagcagatggttgacacactggtagaatcatctaccaatgtagaaatgatcttgaaattctttgacatgttcttgaaact

SEQ ID NO: 78573 - DNA, 1021 bp, Homo sapiens
ccccctttatgaagtgtactagttcagtggtgatacctggctccatcacctctgccctctcagcctccatagtgtcatcatggataccaaattgggttgggtcaggcatgtcacccaggatcttggtcactctgatgttctttgccccttctaccaggccccctccaaacactgtgctccagaggatctgaaagattcctcccaggatggtgaagagcaactggaatagccccacgaacagcatccagaaaaaggagaagagcaccttcaccagctccttcgcagtcatctttttcacgttcctgtactgcttcctgaggttcttcagggttgctctcttcaggaagtcggtgacattcctcttcacagaggcacaggccatagcaaatgcagaggccggctcaagagacccgtcttcttcctcttcacccgcaatttctaacacgtaagaagaatcttcatcttcttcctcctcttctggcctgtcagctgaatcggattcagagatctgagatgctaactgcatttcaaagatggtgtcctcacagaagttcacaaacagctccatcttttcctgctccccaccttcattgacaacatcaaaaatgaactgtcgcttagattccttcacctggggcttctcccactgagtgcgactggattcactgatctcaaaataaacacgctcaatcttcttggccccacccatgatctcgatgcgtcctaggtagggttcgaagtaatttagcacactttctgctgggtccaacagacacttcaggcgggaatcgtttggcatgtgttcagaaagatttgtcaataacacagccacattaaaccctatgtccttggctggctcatggaaccggtctacaaaatcaacgtaattaaacatgtcattctcatcagcttctgcacacgacaggagaaagtcaatctctgactgcgtgtactgtttttgcccttccatggccttctggaattcttttttggagataattcctttaccatctgggtcata

SEQ ID NO: 78574 - DNA, 1009 bp, Homo sapiens
caacagtactcatttttatgtatgagaagatagaggactgggagtttaagtggcagagctgtgagttcaacccaggcagcttggctccagaatttgcactttcatagttgcaatagagtccttagtgtagcccagggcataaggtctctgcagcacagtagctggacttcctacatgacacaatagttcactgagggaagaaaggaccacaatataggaaagtatttcctggactcttcctgggaagaagatggcttgctgtacttaaggagacttcctactcaagagaaggaagaaaaaaatgtaatgagaaaagcagtgagaaaaacacaattatgatgtagcagaactagatctggacttgggacaccaaaaattgaatgacagaagattgacataactgtagtggttgtgaatatggccccaaggaaccacgcctcctggaattcatgcctttgtgtagtgcctctcccctctaccatgcagcagtgcatctgggatggccatgtgacttgccttaaaccacagaatgcaatggaaatgacactgtaccagttctgggcctaagacctaggaaggcttagcagcttccacctccatgctctttttggaaacccaagccatcatgcaagaagtctagctaccctaccggacagatcatgtggaaaggccacgtggagaaggagatgctctgaatctccctggagagaaagagggagacagagagaggcccagctaccccagctgagcccatccttccagttgtccccctgtggagctgccaggcatgggaatgtgccatcttggccattccagcccagctgagctcgcagatggctgcaaatgtagcgcctttacatagaacagaggaactgcccaaatgtgccagtcatctcacagaatcacagagataaatagttgtcattttagaccactgagttttagagtggtttgttatgcagcaatggataactgaaaactaacacatcagtaagctttcttctgagat

SEQ ID NO: 78575 - DNA, 1072 bp, Homo sapiens
aataacaagttacttgaacctattgggtgctagggacttcctataaaacttaaaacagaatgtatagagtgtatagattttattacctgataactcagaccctgtaactgttcatttacaagaaaaaaaataaaatgctgggctctgctccccagcctagctcttcccccttctctctctattttgtagcttagagagtcctcatctttcgagatagatagggtctcaaccccgttgcccaggctcgagtgcagtggtatgatcttggctcactgcaacctccacctcccaggctcaagacatccgcctcagcctcctgagtagctgggacaggtgtaccactaatttagcaccagctaatttttttttttggtagagaaggggctttgctgtattgcccaggctgatctcgaactcctgagctcaagctatccacccaccttggcctcccagagtgctgggattacgggtgtgagccactgggctgagccctcatctttctttaggctagagcaggctcagcctttggagaaggcattgtcagaagtggcaaagataacatgtttttgctgggggatgagtttaagtcaaaaacatgagttttgtttttttatttattgagacagtctctgtcacccaggctgaagtgcagtggcgccatcttggctcactgtagcctccacctcctggattcaagtgattctcctgcctcagcctcctgagtagctgggactacaggcacctgccaccatcctgggctaatttttgtatttttagtagagacagggtttcaccgtgttggccaagctggtctcaaactcctgacctgaagtgatccacctgccttggcctcagcctcccaaagtgctggaattagaggcgtgagccatcacacccggcctcaaaaacttgagttttaaaaagataactttactgtgcccttcctcatgagtatttatcatcaattcccattaagagaatatacatcttaatggaggttaatgagcccatggccacgtgtctgtacccatgggttatagaccagtggaaggatgctgtcctttgggttgga

SEQ ID NO: 78576 - DNA, 1029 bp, Homo sapiens
gcattgcacatgaggtgcctttgctagatggtgagagctaaggaatacatttatgtgtacatatatgtacatatactgatatgaactacatgcatgcatacatgtatctctacctacacttttaaaaaaaaatcatgagttcataccagtatttctagttctcgtccatccccacagggatctttcttgccttctcctgctccatgtttgtatatccctttcatgatgagaaccttgtcactcagcagtatcaatgcattcaagtgtgtgttcaatcctataactcatctagtatggtttccctatatgcctgttaaaaaggaatttatattttcttctagtacttgagcttcatattttatatttagatcctggaggcatttggagtttattcctctgtattgtgtgaggaatgggtccaattttatctttctccaaattgctatacggttgtaccagtcctatgtattaaaaaggtcatctttgtgatttgagatgtacttttatcataggttaggtacaggtctatttctggacttacttctttggcatctgtgcgcatacgtgctacacactgttttaatcacaggcttttaatgtgttttagtatttctcatggctcttccttttcagtgtgttcctagctgctactgtatgtttatttttacattcaaactttataaagaaaaactataaaaccactgtaaaagagctcatagctattgggggggggttatattaaatttatacattaacttagaactgacattccactcctcccattcctcaaatgtaagcaccttctatgggtataattctattcatctgctcctccctgctctttgtgctattgttaacttctacgtatgctgtgaacctgactttacaatgttgttatttttgcttacatgatcagttgtcttttaaagaaattatggaagaacaatgatattttatatccacatatttcccattttcagcccttttcatggatttctgtagatctgagtttccgcctggttatatcca

SEQ ID NO: 78577 - DNA, 1047 bp, Homo sapiens
agttttttttttaattctgtgaagaaagtcattggtagcttgatggggatggcattgaatctatagattaccttgggcagtatggtcattttcatgatattgattcttcctatccatgagcatggaatgttcttccacttgtttgtgtcctctttatttcgtagagcagtggtttgtagttctccttgaagaggtccttcacatcccttgtaagttgtattcctaggtattttattctctttgtagcatttgtgaatgggagttcactcatgatttggctctcttgtctgttattggtgtataagaatgcttgtgatttttgcacactgattttgtatcctgagacgaaaagtcttattttctaatataaatgttgggatgcttagggatctatgtgttgttgaaatgaagtgtttttttttttttttctctttagcctcttatggacaagggtgtatggcctgtccaacttggtgttttgggcatatgtagatgtcttcgtatagtgccctattaggcattcagacatacttattggttgattggtaaattcttgtccatgctgttttcctcagttggatagtttcagttccacatctagttcaacaatctcagaagattaggtaaagttgtgtagttattacaaaaaatgcatatttaatatctattttttcatttatgctgttttgggagccagtttttaaaaaagacgtaatactctttcattatttatgcggtttcctatctttttggagaatcattgtaattttattgccattgagtatgttggtatctgactcagaaagggaagaaatactgaaattacagtggatgagacttaatttctcatttcctgcaaccaagttactacaggtgtcccaattatggataagcatctatctagacagataaagtaggatagatttaggagtcatcttctaatagtttggggaataggttgcaaggtatattgctctctttgctaatgctttgcctcctccaactccctctatctatacctttgaacctggagtgattttttttccc

SEQ ID NO: 78578 - DNA, 1025 bp, Homo sapiens
actagaagcatggatgttcttgcactcttgctttcctttctccatacgaacttttcagtccatcagcttcctttctgtagaagatgaaggcatttcttctgtcctcctcatgcttttgtaacccatgcttctggtaccctgttttttgaatagtgaggtaaaaatccagaaggaagtacggctttatcatgtctctggacggtgagcgtacttggcatgaatgaagagctgataggagctattcaaaccagacagcaaactgatgggatgacgctgccatacataaaaaactcattaattacttcccctgctggacagcagtatatcctgaaaggaagaaagaaaggagcagatgatgatattcgttttgataggtgttctctgtttgaacagcttgtcattgagaagagaatccaggaaaagctgcagcttcagagtgtgatcaggtagaatgggcaagagttatttgacagacagttaagtgacgtattttgggaggaaaaagagggcttagcatggaggtagctggaataaggttccaaaatgcttttgaaaatgttcattttttcctgttagtctttttggctagaagcttttttttttttttttttttttttttaagctttgctaggcattattcacagacatgttgctgagttattttctcatatggttttccctaaagatggaaaataatttttaaaagtctttgagatagaaagagtatactgtgagttttaaatatttgtagcagagaaaaggctgccttttttttttttcctaaatgtatgcctgtttttatacatcttttgggcatatgcgttttgttgctttggagtaaagcattataagtcctcatttgatacaaacttttaacagggtcttcattaaagcttttccttaagttagatgaaatccatattagctgtataaaagaatagatttttaaatgtcaatttcataatttttgcacttcagtttttaaatttaaaattcaaatttttaaaactgcacttcagtttaaa

SEQ ID NO: 78579 - DNA, 1068 bp, Homo sapiens
aaatgtttaacagtgtgagcagaatgcactggatcaatattgaagaaaacgtggggaaaatattatgtgcaagtctgtaaacactatttttagagatacaaataaaaacgaaataaccagactgcagtttggtcagtatagttgttgtctgtgcatatttttgcttaaaactattatatattttcttcaatttaattttatgaaaagctattttgggtaggaaattttaattgtaatgacattggaatttcttccctcctctgttccttgtgccaacaattagactgaagggaaaagaaaggatattactctagcagcctgtacttttaaattaaacctcgaaccttttctttccatgaggcaacaagacagttttatttgtcctcattgattcagctcatttttttccctcttcttgtatggtatatagtttgtgccaatatagtctcatattacaaaggcaatatagtagaagaagattcttccctttgatatttaaaacatctgaaataacacaaacagaactataaattaaaaaatttgttctggctgacagggctaaaaaaattttcaattggataaccaaaaaaataaaaacaaggaaaactccgataacaaaaaaacttttccttgtagctgaatattgaatattgggcctaatttgattttcttttttctttttttttgagacggagtcctgatctgtcgcgcaggctggagtgcagtggcgcaatctcggctcactgcaagctccgccccccgggctgacgccattctcctccctcagcctcccgagtagctgggactacaggtgcccgccaccacgcccagctaactgttttgtatttttttagtagagacggggtttcaccttgttagccaggatggtctcaaatcttctgacttcgtgatccccctgccttggcctcccagagtgctgggattacaggcgtgaaccatcgcgcccggcctgattttctttttaaaaaccttcaaaagataagagcagaatttgtgtgctaaactgctagtctccagcgccattttgtgttttctgttgttttgaag

SEQ ID NO: 78580 - DNA, 1102 bp, Homo sapiens
gactccgtctcaaaagaaaaaagaaaagaaactgaagcataggacaactttcgccaaggttttgtttgtttgtttgcccgttgcttttaatgtcatttttcgggagagttgatttgggaattagcaagtaagaaaagactaagctgttgatcagtagtagctaaacatgattttcatttttccaggacagatgggagttttgtggttcatgatataccttctggatcttatgtagtggaagttgtatctccagcttacagatttgatcccgttcgagtggatatcacttcgaaaggaaaaatgaggtgagggcacctgatttaatttttgccaaaagctaggctactgaataccttagtatatattccttttagaattaatagtttagatggaaaattctttttatttaaactacagctattccttaaaacacttaaaatatcctcgtttatttaatctgaacattgaaaaaattgtaaagttgagcttcttgctctggcttaaaatttattttaaagctcctaatatgattacataaagaaaaggtaagattacttactataggagctaaagtgctatgaaagttataattgaaatatgattattaagttggaaataatttaacttttctaaattagaaatactattcatcacctgtttttcactgggatattttgataatacctcttattacctatttgatacttcattgatctggaaatttctgtggtcctttctttatggaatcttttatgttcaatggaaatatagtatttctagggaaaacaattgaggtgaaaagaactatagtctaatttagactgtgagtgtggaatagcaaaacctatttgaagttgaaacatttgtatagtatctatagtcttcagagtcagcttcccattataatagaacacatttatttatttattttgttgtctcatggcaatagcatcctctttggtcaaatctgaccaggaaatatatgaagcaactcctaagtggtaatgtctcttctttaagctatcaaatatgactatgttgcagtaataaagcacaggtcatgcaaaggcaaaaacaatttctggaggtggaggactaataa

SEQ ID NO: 78581 - DNA, 1064 bp, Homo sapiens
gcatactggcggtagtctgtaatcccagctactagggaggctgaggcgggagaatcacttaaacccaggaggcggaggttgcagtgagcagagatcacctcactgcactccatcctgggtgacagagtgagactctgtctcaaaaaaaaaaaaaaaagaaagaaagaaattggttcagtcagggtcccattaagaagtagaagatgcactcaaattagagtaattcaaggataatttaatgaaggcatcaaacagtgtagtcatggtgttgggaaacagccagattgtgcagtaccctggagcttacatcctcaaggttattatcaccacctctaatcctgaaggaagaggagagtagaggttactggaaccttgaagggaagaaaggcctgcattgaaagacacaaaccagtcccttaacacagccagtcagaggtggcctgtcagtgagaggtctggggggaaaatagactaagctcattttctttccttcctccagtctgcaaagaggagaaaggtagagagtggatctagagggcaaatggaacatgtccaggccaggcataagttaacttttttacatttcaattctggcttagtgtgctctggagtgacactttttcatcttacttttttttttttttttgagacggagtctcgatctgtcacccaggctggagtgcaatggcacaatctcggctcattgcaacttccgcctcccaggttcaagtgattctcctgccccagcctcctgagtagctgggactacacgcgcatgccaccacacccagctaatttttgtatttttagtagagacagggtttcaccgtattagtcaggatggtctcgtcatcttgctttttagtaactgttgtggatatcatcagtatcagttattcctttaactatgaaagagcctatgaggatttaagaagcattattttaatatattattatgatatcgggaattctctgatacagttggtcattttagaaccatttgttttcctgaaacataaactttttttcccccctcagaatagtagtttctcatttttcaaaca

SEQ ID NO: 78582 - DNA, 1049 bp, Homo sapiens
ttctggatggtgtttctcccgaagccagtctcgtcatcttttactcccgtgaggtccttggcctccgtggctgccgcagcaacacacacttgactttcacttcatgggcagtccccttcataggcacttgacacaggctctgtgcgccgtcttccaatccagagtgccgggagttaagggcagtacttccgccttacttccgcctcgctagtcgatcggccatgatctcttccctctggttggatcccacagcttatgacagaaacgggcgcgcagtgatgacaacatcaagccgccagcggcggcggtggcggccgggagactgggagggcttccggggctgccggtctgagtgcagagctgctgtcatggcggccgctctgtggggcttctttcccgtcctgctgctgctgctgctatcgggggatgtccagagctcggaggtgcccggggctgctgctgagggatcgggagggagtggggtcggcataggagatcgcttcaagattgaggggcgtgcagttgttccaggggtgaagcctcaggactggatctcggcggcccgagtgctggtagacggagaagagcacgtcggtttccttaagtgagcatcctgagggcagcgggaaaaaggctgggatggaggccggacagggaccccaccaggagagttaagtgtcaggacgggacaacgtcgctgtctcagactgaaggggagggtgccgctaacggtctatgccgggagaccttgggaggcagtcggatgctttccctttcctggtcctgtacctctggaatgagcatggcaggcgctcaccccctgccatggtcagagcatggagtcagttatttccaaccttattttggccccatgtggggacgatcattcctgggccctggggacaggtggacccttattagtctcttgttggattcttttatatctcatctggtttccctagaacctagtcgttttttgcattcacttcagtcttttggtagcttgttattatgtagaaagatgcgacacaagtgggaattctcaaaac

SEQ ID NO: 78583 - DNA, 1047 bp, Homo sapiens
ttggcactatttacatgaatcttgagatgtgagaattggttgtaagtatctctgtccatttgggggaatcacaaataccaacattgaactctaagggctactgaggaattaaatcctaatgcctctaaatttactcggtacacatcatgtcctaaccttaaccatggttgtgtgggttcaaagctaggtttctgacctttgaaacagtagttttctcaaacttagaacatttctatattttgcaaagttgttcacacaattaatattaatggataactaattggagtaatgattattagctactgaatgctgataatagaagtcatatttaaatgcttacttagttacttaagttagtcaaggactctgaaaaaataaggtttaagttaacagtgtcatcagtcattcccagttatcttcttatttaagaacaagatggtaatgcagttgcctttgtttatttaaatagaaaaaattaaatcaggataaaatgacccaactacagtgatgtatttggacacactacttcttatctttcaatatagacttttatttctggattaccatagatggaaatagtattactggacatatgttggtaggtatttacttctgtgtttttctttttcctttaatttcgaatacttctagctacaaaaattgtcataaaactttgcaacacactatacctccccccttttttattctataacagaattatagaataaaaattcaggccaggcgcagtggctcacgcctgtaatcccagcattttgggaggccgaggcaggtgaatcacctgaggttgggagttcaagaccagcctgaccaacatggagaaaccttgtctttactaaaaaatacaaaattagccaggcgtagtggcacatgcctgtaatcccagctactcgggaggctgaggcaggtgaatcgcttgaacccaggaggcagaggttgcagtaagctgagatagcgccattgcactccagcctgggcaacaagagcaaaattcctactcaaaaaaaaagaattatccctccctgaaca

SEQ ID NO: 78584 - DNA, 2562 bp, Homo sapiens
catttagcacttagcaaatatatattgagcacatactatgtgccaggccctgtgctgaacaaatgcagataaaagcactgaacaaggcacgtcttttaccctcaaaaggtcacaaaaggaaactaaggcaaattaagcaacaacaaaaaaaaatggattgtttatgtttgtatttactgtactgtctaatgaaatgtttttgttttatcttctaaggatgtagatgcttatttattacagttacattgagagatttcatctactaaagagcatttggtttttcaaaacatccctgaactgtataatttacaaaaaaaaaaagtctcgtctgagaactgtgaactgtggaagaaatcaaaactattttttcttttaaaaagccacgtaatgaaaccactaatgaaatcccagcaatctgcttcacattgaagtggaaaaatatccaaaaggagcagcttcaatttcattgaggtgaaagtgcactatgaagattgttcacctttgctgcatttgggagttatatggttatttggtaacattaagaactactggattttaatgcaatcctgcataaaaatataatttatactatgtgaaaaaataagacaggacttaccactaggaaccaccaagaccaatcatcattaacttttttaagattgtgttttattaaaaaaaaaaaacacttaaatgtgtgcagctattttcttatgttgaaaagactgaaagtttaaaacatgaaaaaaatcaatattaaacattttttgttcacactgagatactgtgtatgtaaaatgccttaattattaataagccaatgtgttatgataccaatatctgttttaaaaaactaaaaccaaccatgcttctggcatgataaaatcatggaattaaatcaggggtttacattcttgtagagtgttcttgaaacactctctgcaccatttttaaaacttgagaatagttttagtatctctgatattttttgccagaatcatcatgtcatgtatgaatgtgttatccctatctaaggaaaaaggtgaatatgtttttgtatgaatgtttaactggaaatgtccatggacttggctaatttatatttactttttattgtacatagatttctaatatttttcattcctgtatcatttaaacttccttcatttgagtaaattcactaaatatttctattttttgcttttttaaattctgattttatatgaattctaattctttttcactacatatgttttaaagagttacatacagtgatttagaatggtttacagttaatgctgatcttgtattttaaattccaacactttgtgtcactacctcctctaatggttagtatgatatgctagcagactgtatgaggtctttttttaaaataccacttttagtgtcagtgaaccaaattctggaatgtcttaacagctctaaatcttacttgtcttgaaaatgattggggtttaataccactgctggtggttcacacatcatcccatccttaatatgcctgacaggcatctgagcaaaggtttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccagttttcaggacatgggaatttgaattgtaaacctgttatctctgtgaaacttttaacatgataaaatataacctttctttgtgcttattcctgtagttatcactgtcttatgtagcagtttgaaccagttaacttggttggagtatggtgctaaagaggccgtggacaggagtttgatgcttttgtaggttcattaactttacatacacacaaaatgtttttatagctgtcgattgcaccttccgtcaggtatccatctcagaaattcaggaagatggtatgtatagcttagcataaacctttcgcctcaaatggaaagattactcaatgggtatatgtgatactgtagacttttaatctaacatttaaaataatagattcaaaataagatatctaaaatactgtgtaatgtttagtttcaaagtattaagtaatattacatcagatatttttcacatttttctctgggtcagatcattgactaaacagtatcttcaaaaatcaaacttcaataaatcagacttcagaaaaattaagtacaaatgacatatagtaagaacaggtattatcttggtaacatttatacctaaatttaggttttttgaaggcatgtagataatactttatcttacatactcagagctatataagtcagcagagtttttagctgacaaagattattgagtagcatatactcctaatttctgttcttggcctttgcagtttccttagtac

SEQ ID NO: 78585 - DNA, 1057 bp, Homo sapiens
aaaaaatttctcagataccttcaaaaaaaagaagcaaaatgatatatcaaccaagtttgttaccactgtgtgggattttactctatagaattcttttttttttttttttttttttgagatggaatctcgctctgtcgcccaggctggagtgtggtggcgcaatctcggctcactacaagctccacctcccaggttcacgccattctcctgcctcagcctcccgattagctgggactacaggcgcccaccaccatgcctggcaatttttttttttttttttttttttttgtatttttagtagagacagggtttcaccatgttagccaggatggtcttgatctcttgacctcatgatccacctgccttggcctcccaaagtgctgggattacaggcgtgagccactgcgcctggcctatagaattcttaatgatgaaaatcttatgaacatatcaatctcctagaaagtttttgttgttgttttaggtttttagagcatacatgacgtattaccttgctctaaagggttgttgcattctgtatagaagaactaaaaaatgattgttccttatgactgaaatttgctttcaatcagaattttttttgttgtttttgttttgagactgaatctcgctctgtcgtccaggctggagtgcagtggcacaagctcagctcactgcaacctctgcctcctgggttcaagtgattctcctgcctcagcctcccgagtagctgggattacacacatgcctggctaatttttgtatttttagtggagacgggatttcaccacgttggccaggctggtttcgaactcctgacctcaagtgacccacccacctccccctcccaaagtaatgggattacaggcgggagccaccacacccggccacaatcagttttttacaaagggaaaagctttattgtgaatatgactttaaggtaccatttattattggggacaatattgagtgattaaaagttcaatgcgaagttccttatgatgagactttcttacaaaattaaaccatcaattaatttgtaattttttgagtatag

SEQ ID NO: 78586 - DNA, 1121 bp, Homo sapiens
atctctacaaaaaataaaaataataagccaggcacagtggtacgtgcttgtggtcccagatacttgggaagatcactttgaacccaggagttggaggttgcagtaagctgtgattatgcaactacattccagcctgggcaaccgaatgagacccgtttcttaaaaaaaaaattactaaaaataaaaagtaaacatcccttttgagtgggaatttgaagcattactttcctcattgtattcaagtctctcagatgttaccttagggaagccttctttgaccaacttattttaaaatacctatttctccactccctatctcgctttcctgttttatttttctccatagcacttatatcaacctgctctatatgtcttatgtcttgttatttgtttattgcctgtctctgtcccaccccccaacccccacagttgctcacacactggaatacaagccctgtgtctttgttcattgctgtatccacagacatgactcattgtagatactgacattgttaaatgaatgaatttctcaaaagcggtgtgaataatcataatatgaaagtaaataaggaaatcagctctctaaggcaatgctattctttttatactctcaggatagaagatcttggcgttgtggtagattgccttcctgtgctcaccaattggtaaaaacaatatttttcagaaaaaaaataagattaaaggaggtcaaattatggcccatccatatttttataacttggtatttattttagtttacaggaagaaaaacaatatatctcacttggctgctgtgttgacttgttgcctctagtaaagtcactacttaaaagcaaatttgaagagtaagtgctaatctgaatcttgattcatttttctttttcagcatccttgattttgtgctttgtgagtacatagtagattgggctccatgagacatgcaaggtttctgttttcaagaagctaatagtacaattaggaaaagaatatgaaatgactaaaggacaattataaaagcatctctaaacaaattacatgaaatatacttttgtgtaatagatcatgaaggtaacaattttttaaaagggaagggaccaatgtgtgtgtgtgttttttgggag

SEQ ID NO: 78587 - DNA, 1029 bp, Homo sapiens
tgtttatatgtgtacttaatttgtctttgtctagaaaatggtctggaaagatacatatcagtctgttaactgtgattatttctgcggagtgatattggatgtttttgtgggcaggcagagagtttttactttttatcttacatagttctgtgttaaacacattagaacaggaaaatgacacttcattacttaacaataaatagataaatttaaatgatactacaacacttgtcaaaaactgagtttttgtgattctcctgccattcagttggtaatgactagcctacatgtttacatttttcttttatccatgttataaattaagtcctagtttataggtcagctaaaaataattttataaattattgggttttaaaagaaaaatggtagctagtgaaaagtataaatgggtcttaaatttgttcagatcatttgtttactgtggtcaactgcagtattcctttttgtgggctagtaaaaggagttacttttgcatgatttttaactatgtctaccagaacgatttaataaaaaaatagtttcataccctgtttcagtgtgctttttaacaaatcagattattgcctttcaggtttctcaggaccatgaaacaatggcccaagttttgttcagcaggaatatgagattgaatgtagctttaactttctggagaaagagaagtataagtgaacttgtagcttatttgttgaggtaagtgtgaccttttatcctctttgttcaatcactttttttctgagacaagttcttgctttgtcatccaagttggagtacagtggcacaatcatggctcactgcagcctcaacctgctgagttcaagcagccctcccacctcagcctcctgagtagctgagagtacaggtgcacatcaccacacctggctattttttaaaaaaattttttggaagacatgaggtcttatgtttcccgggctggtctcgaactcctgagctcaggtgaaccttcttcattattctaaactgcctatatgtagcttcagtagagacagt

SEQ ID NO: 78588 - DNA, 1111 bp, Homo sapiens
agaattaagatttttaaaattctatttatttctaattttagtggattacaatcaccaaatatagcctattaattctctgtttaaaaacttttaaaggatttcatatggttctttttcatttaagaaaataaattctttttacagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtaagtcttttctctaactcatatctagtttaactttgttcctgttataatcttgatttttttctttgccatattccactagcagaataatttgtcacctattgaatgtagacttatttgagtcatagtaactccctgagacaattttctagattaaccaaatttgaattaataatttattccatttctctaagatgggatgaaatgcttagcaggctgctaaaactatccagaatgacaagttagccagtagagatttaaaggaagggaaaaggagaaatcttgcctaaaaaagtggagcactaggccggacacagtggctcacgcctggagcccgaggtgggtggatcacgaggttaggcgtttgagaccagcctggccaacatggtgaaaccctgcctctactaaaaatacaaaaattagccgggcatggtggggggcgcctgtaatcccagctactcagaaggaggctgagacaggagaatcgcttgaacccgggaggcagaagttgcagtgagttgagatcacaccattgcactccagcctgggcaacagagcgactccgtctcaaaaaaataaaaataaaaaggacaacatctgcaggcagatcacctgaggtcgggagttcgaggccagcctgggcaacatggtgaaacaccctgtctctacaaaagtacaaaaatgagc

SEQ ID NO: 78589 - DNA, 1140 bp, Homo sapiens
ttttaaagtttaacttcctcattctttacacctccttgccctagtttcagtaaacaacccccttctagcctttatactcacatatttagagtccttagtcatccttagtcacctgctctgtccttagtcatccttagtcacctgcactgtaaccatccttcctgcctaaactgctcaccccgccactctgcctcatacccagatagcctatcagaattagtttagactgtgcggtccaaccctagccaataggggaatgacacagtagtagggactagctgcattagggataagaaccccttctcctcccatgcccggtatgctcttgcgaccactccaggcacgattggcacccttctgcagaagtaaattgccttgctgagaaagctttttgccggagtgctgattcttctttgcggcaccaagcatttgtttctaacatcaactatctactttcatttttcaggttaagaaatctccaaaacagttggctgcttacataaataggtaagagtttctttaaagtttgtggggaacaacaaatatgaaagctgggtaaggatgacaataagggaaaaataagcattcttttatcataataataattaacttattgtcaaacagcttctttatgccagtatctgcactaataaacacatcaatattgtctctgctccttacaacagtcctactctatagcctactctatagataacattaaccctaacagttgatgagaaaacttaagatcagataagttaaatgatttgttcagaatcatatagctagaaaagtggtaagaatgacattcattctcagatctgcctaacttctaaaggcactttctacaaaacgactggttttcaaagtgtgatttgaggacctgcgggtccctaaagaccattcatggaatttgtgaagtcagaattacttccatagcaatactaagacattgactgtcttcattttcattctcttgtttgagggtacaatataatttttcaagaagctatatgccatttgatatcacagtagattgaatggagaagcagaaatgagaacccagctgtcttttgttaaaccagatattagagatatataaaaatgtaaaacagtaccattcttctcactttttaaaaa

SEQ ID NO: 78590 - DNA, 1407 bp, Homo sapiens
ttggtcaggctcatctcaaactcctgacctcaaatgatccacccacctcggccgcccaaagtgctgggattacatgtgtgagccaccgctcccagcctagagctgtttaatcctttgatttggcagccattgtagtagattatatagaaagatcccttttcatttttctggtaggtgacagctactatgtaaagagaatttatccctccaattccttctacatgcttctgtttttctaccttcttaggacaatacactaagggtattagcaaacactgtattgtctttaagaaaatatgcactatatccaatgttcaggatagttatatacagttagtgtattggcctcttctcaatcttttattctcttaagaccttatttcttttgttcctttttttcattaaaaggcaatgataattgccagtttctataatcactgtcttcaacccttaataccatttcagattcttcacttttttgtgtattatcaaatagcacttcaaaagcgcatagaggcctgaccattgctttaaagtagttttagttacattgtcaaatgctcttggtggaaaagggataatcctgtattgttgccccaacaaaggtgctgtcaaatatatgagacatgaaacaaaatggaatttgtagtgtataaatcctttgcaatgagactttaccattacaattatgatttccttcactccctttaaagctttattgaagtataatttatataccataaaattcacctgtcttaaatgtacataccaaaatgtacaatttactgattgtaagtatattgtaagtgtacacagaattgtgcagttgtcaaccccagtataattatagaacatttccatcatcccaaaaagaaaccttgtgcctatatatacaattattcccactcccatcctagcctaagacaaccacgagtctgctttctatctctataaattttatttttatagacattttcatttaaattgaatcatataatatgtggtctttcatgtttggcttctttcacttaacatagtattcaaacatgttgtatatgtattggtactactttttttttttgagatgaagtttcactcttcttacccaggctggagtgcaatggcgtgatctgggctcactgcaaactccgcctcccgggttcaagtaattatcctgcctcagcctcccaagtagctaggattacaggcgcctgccaccacgcccagcttattttttttctgtttttagttgagacggggtttcaccatgttggccaggctggtttcgaactcctgacctcaggtgacctgcccacctccgcctcccaaagtgttggtattacaggcgtgagccaccacgcctggccacttcattcctttttgatgctgaataaaattccatacaga

SEQ ID NO: 78591 - DNA, 1467 bp, Homo sapiens
gggctatagttctgacagtggaagaaggaagatctgaatggatctgtgaaatattttgaaggaaggttttttgtttgttttgctttggtttggttttttttggagacgggtctcactatgttgcctaggctggtatcgaactcctgggctcaagtgaccctcccgcctcagcctcccaaagtgctgggattacaggtgtgagccactgtgccctgcctgaaagaagatttgagaaaacttggtgatttgttagaaggaaggagaaaggagtcaaaataactcccatgtttccagtctgagagaattttgccagtcatttcaaatgtgatagctaggaagggcagcaagttggtttgacattgaagagatttagatgtgttgacttggacctagcagtggctgaccgaggagccaaatacaaagaaattaaagaagacctgggtcgagagaaataactgaagccatgaaagcatatttcttcaatttcagtagagagaggagctgctggaggaaaaggaaccagaaaaatggtaagggaacaaggagagtcaggacaactgtgtcgtatgaacagaaagagtcagggaagggccctgaagtgacgaaagagctaaatggtgatgaagaatgagcaatgtctttagagttggcttggctgactttgatgagcatcatcagtgctataaaggctcctatataggtttaattcaagacgcattttttttttcagatgagagagcaaaataaaagcaagattacaaagagttaaagagaaaatggaagctaaaaagcactcattgtagaaatttggcaggaaagggaagcagagaaagagtataggagttgatcacggaaatctgatcatgtttgaaagcagaagggaggaataagttcaaagggagaaatcaaagatttttaaaaagggtttgtgggagcaaagtccaaattgaggtgagaaagcaagaactgagaaaattagatgaagctgtcctaattttggaaaagttaaaatagattcttcttatgaaatattacctccatgtattggcatttccaccttttttgcttgtttactataagggagttatacgattaagccatgttttataagatagtgatctcattaagttaaaatatttatttcttcagattataaaaataattcgtgtttgttgtagaaaatagaaaaacatgttaagtgatggtgggggggagcacccataatcccaccaacaataaataatttctgttaatgttttgatagaccttttttgattggatagatcttacctatatctcttttgaaaaacctggatcttactatgcatttagttttctattctgctttttaaaatactgttgcttgccaggtgggatgttgtgtgcctatagtcttggctattctggaggctgaagtgggagaatctcttgagtccgggagtttgaggccagcctgggcaacctatg

SEQ ID NO: 78592 - DNA, 1953 bp, Homo sapiens
aataatcgtattttattgtctgcaggtttttctttcttttggagtgaggcaaggtaaatacataaatgtctttaatagatttaaaaaagtgagattcagctgtttccaaggttatagagctagttaagtgggaaagctgggaatttgaacatggatctgtttgacctaatctttttagctgcaccagcctttaaaaattcggatgagtctttaattttttacccagattgtaagttgtgatacctacctgcatagtaagtagaaagctttccagagagctgggaggggcaggaggagcctggaggcctttgcaaattaagttttaactcccattggcctgacagcacttaccccacatcattgcatacaaagggtactgagggcatccccagtctgcagggtcagacccagcccacacagctgagaggagcaaacaaaaccggtagagctggccttggtagtcgccagtcaaaacgaaaattccagatactttgaggaatgtttctggcacctccaggattgaagagtaaccagtttcctggagacaaaagaatggatgtgggccaaggggcgccatatttctcagctctgtcaagcaaatgccaggtatccaaggagtctagtgaaaagccatggatagctgtgtgccccaatttatttttaagtcagattattgaggtatcctttccgtgagttttggcagttgtgtaattaccaccacaatcaaaatacagaacatgtccctctcctcaaaatgtttcctcttatcctttttagtcagcttccttccctgtctctggcaatcactgatatttttcttatccatatttattttctagaatgtcatgaaaatgaagttatgtaatatgtagcctttcgaatctggcttctttcacttagtataatgcatttgagacttatccaggttgtcatgtttattagtagttcattcttttttattgctgagtagttagtcatttgtatagaaaaaaatcatgaataaaccagtctaggatggtaaacatttacctcaggtggggtgaacatatatcccaatattcgtgggactgatctgatttatgcctattgtcccagcataatttttaatagtaactcctttcactctcaaaagtgtcctagtttggatgataaattctatggtcactctaaatgagggcatactgagatgtgattatatttcatttgctttacaatgctgtcaaatttgccttccagaacaccgtaattgtatatgtttatatttcttataagtattattggtgataatagcagtaataacttacgtgtaatctcattttgattttcacaatattctcattttgcatttgagaaaacagatttagaatagaataaatgatctgccaaaaatcatgagctagaaagtgatgaaaactgtatcatctgtttatacattcagcccttaatctctcatattaattgggaggcattacagtgtattcgttaagaatataggcaatggatacagaacacctgggttccagtgcagactcttacttgttttcgttgtttaatctcgggcaaattatttaatctttttatgcctttattttcttacctatagaaagaggataatatgtcttcagtgcctacacctggcatatggtaaatttttgataaagtctatctgttatttttaatgatactgttaacactatcgtagtggaatctttccccagcaaaaccctttctcctccccatccatatatatatatatatatggatatatatatatggactatatatatgtgtatatatatggatatatatggacatgtatatatgtatatatatggatatatatatggacatatatatgtgtatatatatggatatatatatggacatatatatgtgtatatatggacatatatatgtccatatatatggatatatatatggacatatatatgt

SEQ ID NO: 78593 - DNA, 1322 bp, Homo sapiens
cccagctactagggaggctgaggcaggagactctcttgaacctgggaggcagaggttgcagtaagccgagatcatgccactgcactccagcctgggcaacagagcgagactccgtctcaaaaaaaataaaataaacctcattcttttatttaaaaggtaatattttttactggtaaaaattgataaaaataagccaaagacaacgattcaatcttaatctcatagaaaaataaacagaaaaaaggaatgtaataccactatttagaaataacccttatcctttcattcttttctctgtgctacatatgcacatatagaaacatacaacaaatttaggaactgatattaaagtttgctaataccacgaatcatgtttcttacaccaaaggcaacttgcctcataggtgatgtttgtgtataacttgataatagctaacatttacggagtgatttacagacattgtggtaagtggattatttaatcctcacagcattattctgaaaataggagattaggtaacttgcctaagatggtacataactaataaatggttaaaacaggacttaaacccaggtagtctgactctaggacttatatttctctgtcacaccatactgcctagtcttttcagtttaaacgtaagaaaaatacaacttcacattaaatttttcaaaagcaaactaaaacatgacattgttcatcgtttgtcagattttcaaaggtaaaaacgttgacaagacagaatcttgtgttatcatggatgcaaatagtggttgttctccacctctagtagcaggagtctaagttggaaaaacctttgtagagagcagcagtctatctctgccacatttgccaagcttcttagttcccaatttagtgaagacagcaattggaaataggaatttaaaatatattgtttccatgaaattaattgtaatgctttgggtagtctggacaaaggcaaatgcctgaaaaactgtatatcaaataaggtgtagattagaaagctaaacataaatgaagtaaaactgtaacagtttaggattttgtactgataatgtatcaagttcttgagccactttaagcccaaactataaattatagatgatgcatcatacattatgtttagatttctttctttctttctttctttttgagacggagtctggttttgttacccagggtggagtgcagtggtgcaatctcagctcactgcagcctctgcttcctgggttcaagtgattctcctgcatcagcctcccgagtagctgggattacaggtgcctgccgccacgcctggcaggttttcgtatttttaata

SEQ ID NO: 78594 - DNA, 1109 bp, Homo sapiens
aaaacttattgagtggttattctgtacttgaaatggttatacttaaactaatacctccttgacaaggaataaatttcaaaagcaaaatcacttagtaagaaatcagcagtttatacttatctatagcagagcttttaaatgtcattcatcagttacaaagctttcgattgcctgtatgcccaacagggtggtagacccaattggctatacaaaagaaatgtgccgcaagaatgacactatggactttggggacttggtagaaagagagtgggagggggatgaaggatagaagactacacattggatacagtgttcactgctcaggtaatgggtgcaccagaatctcggaaatcacccctgaagaactgattcatgtaaccaaacaccacttgttccccaaaaacctattgaaataaaaaataataaaaataaaataaaaaatgtgccaggacaaccaaccttagggagattaatctagtttgggttatgagattaacaacaaaaaatatatatgacactcttcgttagtacagtggatgaatgcagaactgaactgggtaaagcttctgcgaaaaactaacaattgcaggatttatgtagggcactgaacagaagggtggatggtggggctaggcagggttggtaatcccaacactttgggaggccaagacaggaggatctctggaagccaggagttcgagagcagcctaggcaacatagcgagaccatatctctacaaaaaatttaaaatattttgccaggcatggtggcatgtgtctgtagtcccagctacttgggaggctggggtgggaagatcgcttaagcccaagaggtcaaggctacagtgagccgagattgtgccactgcacttcagtgcagccacagaactggtgtggctcacacctgtaatcccagcactttgggaggccaacggtaggaggaaagcttgagcccagaagtttgagaccagcctgggcaacataccaagactccatctctacaaaacattttaaaattagggccagtgggtcatgcctgtaatcctagcactttgggaggctgaggcaggtggatcacaaggtcaggagatcgagaccatcctggctaac

SEQ ID NO: 78595 - DNA, 1018 bp, Homo sapiens
gtgcaatcgctcggtctcagttcactgcaacctccggctcccggatccaagcgattctcctgcctcagcctcctaagtagctgggattacaggcgcccgccactaagcccggctaatattttgtatttttagtagagacggggtttcaccatgttagccaggctggtctcgaactcctgacttcaggtgatccgcccaccaattcttaacgctgagtcagtatgggctttccttcagccccataaagtgcacctcagaggtcagggaacacataacaaggacattcaaaaggggagcgcgcggaagtggctttaggaagcactaagtcttgcctggttttttttcctccctgcttttctaaatccaaacccggactcctcaacccacagcaccaccaatttccagggcggaaatgacgtcgtattcacgcgccggaagtgcatttgcagagtgagacaaagcggagaacgctggtgggcctgttgtggagtacgctttggactgagaagcatcgaggctataggacgcagctgttgccatgacggcccaggggggcctggtggctaaccgaggccggcgcttcaagtgggccattgagctaagcgggcctggaggaggcagcaggtgaggcacctgggcaagctgtacatcactgttcatcccagaactgcaccagagtaatgagacctgagccctcaggcataactctgaaaaagatgggtggcacacagacatcacctggggaggtagcggcttttctgccgtggaagtttctctgctcaaacaatgcttacatcagtcctcctgataagtcaaaggactgaggaacatacgagggggcttggtctaatctgagtaggtgcatctgaagatctttattcctatgattggtagatcaggaaatgtgggataagaagtatcggaggttgcagctttagtttcttggtttggttttttaggggtcgaagtgaccggggcagtggccagggagactcgctctacccagtcggttacttgg

SEQ ID NO: 78596 - DNA, 1048 bp, Homo sapiens
ttgcccaggctggagtgaaatggcacaatcttggctcaccgcaacctctgcctcctgggttcaagcgattctcctgcctcagcctcccgagtagctggaattacaagcatgtgccaccacacccagctaattttgtattttcagtagagacggggtttctctactgaaactgatgttggtcaggctggtctcgaactcccaacctcaggtgatccgcccgccttggcctcccaaagtgctgggattacaggcgtgagccactgtgcccaaccaggatccagtatcttaaaggcccatactgtaaaggtcagcctgcctaggaattctgccacatttacacacacccctggccaaagtaatattttttttttccatgtagaacaaattatgggcagaaagtaaagttagttttagaagtgctgtttgtggttggagaattgtaaaaatcttttaaagggataagggaattagtggcttttaatataaccactgcttcagcccgaaacacaaaatcactgttacatggaaaactggttattaggccagatttatattcatgtctgtctagagtatttcatgtgtgtatgtgttgcttacgttgtctgtctccaaagtctctcatctcttttaatcactgcaaataaagcaatactgaaaacttgagagaatgcaccttaggggaaggggctatttcaagacagaaaacaaaggaaatacctgccttttgaataagatcccgcttttgagtcttacctatgactttaccagggtagattagaaatacacatcctcctgctgaccctctgccttcaatagctatctatcttaaaagctgaagtttgaactgcagcatctgcttgacaggtgccaggttccttcggcagggggacgatcactctatatatcttccgttgcctcagattcctgtggcccaaggatcccaccaatcctcgttccccctaaacatgctaacaaaaatcccttatcgtgggtattaaaataataacagttacactgtatgcatatttatgtgctccttttgtctggt

SEQ ID NO: 78597 - DNA, 1052 bp, Homo sapiens
tgggagttgtaaataatgcttctaccatctgtaggaagtaacagaaaaaaagacttaagatcctatccgctttgccatcctcagtgggcctggaggttgaagcaagcaaagggaacaaatcaaaattactcaatttctttctttctttctttttttttttttttgagatggagtctccctctgtcgcccaggctggagtgcagtggtgcaatctcggttcactgcaagttccacctcccgggttcacgccattctcccgcctcagcctcccaagtagctgggactacaggcgcccgccaccatgcccgactaatttttttgtatttttgtagagacagggtttcaccgtgttagccaggatggtctcaaatctcctgacctcgtgatccgcctgcctcggcctcccaaagtgctgggattacaggcgtgagtcactgcacccggcccaaaattactcaatttcttaagctatattgaagggttttctctgtccttacaggtcaaatgaataatttgtgacacctaggtcagcttgctccatgtcctatttagtaatcaaagaagagtggcactatttatgactaataaattgaaattcaaaaacagccatgaatacaggcaagaaaagtttctctaaataactattctgtaaaagaaatgaagatttcacatacttgaaattactgctcagccagccacataagtagtttccctatgcttgtaagccagatgtttgatcagtatattagtaaataaaaagctgagcttacacaagtatttccttggcacactgaactttctttttgaaacatatcactctgttacccaggctggagtgcagaggtgcaatcctggctcactgcaacctccgcctcctgggttcaaatgatcctcctgccttagccttccgtgttgctgggatcacaggcatgcaccaccatgcccagctaatttttgtatttttagtatagacaggttttcaccatgttggccaggatggtctcgaactcctgacctcaagtgattcacctgccttggcctcccaaagtgct

SEQ ID NO: 78598 - DNA, 1637 bp, Homo sapiens
agaaagaaaagaaaaaggtttaaaaagaaaaagacaaaccgaactggcagaaaaatctgacttgagcagcttcacttagaaattacttgggttctctctaggaatcttgttagctgccctattgtggcttttcttcttctttcatcatttttatcttatttagagtaacacttctaggttttcccattttttaaatacacaaatgggagtctggtattatgtatgcaaaaggactggatctctggttacttcacagggttaaattcaatccaaagttcagacttttctgaatatataataattaagcagctaattttgtagctctatgatcagataacctcagattatgatgatgccaggttttaagtttgtgctcttcttttgcctgtctccttgacaagttttgaagacatggagttcctagaggtgcttaccgagggactagagcgagtcctacttgtccggggtggtggcagtgaagtgatcaccatttattcataacctactctgaatgaccgtgcttgacctgttttcttaaaaggcctacgtcctccatggaagtgccagctcattactaccactcccactcaactagaagcctgtgttctgtacacatcatactgaactcttgatgagctgagcctcaagtacctgtgtaaaagagctcccatctgatctgcagtcattacagaaaaagcaaatattccctcaacatcagaacaatgctcaagtctttcaagccacgtctgagcagtcaaaggcaaattagaattaacaagctgagccaataaatgaattggtaaaagggatgctagaaattcaactgaagaaaaaaagcaagtcaagtacgtattcagcattaaagatgaatctcagaagtcatggttcaatgttgacactgtgaggataacaactagagacagcttcatcttactaaagaatttatggtcaagtatatttggacctattatcctcggcaagccaagatgcaaacattttttagctatatttctttagtatacccactgctgtaattttatattaggatactaacttgaaacatggctgcagcctctacttcttcaaaaacatccccccaaaataccagatttaaatatccaaatactgtgtcagtgtatacttcaactgttttgtttctcttaactcaaaacccattctgtcattgtaacacaggcagtgttaccatggaaattgtttttggtaaggtaaaaattatttctttcaggttcctttcaaatggccgaactaagagaactccaaaaggaagctattaacatttactgaaatagtctgtggttctctatacaacatggacaaaacatacaagctgttgtctaagaaatgcaggtcatggtgcacattaatcaacaggttcttctccccccgcccccacccccgcgcctttttttatgccctcttattaagcacaggtcaaaaaatcttaaggaacaaatactaggaaaactggctaaacatccttccctgaaagcactggaccatcttttaaagggcacatctagcaatggaattggaagttctagagccacactctttctttagtgccaacgttactgagcggctactctccttacctactttactaaaatggcatacag

SEQ ID NO: 78599 - DNA, 1202 bp, Homo sapiens
catcaatccaatccgtgctctctaaagtctgtcactgaaagggatgatactgggctgggcatggtggctcacgcctgtaatcccagcacttttggaggccgaggcgggtggatcaagaggtcaggagttcaagaccagcctggccaagatggtgaaaccccatctgtactaaagtacgaaaattagccgggcatggtggcacatgcctgtaatcccagctactcaggaggctgaggcagagaagtgcttaaacccaggaggcggaggttgcagtgagccaagatcacgccactgcactccagcctgcgtgacagaggaagactctgtctcaaaccaaaaaaaaaagggatgatactatattgttttcaaggatgacaaattccttctcactctgtcagttattccactataacccattactgcttcaaaataaccaaagatgaagcataagagaaaatttggtagaataacttgtgttggaccttcttcctcaggcacaattggtgaaagaccgaaactcaatgctacgattgaccagcattggctctgatgaggacgaagagacagaaacctatcaggagaaggtgcacatgacttggacaaaagacaagtacatggcatcccggggacaaaaagcgaagtcaatggaaggattccaggacctgcttaacatgcgtccgtaagttttcccactcccaagtttatcataaaattacctaatcagtggcacaaatgtgactttgcctggacacacaggatggagtctgttcatttcaccctgaatctagccacctcattattgtttgcctgttcatactggctcccaatgaacactgtacacaagctaaccatcccctctatccacatagttcacctccatactgtgttcttactataaaataagccaacagagaatgagaaaacccagatattaatatcataaagaaaccattttagcctgggcacagtggctcacgcctgtaatcccagcactttgggaggcagaggcgggtggatcacctgaggtcaggagttcgagaccagcctgcccaacatggtgaaaccctgtttttactaaaaatacaaaaaaaattagccgggtatggtggtgggggcctgtaatcccagctactcgggaggctgaggcaggagaatcacttgaacctgggaggcggaggttgctgtgagctgagattgtacca

SEQ ID NO: 78600 - DNA, 1044 bp, Homo sapiens
gagagcctagttcttagccgcatcactgatttaatctgtgcctttgcaaaaatcattccattttccataccattattcccagggtggagtaagagtaaatgagatgatatctccaaattggtttgactaaataaaggaagagtaatgcaaatacaagtgtcatgaataatcaccattaaaatgtcaaaaagcatatgggaatgggagaggcgaaaaagaaaacatacctgagaaaattctaaagtgaaactgaatcatcatactgagtttctggtaagatgagtcagggcatgactggggctgaggcaggaaggagatcgtgttcacaatagtgaatcaccctggtcaactgagaaagaatgttgaatattcactttgtagagatccctgttcccagttttttggtatggtgcaaaggaacaaaagcagaacagaggaaaaagcagagaaactacatgtagacaaccagctacagaggcaaaaatacgtagtaagcaaaaagacaaaagatcatgaaattcctttgggataattttaactttttggacttttctgtagatgatatagtattatgaagactttggaaaaaggtgggggatataatatggagaaggaacaatgggttaaaatgtccagagtgaaccagttcagtgttgcggtcctgtgtctctttcagaccataaagcacctaatggaggcagagaaggtaaaaggattctgccagctggtggtggccgccaagctgagagagggcatttcccacctcatccagtcatgtggccttgggggcatgaagcacaacacggtggtgatgggctggcctaatggctggcgtcaaagcgaagatgcccgcgcttggaagacttttattggtactaaccatttctcatacaaacctaaaggcccaagtcgagggtatatagttaaatctctgtcacccccagcctcctaaagtagagactatgccattgctgaagcatagtcttataaggcaacctgaaaaactattggtagtaatacccagattctacctacccccttcag

SEQ ID NO: 78601 - DNA, 1051 bp, Homo sapiens
cgagaccatcctggctaacatggtgaaacctcgtctctactaaaaatataaaaaattagctgggcgtggtggcaggcgcctgtagtcccagctactcaggatgctgaggcaggagaatggcgtgaacctgggaggcagagcttgcagtgagccaagattgtgccactgcactccagcctggtgacagagtaaaactctgtctcaaaaaacaaacaaacaaaaaaaaaactatgtttttatttatgtgtgttttattgtgcaatgtgtgtgtatacatgtgctcatgtagaagcaaacacacctttagaaactgtataaatgaggagcctgattttgaatgtttgggtagaaaattaattatcttttttttttcatactgctgctgcttaaattcccatttttcccactgcagagaatctttggagtaattacctacccaagggagagatcatcgaaaagccttcagccaaatcttctgatgtcttaggcagcttaaaccatgaatatgttcttgttgacatcaccacctccttcacgcttctggtgggaatcttctttccctctgttacaggtaaacacataggctgttgtatattttagaagctgtcagacccacggagtgatttttctcaggaggcagaattctcagggttcctagatttgcttctactctttgctatcagtatcaatatcaaagtgtccaagaagttaacttggttttttcccccttatctctaaaggtatcatggctggatcaaacagatctggagatctgaaagatgctcagaagtctattccgattggtactatccttgccatcctgaccacctcctttgtttgtatcctttttatggatccagtctgagtcttagtcataggagcatccagtagaactagatgatcagtatttttatcctggtaacaaagatacctgctttctatcacttcacttcttgccagattatctgcctacctcatatagaaaattcaaaaaagaatttataggagtatttagcagctcattttactgacagaagaaagtgtctactga

SEQ ID NO: 78602 - DNA, 1029 bp, Homo sapiens
ccaccactctgccacctcatccaagaggttcaagtccaatggggaaaaagtaaaataaagtttatcttttttgatatcttcatccctatgaaataaaatgcttctcatatctctcttcactgagacatattgtttactatttaaagtagtgatagtagagtcagggttaaagatcatcattataattactttatataaccctatgaataaaattaataatttgttcctttcctttctttccatttggaaatgtagttattcagaacagcatgtagaccaaaaaaaaaaaaaaaatccatgacatcccatttctgaaggcatttcagatcctattagaaactaggctaattccccagtcattttctctctcagctttgctttcttttgtgaaagtaaatgcaaacgaatacagcctttttacttaattattttgaaataacctaattttctcctttatttttacctaacaggtctatatcgtcccccgagctgccatctttcacagtgatgacgcactcaaggaatcagcagccatgctaaataacatgcgtgtctacggcacagctttcttggtccttatggtattagtggtatttatcggcgtacgctatgtgaacaagtttgcctcacttttcctggcctgtgtcattgtgtccatcttggccatctatgctggagccatcaagtcttcttttgctcctccacacttcccgtacgtgtctgtctctctgcctagccatccttattgggtagtaattgaaaatatctggtggtgtgataattttaagtcagaatttcatagagtctctctgagattttccctctcagataagcccagttagacttccttcctcatctaggcaggaagcctaccagcaaactatgtcccgttcatcctctttcttatgtcctaagcatagaactagtagctgtaaccatcatttaggttcagatattagatttttttctccctgataattgtacataatctttttttattatacacattttgaactattcataaagggc

SEQ ID NO: 78603 - DNA, 1090 bp, Homo sapiens
gccaccatgcccaactcaatgtaccaattttttttttttttttgagatggagtctccctctgttgcccaggctggagcgcagtggcgcgatctcggctcactgcaacttctgcctcctgggttcaagctgattctcccgcctcagcctcccgtgtagctgggattacaggcacgtgccaccacacccagcttatttttgtatttttagtagagacggggtttcaccatcttggccaggctggtctcaaactcccagcctcaggtgatccagccaccttggcctcccaaagtgctgggattacaggtgtgagccactgcacccggcctacctgtgaaatattttttcatttaatttgaagttttctggtagcaagattattttgatacttatgttcagtgttctttgtagctcatttcttccatgtcactggctttataggaagaaatggacaccagaccgaaggtgtcttccctcctcaaccgcatggccaattacactaatctgactcaaggagcaaaggaacatgaagaggcagaaaacatcactgaagggaaaaagaagcccaccaaggtgaggcctcagaataacaaggaatacatagaaagagccctgtatataagaaagaaggaaatacctaaggcaccattctgtgttcagcagctatttattaaatgcttgagaggtgcctggaactgttctgggcaccagcgtcatagcacaaagaaaacatatgatgcagtctaaattctgatgtggggatacagtccttaagctgttttaactgccaaagtatataacatattaagtgttgataaattcccgagcaaaaaattaagcagagtagagagactgaaattggcaagggatccagagtggagggcgttgctacttacataggttggacagggaaagcctttctgacaaggtgatatttgaggagagatctagctgatgggagggagtgagctatgtgggaaaagagcattcagggagagggaatagcttttcaagagaagagtgtccatacccatctgctgatgccatctgtctgttgtgaagttgttgggttttttaaacaccaaacatcag

SEQ ID NO: 78604 - DNA, 1025 bp, Homo sapiens
agacagctgtggaggcagagagcttttactgtcattatcagcagcaatagtgtgtaaaggagactacatctaacacagtattataccctgagtatatactcaatatctttttttcctcctaaacttaggtgactttaagagtagagtctcggctgggtgcaagtggctcacgcctgtaatcccagcactttgggaggctgaggtgggcggataacttgaggccaggagtttgagaccagcctggccaacgtggtgaacccctatctctattaaaaatacaaacaaattagctgggcatggtggtgcgtgcctgtactcccagctacttcaaggctgagacaggagaatcgcttgaaccagggaggcggaggttgcagtgagctgagattgcgccactgcactccagcctgggcggcatagcagctccatctcaaaaaaaaaagagtcttcatgggctggaattccaaaagaatagcgtctctaggggtcttgattattgttaaggaaaggaatgacccatgtttacttctcagagttttctttttgttcctgctggagagttttattttgttccatattctccaagcagtgctgattgagttctaagattaaatttgaatatgaaaatgggttatattaataccgaagcaacctgcacttatctggtgctgatgtttcttcgtcagaaaccagtgagaaactaacttggtctacttttttttttccagacgacggacataagaaagctcgaaatgcttatctcaataattccaattatgaagaaggagatgaatattttgataaaaatttggcactctttgaggtaatattttggagaaaactatggactgagactttaggaacagagatctcatgatagccatattttaccccatttggtttaaaaattttacaagctggataatttaatgttaaaagaaaatattgtaacttgttattatagtaaattttgtctgtgtaatctaattatagtgagtaactattaaatcaaattgttatgtagt

SEQ ID NO: 78605 - DNA, 1266 bp, Homo sapiens
tataaatgtatcaaattttttgatacaagaatagtgactcaaactattattatcacatgactgtatcgttataaatcaatgtgtatatcagtgctaagaattcaaccacattactttgatattttccacagtactattgtactacaaaatgtttagaattccaagaaatatgcccagctacctaaattctaatttgtcgccatgactctttttagcatataattgttattatgtctgttgaggatcattctgtggcttatctcaattttctgtgatatagtattattcctattgcatagatggtaaattaaagctaagaagtattgactcattttcccaaggttacactaataacatgtggtagagctagtatctcacctgagctttacctgcttcccagttctgtgttatcttttcactctgcctcatgtctgcgctctgggatagttgcacagctgtcatagtgggctctgtcttcagcatcatcctggaggttccctttgcctttcctgtaaaatggaacaatcatgatagtacttacagcataggatgagattgctgtaaatgagataatacaggtaaaacgtttaggtgtctatcacatacataccctaataagtgctaactgttgataattctttctattgttgttatgtctactaggagacttttattggtcccaaaattattcatgacacttgtatttattataaatccataatttaaccaaatattacacaaattgatgtaatatgaatagggaaagtagagttgtgtctataaaagctaacgtggattatttagcaggtcattaaacacttatttaaggctgggtgtggtggctcatgcctgtaatcctagcactttgggaggggaagcaaaaggatctcttgaggccacaagttagagaccagcctgggtgatatattttgtctctaccaaataaattagccagttatagtggtgcacaccagtaatcctagctactcaggagactgaggtgggaggattgattgagcccaggagttgaagattacagtaacctaagattatgtcattgaactcaatcatgagcaacagaacaagaccctgtatcttaaaaataaaattaaaaaaaaggtatttagggccaggtgtggtggctcacaactgtaatcccattactttgggaggccaaggtgggtgaatcacgcggtcaagagttcgagatcagcctggccaacatggtgaaaccccctctctactaagaatacaaaaattagcctg

SEQ ID NO: 78606 - DNA, 1032 bp, Homo sapiens
gaacgttgtcactaaatgaaataccagcatgcttgccataaatagagtataaattaaaaatagatacaataaagcagctaatcttgttagatactgttgccaagcttaggctctgactaagcctgttaaaaaagagattagcaacatttgaagagattttaaagatattctagcacaaacatttttaaaaatgatatttggcaaagtgcttccaactttcagttagctgggttaatggcaggatgaggggagaaggtagaatcagttaaaacttatcaagatgtttagtagaaaatgaacttaataaacatttgtagttaaattttcaaaaatttgattcttatggagttatcagaagtatacaaataacacaagtaaaacagtttggttactaaaattttttttcaaatatcaaagtagaagcatatctacttttctatgtggatgttctttatctcttcttaatttctctaccttcagtcctgactctctgttggattccataaccacatgagctttcctttaccttctctgtgttctgccatgctcttggcaaaaagggatggggcagtcttacctgggtcggcaatgtttgtgaactctgctgcattagcaacgcatcgatatggccatctgtggtcactgtgtagttccatgcaccagatacctactctgactatttgtaattatttcatacatgccttgttgtgatcttgtgccttagataattatcttccctggataattaaaagttatgtatattaccattattcattcttgtacctaaattttaggaacaaccagtatgatatagtagacaaatcagaatccaagttcaagcgagtcttttttgaaatttacactcagtttgccttggatgaaccattgagcctaatcttgctttagctttttaatatttcctatctgtatcacagggttatcatgagaaccaaaagaaatatgtgaaaatattttaaaaactgtaaaatgttactatgtgtaagttactattattaccatcattctttctta

SEQ ID NO: 78607 - DNA, 1076 bp, Homo sapiens
caccatctcagctcactgcaacctccgcctcccgggttcaagcagttctcctgcctctgcctcccgagtagccaggattgcagatgcccaccaccatgcctagctaatttttgtatttttagtagaaacggggtttcaccatcttggccaggctggtctcaaactcctgaccttgtgatccacctgcctcggcctcccaaagtgctgggattacaggtgtgagcggcctatttttgttctttccttcttgagtcccacagtatttgtacttaaactgtaataattttattgtttcataattgtgtatttttcccctctgaacttcttgagagcaaatggtcactgtttttgatatccatagtgcctagcatgtacctgacatatagtaggcattcagagtcttggttgaattaatattaataactactactgctgtcctagacagttagccttagagatgtttgcacatggacagaccgccgtggtctattaatgagtctgcctgcctgtctctaatatatctagcatttatttctttttgcatttttgtactcatgtttccttgcctaaaatactgctttcatttttagacttctacatagagaatttcagttgttttccatctcctttagactcctctatttgccttccaagattttcctaatatgacccaatcttcccaagcaaatctttccagacatgtgctgtatttattcctcctctgtgattttgagccctccatgatttttaaggttttcaaaaatcctccttcaagttcacactgccttgatcaatgttgcacgtctccctgtggaccctcacactgcttcctgctagtgagatgatccaagaccacagctgaggcctggctttgccatggttccattggctttattggctacaccaccttgggcaaatcatttcagctttctctgagctagtttctttatgaatataggaataattcttcttcacatggttgctgtgcagtttttatgtgatgatagtaggaaattttccctaaattcagtcttttagagactacctttgtaatctttctatttttatggatcatc

SEQ ID NO: 78608 - DNA, 3246 bp, Homo sapiens
atggcataggttaacaaattgattataagctggtaaatttaaagaatcgagaatttcttgctttggccaggctgaaagaggaaacaattttacccagaaaatgtcatcaacatttcagtaaaaataccaactaccattgttgagcatggtgagtagcagagccagtgttcaaaccaggcactggtttgtggcttatttaatcctcacaacaatcaggacaggtaaccattatcaccatgttaaaaatgaggaaagtgaggtgccaaaaaattaggaagattatttaagtgacagatttggaattcaaaataagggctgtgtagctctaaagccattatttttcgccacaccacgctgtttctactttaaacatatatgtaattatttgtgttttctgaactaggctgctctgttttttcagtagttactagttcttcttaagctctattatcttcatggatttaacaaaattaattgaaagttaactgcttcttctaccgttttgttttggattgcttttttatttcgcatagagtatttacaaatgtagaatattctttcaaatggcactaaaaattgagaaatctgaacttgacttaatccaacaatctggtttgttttttttttttttttttttttgtcaggtggacagtgtctggcttccttgctcaggctgaagtgcagtggagtggtctcggctcactgcaacctccgcctcccaggttcaggcaattctcctgtctcagactccagagtagctgggattacagacatgcaccaccatgcccggctaattttcatattcttagtagagacagggtttcaccatgttggccaggctggtcttaaactcctgacctcaagtgatccacccacctcagtctcccaaagtgctgggattacaggcatgagccaccgtgcccaacccttaatccaacagtctttagtagctctccactcctcacatttctaggaagatgcaattatcagcgagatagaaataagagacttaacaattcgcaggagacttgtaccagtctaactaatggaaatttagatctgcatgcttaaagactaagggttagtgatggaaaaaaatgggcatatggagcaagtgaaataattgaattttaatatcactgaaggtaggtaagatatttttaatatattaagaaaaattatatttcattttcatggaaatgaagctgagtaaaaactaaattctttctagagaaaaatactaatataggtagaatatagacatggcaaagattaaatatggtacataaataacaaatgattttaataaattctaaagcctcatatggtaaattagatctcatttattttcctgtattctttccatcaacatgtaaccttttgtgacagaagattctgatggttatattagaaacagtgaacctatagtaaaagccctaaaagttgtctccatcttccccttacttcattgccttcgttcatatttttttcttcatctcaactttcttctcttctgctgtttcctgcctacagtaaaaaaaattacatatacccacattcagtttcattacttcaagaccaagttcatacttatttcctccaagatgactttcctaatcttctactccaactttgattatatcattaattggtattaatgggtggacatggtgactcatgcctataatcccaacactttgagagatggaggctgtagaccaggagtttgagaccagcctgagaacatagtgagacctcatcttcaattttaaaaataaaagaaaaatgtaaaaaacaaagaaaaataattggtatttatcagcagtcaaatattcttgcagtaacactgtaattatattttatctcttcacctgtattgagggtgagacatagtgttttaatatttttctgaaaattacatattttattttttattgtggaaatttcaaattcggaaaagtttagtgaacttcctgttcatgtctgttacctgtaggtattcttctttattttttagatatgctttatatttagggatgtcaatccctttgggaaataaattccaaatgtttttccccatcggtatttttttatcgaggtgcagttgacataaagttaactgtacatctttaaggtgtatattttgttgatgaattttgacatttatatgcccatgaaataattataatgaagatagtgaacattttcgtcacccccagaagtttctttgtgccctttatgccccactcacctaattccttggtccctaggcaaccactgttctctttttctgtcaccaaattagtttgcatttcctagaattttatataaatgtaatcatacagtatgtactccttttggtctgactgcttttatataacaattattttcagagtccatctaatcagtttcctttaattttgacttccattaagatcttccttatttcttaaattttttcttcagaacttaatacttagggcagtagttgaaaacaatgcagtccacagatgtttggactttacagtggcactttaaatttttgacttacatgccaagattttaatgcttttaggattagtctgtaaacaggactgacttttcagagtgagttctgggaaggtggctacttgaatatctcactatccctccattcctgcttccagcctgtatctgtcaatcttgagtgaagtggctcctggatctgatgaacagttggtgcaattgaggccatgggctgtgtgagaactctgtcagggagagttggtacaggacttttcctctagacaagagcctggaaaatctcaggataagcataagaatggcaaatccaggaaagaacttggtttggtagatatccatgaattcctggagggaaggagaaaaggaaagagccatgggtctgagatcttcccatccctgtggctggcatatgtaaggagacctgagagcagggaggcttcctcctgggcctccacaagggctggtggcttgcctgctgcagcactgcctacccacaggggtagagactgctttgcctttccattttcttgagactgctaccgcttgtggtcctccaacaactaaatctcatcccccatgaggtgacaaagataaacaacccatctggggaagccaggcaacctgaaagagaaaaaccacttagaataaacaatatattgagttagctaaatagaaatgctggaggaggctgggcacggtggctcacgcctgtaatcccagcac

SEQ ID NO: 78609 - DNA, 1115 bp, Homo sapiens
cttgcctcaggccacatggtgagtagcagagccaatgttcaacttataaattctttgtgctctccactataccatgatgccaaatcctagctttttactaataagaagagattactttatatcttaatgtgcctgagccacagattttgatgtgagcattatcgaaactgtgatttttaaaaataggaccaatataacaaagttttactgattattgcatttacttaatcagatatgaatttccattcattcatttatttaaatatttatttccactgcttcacttggctagcctaaaaatatatgtattaaaaaataaaaataaatattatggttagtatttttgtgaaataattgttcgagattttctcccctgctcctcaaatcttatattgcctatggattaggcagatttgaattgataaacttgccttcactggacacagattgccatttagaagattttctctcctttaaaataaggttctaaggaaatttttagaaatggacctatagcacaatagagagaggaacctgtactggtattgaagagcatctccaaacagtaactcacaagtaatacaaatggtaggagagcaaactatgagacaaatttctattaaatgaggtttaaattttattgagaatccacaggatgttagactattaactaaataattgttacccatgaaagcttatgttctaaaaaaggtgatttggctgggcttggtggctcatacctgtaatgccagcactgtgggtggccaaggtgggcagatcacttgagcccaggagttcaacaccagcctggacacgggacacacacacacacacacacacacacacacacacacacacacacacacacttgagcccaggagttcaacaccagcctggacacggggacacacacacacacacacacacactcttgagcccaggagttcaacaccagcctggacacggggacacacacacacacacacacacacacacacacacacacacttgagcccaggagttcaacaccagcctggacacggggacacacacacacacacacacatacacacacacacacacacacacagttgagcccaggagttcaacactag

SEQ ID NO: 78610 - DNA, 2409 bp, Homo sapiens
attagctgggcatggtggcacatgtctgtagtcccagctactcgtgaggctgaggcaggagaatcgcttgaacctgggaggcggaggttgcagtgagctgagatcgcactactgcactccaggctggacaacagggcgagcgagaccctgtctcaaaaaaaaaaaaaaaaaaagttaactgttctctaatctttcttgtgtgaaatatgagggcagaggttgagatcatgacatgcagataagaatgacaacttcagtgaaggaaatagaggagcaagcggtagacagtagttcactgtgaattctgtccagtctccaggtttcagcagctttgggaagcaggctaaactgttcttggggttcttcaggttaataacaataagcaagggtggagtgcttaatccttttaagtgaatgataaacactgtggaaggcgtgtcttcaagcgccccactccctcagggctgtaggtcacgtgagcttaaagtacttcccgaatcccagccactgtctcttgtaggcagggatcacagtctgaaacgacagcaaggaagaggtaggcagggaaaactaactggaaggaagtttaaatacagaaagagcaaagtattatctaactataacaatgccacattttactgtgactaaggtagaggacccagaggagggggcagcggcttcgatctctcaagagcctagtttagcagacataaaagcccggattcaggattcagatgaaccaggtgagtacgcaacttgggagcttttggaacctataaaatgtttcatgaaagaagtaactaggatatcaaaattcaaaatgccttctttaggacagagaaaagtgttgtggttgaggtgtttttcagttacttatttcactcccctgtgtatctgatagcttctcttacttttctcacacactggattgtttttccccacaatgagttctgtgttcattaccaacaggtgaaactgaatcagtggcaatgtttgaagagttttcaagcaaaaagaaagacacagaagtcaatttatgtggaatttagaattcactttttcctcacagtttagattatatctggaaaagactttaaacccaccgagtggatgacatttaaacttagcagtttacataatattatataaagagggagcatggttcagtagttttgtaccgtggactttgactgtacttgtgatttctcaggttattcagtattttacctcagtttaccagcttaaactataattcaataatgaatggtctaagaattttttaatggcagaacaaaagtacaagagatggtcattgtggtgactagcatagcatcaggttaaaaaaagtatttgatgaatgtgattatccctattattttctttaaatggtaacagttcacacttgctagaggaattgtggttttgaatttttaaacaagcaattaaatctttgttaatattatagtattaaatatagttgtaatttgaagccccttatttttcaagtctgtaaatcgtgagcagcgtctttagttatatgaattaagaataagggaataagctctcaaaattacttttattttattttatttatgtttttggagatggagtctttctctgtcacccaggctggaatgcagtggggtgatctcggcttactgcaacctccgcctctcgagttcaagcgattcttttgcctcagcctcccgagtagctgggattacagatgcctgccaccacgcccggctaatttttgtatttttagtagagacaaggtttcacctttttggccaggctgatctcaaactcctgacctcaagcgatcccccgcttctgcctcccaaagtgctgggattacaggtgtgagccactgcgtccggcctcaaagttacttttaattccgtgattctgtgattctcactttcctttatagcatgtaacacattgcaattccttggtgtcaatagcggttggttatctttttcttaaaaccattcgagaatttttatgaatcttgtttgaagatgcaaacttttaaggaaaatgttccttttgttttttccttctagtgagataatttattaggggaatatcagaaaaaagattttatgtaaactctttgtccgcaaggttattttcattttgctgaataggatgatggaaagtggaaagcaagtttaatctgctttgaacttgaatatgattctctacaactcaacttcagctcaattaggttctgtctcaggcctgtgtgtatttatttatttacttattttttacttaatcccaaatgtgatagtaaggctaatgtgtatttgaagctgcaccttctttgcttatgttttccacccttacagtttaatccctttaggcttttgtctttgctgttgtcttcgttaatttcataag

SEQ ID NO: 78611 - DNA, 1065 bp, Homo sapiens
tgatccgtccacctcagcttcccaaagtgctgggattataggtgtgagccaccacgcccggcaaaggcacgagttttaagtgaacattggcagagttttgataaatgcatgcacctgtggaatcctaaaccccatcaagatgtagaatattaccatcactctaggaagttctttcaggcccagtcccagttaatctgtatttccattcttccagatccagccattgtcctgctttttctgcatcataggttagttttgtctgttctaaaaccttataaaagtggattcacatattatgtactcttctgtttaaagcatctttcacctagccgtaatgtttttgagattcatgcatgttgttgaacatatctagtttattcctttttattgctgaatagtaatcctttgtatgactatatcacactttatccattctcttgtgaatgtatacctaagatgtttccagtttttggatattatgaataaactgttgtgaacatttttgtgcaagtccttttgtgggaatatattttcatttttaagggtaaatacctatgagtggaattgccagattataggggaaagtgtgagacccttttccatagtggttgtactaatttatacccccaacaacagtgtatgaaagttctttttgttccacagtcttgccaaatttggtgtttttggtcttaggaattttagccatcttggtgagtgtagtgataacctcattgtgatagtgtattgtactttaaatagctatttctcacatcccaccttctttaatcactctccatgcacatcacacacctcagctttactagttttctctcagctttttctgtactactttaactttgccttcaattttctatgcccctgcacttttatatatagttcaccgtaggagagaacctgtgcagccaaaccagtgctattaagaaccaatgaaataaaatttaggtgagtgtatatgagttttctttctttgaaacatactctatgttgcctacctcagggcattagaggttttaaagttgagtttcaccacttacaatggtgact

SEQ ID NO: 78612 - DNA, 1032 bp, Homo sapiens
aacttttaggaagttgaaaaagtagctgggcaggtggtggtgtgttgtgttctcaaggttcattctctaattatagtgcattggacgtataatcctagttttgtattgcctttgagtctatagttaatttggataataagactgtgagctccttgggcaggaacagtgtcttgctctccatttcattcctatttcttggcacttagtgggcactcaaatattattgagtgaatgcatgatcctttcagcctcagttaaagcatgagattttcctgaggctttaacttggagaactctttgcctttcttactctacaatatgatgaatccaccagaaaataatgtcttttatatatttataaatatataaatcaccaaccaaagaggtagcactggcagctatgaacacagacattcagttactcagggtttcatttctgatgtatgacatttaattcttctatttttagttttagcctccaaattcattatatattcaccactgataacatttcataaaaatgcattttcatagacagtttcaagtcaagatttaaaagacttaagctgtaagtccttaccatcccatgatagttggtctttaccaaagtaattgatgcattcaattcttttaataattttatacatagtaaggcaaaatttagaatttgtgatcttttttatatttttcactaatatttcctgtctcagttgcagagggataagagggtttgctgaatatgataaataaggaaaatgtgtatacatcttctacttaagaatgagactatacctttcaggctctgctatagtagtagccctaaatgtaagtggtgaacagctcattctcctgtaagatgtttatagcattttctaacacagaactattcagagtgtagtacgagacagtgctggcccatgagctgtttattatttgtgaggagataagttcagaaattgagtttttagaaacttgcatagcagtttgatagaacaaatttatgtctgtcaaatctaataataacaaattggg

SEQ ID NO: 78613 - DNA, 1043 bp, Homo sapiens
aatgcagtgtgtgaacttggtttggattctgatgtgcataaaacaattgaaaaaagatacttttgagacgagtgggggaaatttgaacatgtacatgatattaatattaaggaattgttaattttcttatagatgtttatgacattgtgataatgtaaagctgttatctataaagatatatattgaagtatttacaggttaaatgaaatgtactccagctccttcctccccactcctccccaaaaaagttggggagagatagacaaaacaagattagcaaatgtttataatttgttgaagtagagtaaaaggtacattttactatttcttagcttttatctttgaagatgtctgggaactcctgagctcaagtgatcctctcacttgggtctctcaaagtgctaggattgcaggcatgagccaccatgcctggccaatttttaaaaaggttaaattacaattaaaggattttcttttgagtgtgtcctagaatgctgtagatatttgattaaatatcagtgatcaatacagtgattacctcaacttcttgtctttgatcttcggtggtctcttctgtgtcctcactaagtctttccatcatgagcccaaattcttttgttctcagtggcatgtttctagattccagattctcataaattttgatattacctttactggaatggaaggaaatgaaagaaggtactcctgcaaacctgggaaccttatgaaagttatgctttcccattttaaagctgttagaagaaggggaatgtttctaatgctgatgtttaaggcaacttataatgctgtaagcttttgaattatggctgctgcttcttttgcccttcgtgtctaacatatacttctggactactaagaactttgtgcaaattctaaaaaggcactcctttgtgccctgagccatcatgacttcactggagaagggcaagctggatttcaaccctcttccccttgcccttctggcttaatgccctcgtgcactgtctacacagctgtagctggtgagcttgttgtttcagaat

SEQ ID NO: 78614 - DNA, 1048 bp, Homo sapiens
ttcattactgggttctttatccaagatgaccatctatggatctggaagatcataatcatataattatgattataatagtcatcaggaaccaaggcatctctttgtgagatgcttaggaactctttggaataatagcatagtggctctttgcagtagtaatttggtatgtgggaaggtgtatgacaagaaggaaggcaaatgtatattttaacttcctcatttttgtcttcttagaaatgaaatgggtattttggttaaaagtgaatatcaaagaatgtaatcgttttcagcacacagaatcctaaattttaaaatttagtgagttggatatgtgttctgtagccatcattggctatttcagtctgctttaagactggtttcatggagtagttactggtcgtatcttagcagctttcctccaagacttcgaatgtgtattgcaaaattcttttttgaaatctgtatttttatggagaccttgacacaagtagctaagcccactcagggtgatggtgggtagacctaatgtgctattctgtcaaatggaagacttctgaaaaggcttttagggcctgattcccatgtaatttattctctctgagctttagatggaaagtctgatgattagagttagcaggtagcacacaagccactcctggctcatgttgactgctacagacctttagcttcctaaaccagtttgtgtgtgtcagctggcttggttttatttgaggtactgggaagaggtgatggaagagagagaagagagaaaatggggagatcataacattttttggactctgaaatttaaaagtttgagacctgtactgctttatatatttagttttatgctgtgttgtaactaatgtaatcttttaatgataaaaatttcccttaaagactcttaaaataatattccacccaagtttgaaaaccatagcctcacccactgacttgtgaaagcaaggcttactcaccattttccggtgtcaggaaatattgttccttttaacctaaagggttcaggaaaccagaatgattttagttc

SEQ ID NO: 78615 - DNA, 1310 bp, Homo sapiens
cccggggctgggggaggccaggtcacgtaactgctgctctggcgtcgggccggggagggggcgccagccccggcagcgcgaaccctgcgcgcgccgcggctctgaaacagttaccggctagtaaacaacagctgcgcgcgcacccgcatcagctggcgccgggatactgcacctgcgacctccttctccctcaccctgctgcccagtcaggccagcctgcgtggccgtctcctcctctactgggaccctgaggaagaacgacgagggggtgacctgcgccggggcgggggtaggggagaacgcgcctccggcaaagggggtggctcgtcctgtcacacgcaggagaaacctagcgagcggaccgtggctcagtggactagctacgacttgccacgactctgagctgcagtccgaggtgtcttgatccgctaacctcctcccagaccccgaggacctttctgctaggagaagagcgggcgcgccacccccaccgacctctcggagacaggaatccgctctgcccctgcatcctcctctgctcacccttctctcagtagtgtgggttatttttcccgttatgcatgtgcacctttcccaccagacccaagtggattgtcgacatcaaaaacaccgggtggctttgcatacacctccccccagccagacctgtggggtattcacctgatacacaacaggtggccgggtgtacaccttttagcaatctgatccacgctatagtcgcctgataaaggtttgcctgcacgcacttcgcccaactagaaccgtgggacactcaccagataaaggactacctcgacaggaaactgggggctgaggggagggaggcttcatctgctgccctgagaccatggcactgagccttcagccccggaccagaggggttagctaggtagctcttcattctgaaggaaagaagtcacacaagattggcattgttttgtctttttgttttttgtttttttctctcttaaaaaatatattcacctattggtgatgcactttctaggacagtcggcttgaattctgagtagaagtattcttagttggggctttttgtgtggtgtgaatcaaggttattgaaatgtgttatttttcaagttatcttttgtattgcagtcaaaagtagctagcgtaagaggaagattttgcgaggttccccccactttttttgttcttaaaaagaacaaaatgcatcctccagaaaccaccaccaagatggcttcagttcggttcatggtgacaccgacaaagatcgatgacattccaggtttgtcagacaccagtccgga

SEQ ID NO: 78616 - DNA, 2646 bp, Homo sapiens
accagtttcataaaataactttacgctctttcgctttacggaatattgatactcaacatgcattctttaccgccaacgctttgaaatggagcaggggaactggatgtaaaagaggggagggaagaaaacctcttctttcttccctagggtaaaggggctctgaatcctggagcccttgtttcttcaggcattgaaaactcactgctcctgaaatgggtgtgtatcttgagacaaagacaggcttctatacgtcaatattctatccacatccatccctacccccctctaacgccgtgtacctagcacacagtagggacactccacgtgttttagcctgcaaagttgcaagtagggccccaagccaagccctgctctcgtgcgcccccttctggctagctgaaaacaaggcaaaaattgactacattttccggagtgccaggagagagagacttccggttatgcaggaaggaaattgacgaacacgtgacgcggtcgggcggaccactgcagactgagcggtggaccgaattgggaccgctggcttataagcgatcatgtttctccagtattacctcaacgagcagggagatcgagtctatacgctgaaggtgaggagagaaaacagggtgtaaataggcatggcgagaaatgtagatgggaggagtgggtgaggtcatacgtggagttacctagctgggtgcggggaaccagaaagtccagaaccgaggtggggaagaaccgggaccgcgcgactcattttttaattaaaagaaaaaattctggcggggcgcagtggctcccgcctgtaatcctagcactttgggaggccgaggcgggtggattgccttagctcaggagttcgcgaccattctgggcaacactgtgaaactccgtttctactaaaatacaaaaaattagccgggcatggcggtgtgcgcctgttatcccagctactcgggaggctgagacaggagaatcgcttaaacccgggaggcagaggttgcagtgagccgggatagcgccattgcactcacttttcctttttttttttttttttttttttaaagacagggactcgctttgttgcctaggctgtagtgcggtggtgcggtctcggctcactgcaacctccgcctcctgggctcaaacaatccttctgcctcagcctcccgagtagttgggactacaggcgtgcgccaccatacccggctaatttttggttttggggttttttgtttggttggttggttttgtttgtttgtttgttgtagagacgaggtttcgccatattgcccaggctggtctcaaaccatcctcccgcctcgacctcccaaagtgccaggattacaggcgtgagccaccgcgctcggcctttttaaattttatatttctctatttatttgtacaactttttgagttgaccattgcatcttctattttcatgtttgccctttttcgcgctggccccaccccatttcatcactcctgtactgacatacattctgtgttcctggagcagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgatttgaaaaactcttattttgtgagttgttggaggaaaggattggcagtatttttttaaagggagggagatgataaaggagagtaccccagagagttgcaacaataccacttggaagaaaaacttcagtcctgctgttgcaagagtggtcatgtgctgttcatgataggagggtattggggaagaaagattaagactttcacagctgtcagcattcactgaaaaatacctctgttgtcacttaacgtaatttcttgtcccttgaaataagattttgattaaaaatggaagagtacttgtaaaagtaataggcatattacagacagaggtcagtgaattgaaagtcagaagaccagtatttgctttttgtataactttgagaaagttacttaacctgtttagtctgatttttctcctgattaacttatctttgaactcaaattgatttagtggtgggcctttctttttttttcttttgagacagagtctagatctgttgtccaggctggagtgcaggggtgcagccttggctgactacaacctccgtctcccaggttcaagcaattctcctgcctcagcttcccaagtaactgggattacaggtgcacgccaccacacctggctaatttttgtatttcttttagtagtgacagggtttcgccatgtcggccaagctggtctcaaactcctcacctcaagtgatccacccacctcagcctcccaaagtgctgggattacaggcatgagt

SEQ ID NO: 78617 - DNA, 1052 bp, Homo sapiens
gactcaaagtcctctggctcacagcctctcagccctgcagcattgtggatgtggaggtatggctcccgtgggggcggtgggagaagtacatctcagactcctgaaaccttgggaaaagagggtgggagtggtcatacctcactttgaggttctgataagaattgtgtgtgtctgtgtttcagttccttcctgtgtatcaccccagccctgaggagagcagggaccccaccctctatgccaacaatgttcagagggtcatggcacagtgagtgccccacaaactatttcctggagcagttgcacagggcaaaggaaccacaggggcgtggagggggcgaggttttcaggcaaagatcgaggagcaggcagtgggaagggctcttgaacagctgagacagaggcagggagatttaaaggggcctgatctactccagtcagcgggccagggtcaggaaccaaccctcagaagtttcttctgcttccttaccctccatcccatccctcttcatcctgtagggctctgggcattccagccaccgaatgtgagtttgtagggagcttacctgtgattgtggtgggccggctgaaggtggcgttggaaccacagctctgggaactgggaaaagtgcttcggaaggctgggtaagtggtcttggaaatgagggtatgagcagtgtcacagagagagagagagagagaataagaaggggagaaatgagaaggaagaaggaaaatcttaaaaatgaaaaaaactgggaagaaagataatagaataaataaaaggaagtggggaataaatggaaggatatgtaataatgcaggtgaaaaaagtaagaaggggccgggcacggtggctcacacctgtaatcccagcactttgggaggccaaggcgggtggatcacctgaggtcaggagttcaagaccagcctgaccaacatggcaaaaccccatctctgctaaaaatacaaaatttgccgggtttggtggcacatgcctgtaatcccagctacttgggaggctgaggcaggagaattgcttgaacctgggaggt

SEQ ID NO: 78618 - DNA, 1482 bp, Homo sapiens
tcctaggcccaaagtggaaagatctgtgcacctggtttctgttgggcataggagctatttatggaataagatgtgggggaggaggacctgtctctaacctactgtacatcaagcacagcgccctgcactttcgcatgcattcttattaaatcctctaagtgctagatgctttttatggctttcggttttataaatggggtagggaccaactgaaagacaggaaaataaggcccttgatgccattaatcttttatcctcttgccctcattggtatcttcatcccaccttgggtcccagtcccctctcctgttcccacaccacctgtcacatgcaagggatgatggctgtctgctcctgggtctatgctttgtggaagaaggatgctgtggagggagcatatccaagctctaaagtggcattctctcccaccctttgcagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagtaagtgagggatcagcccccagagaccctacttctcttccctgctgtctattcggctccctctttgagaagaagaaaagagagcattctgaaactattctgtctagcttgggtagatgagatgagtcagccaagctcagacgtggttcccagacctcacctctaagtaatgtgccctgataggtcccaaagtggccagagaccttggccccttggtcacatcctatttaagggtaaaagaggggtgccctactttcccggtgtctgaacctgggggcgggtgagggttagaaccactgcttccgctgatacccagccttgccctggcaggactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggaggtgagagagttcaaagggggtgaagggcagggtgacaactctgggcaaaaaaagtcaggaatggagacactggagtgaagaactggcctcaaagtggggagggactgttggcaagtgaaatataaattaacaccattagtcaaccagtcttagattctgagggctgggacagagagaaggtgttggagggagttctggtcagttctctaaaaggacaactactataaagggattgtcccagggcaaagataacaggccaggcacggtggctcgcgcctataatcccagcacgttgggaggccaaggcgggcggatcacctgaggtcgggagttcgagaccagcctgacca

SEQ ID NO: 78619 - DNA, 1053 bp, Homo sapiens
ccctcggccggcgccctgacaacgcgggcgggctgggctgcgccgcctgctccccgcccctcggccgcctgcaccgggcggggcccgggccagagcgccgccgccgccgctgctgcagcagcagctgctctgcagagtggtggccggggccagggccggggtgccctccctcccaccttctcccgccatgagccagggaagtccgggggactgggcccccctagatcccacccccggacccccagcatcccccaaccccttcgtgcatgagttacatctctctcgcctccagagggttaaggtaatgtgtggggagcgggcgtcggaaggacccgtgaggataggaaaatggggccatttgagccctggcaaaggtgggcttggggatccacgagaaggagatggctgagaggcttgcggagcgggagtccgggggtgcgcacgtgggggcggccgcggttgggcaaggagtcctggagaggacgctgcgggcttgggcgatagacaagctcgaagatgtggaaaaactgagtaggtggggatggagggctgcaggggaccctggggttggagagatgaaggacgctggggaatgcggattacattctgcagagcctgatggctaggatggagttagagtctacgggaagccgggggtgggggcgggggcgggggcgtgccgagtattcctccgaggcatgacttagagggaagacgtttctgggccgggagcctgcgaccctgtgcccttcctacactccctcttcccactccctccaacccccctccaccccgcactgcagcacctcccggtgggggcagggaggctgagagggaggttggctacaggaagtggagggccgcgccagcctaggggagctgggaggtggtgtggggagggagtgtccaaggtttctgctgtcatcacctccccggaggcaggctccaggggctaggtttgcttacctgcttcttccccaaggcagcctatggagtcatcctggctcctggcagcctctctcccttgcagagtggggccgagctcttgtctcc

SEQ ID NO: 78620 - DNA, 1159 bp, Homo sapiens
caaagtgcccagcgggccaaggcctctctcaatggggctggtatctattctggctgttgcactctgaagatggaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggccacgggcccccccgacctcactacgaagggagaaggatgggtccaccagtcgggggtcactgtcggggcccaagtcgctacggccccccagtatgggcaccccccaccccctcccccaccacccgagtatggccctcacgccgacagccctgtgctcgtggtctaaggcttgcatcaatctaagatgaactgtgacctagtcttcaatgtcttctgcttgtatggcaatgtggagaaggtgaaattcctgaaaagcaagccgggggcgccatggtggagatggctgatggctacgctgtggaccgggtcattacccacctcaacaacaacttcatgtttgggcagaagctgaatgtctgtgtctccaagcagccagccatcatgcccggtcagtcatacgggttggaagatgggtcttgcagttacaaagacttcagtgaatcccggaacaatcggttctccaccccagagcaggcagccaagaaccgcatccagcaccccagcaacgtgctgcacttcttcaacgccccgctggaggcgaccgaggagaacttctttgagatctatgatgagctgggagtgaagcggccatcttctgtgaaagtattctcaggcgaaagcgagcgcagctcctctggactgctggaatgggaatccaagagcgatgccctggagactccgggcttcctgaaccattacctgatgaaaaacccaatggtccatacccttacactctgaagttgtgtttctccaccgctcagcacgccttctaattaggtgcctaggaagagtcccatctgagcaggaaggtatttctctttcctttatgccattttttggtttttgtttttgttatttgcaaaagatcttgtattccttttttttt

SEQ ID NO: 78621 - DNA, 1237 bp, Homo sapiens
gcgagcgcgaggtgcccggtcccgactgccgcttcctcaccgtggcgcacgacgacggccgctggtcgctgcagtccgaggcgcaccggcgctccttcggcggcacggaggaccgcctgtcgtgcttcgcgcagacggtgtcccccgccgagaagtggagcgtgcacatcgccatgcaccctcaggtcaacatctaccgcgtcacccctaagcgctaggcgcacctgagcgcgccgccggccgacgagatcgcagtggaccgcgacgtgccctggggcgtcgactcgctcgtcaccctcgccttccaggagcagcgctacagcgtgcagaccgcggaccaccgcttcctgcgccatgacaggcgcctggtggcgcgccccgagccggccactggctacacgctgcagttccgctccggcaatgtggccttccgcgactgcgagggccgttacctggcgccgtcggggcccagcggcacgctcaaggcgggcaaggccaccaaggtgggcaaggacgagctctttgccctggagcagagctgcgcccaggtcgtgctgcaggcggccaacgggaggaatgtgtccacgcgccagggtatggacctgtctgccaatccggacgaggagaccgaccaggagaccttccagctggagatcgaccgcgacaacaacaagtgtgccttctgtacccacaggggcaagtactggacgctgacggccactgggggcgtgcagtccaccgcctccaccaagaatgccagctgctacttcgacattgagcggcgtgaccggcgcatcacactgcgggcgtccaatggcaagtttgtgacatctaagaagaatgggcagctggccgcctcggtggagacagcaggggactcagagctcttcctcatgaagttcatcaaccgcgccatcaccgtgttgcgcggggagcacggctttatcggctgccgcaaggtcggggcaccctggacgccaaccgctgcagctatgacgtcttccagctggagttcaacaatggtacctacaacatcaaagactccacaggcaaatactggacggtgggcagtgactccgcggtcaccagcagcggcgacactcctgtggacttcttcttcgagttctgcgactacaacaaggaggccatcaagatggacgggcgctacctgaagggcgaccacgcaggggtcctaagggcctccgcggagaccgtgcaccccgcctcgctctgggag

SEQ ID NO: 78622 - DNA, 1044 bp, Homo sapiens
agagattccagttacactacacgcccagggctcccagcccccaaccgtcccttagccgcttccagagaaataaggctcagagccgtctgaggtcagaagaaagaggtgccagactcgccccgtggcagacaagagggcaggggcatctgaaatccctcccagggccaggccgcagccgctgacccgaggggagtagggaaccagggcggaggggagactgggaagtccataggggcgacaggtgggggcaccgttttctctggggtttccagtttgaaaggcaagggggcttgcctcccgcccgggggagcccacctggaggagaaggggttagcagggagggttggaaggagccgccacgtgggcaggaaccgggaagggcgggcgggccctagtactcccagagcgaggcggggtgcacggtctccgcggaggcccttaggacccctgcgtggtcgcccttcaggtagcgcccgtccatcttgatggcctccttgttgtagtcgcagaactcgaagaagaagtccacaggagtgtcgccgctgctggtgaccgcggagtcactgcccaccgtccagtatttgcctgtggagtctttgatgttgtaggtaccattgttgaactccagctggaagacgtcatagctgcagcggttggcgtccagggtgccccgaccttgcggcagccgataaagccgtgctccccgcgcaacacggtgatggcgcggttgatgaacttcatgaggaagagctctgagtcccctgctgtctccaccgaggcggccagctgcccattcttcttagatgtcacaaacttgccattggacgcccgcagtgtgatgcgccggtcacgccgctcaatgtcgaagtagcagctggcattcttggtggaggcggtggactgcacgcccccagtggccgtcagcgtccagtacttgcccctgtgggtacagaaggcacacttgttgttgtcgcggtcgatctccagctggaaggtctcctggtcggtctcctcgtccggattggcagacaggtccataccctg

SEQ ID NO: 78623 - DNA, 1060 bp, Homo sapiens
atcgtattgaagtttgttatttatagaaatgcagaagtttgggctctgctccaaacctattaaatctaaatctacattgcaacaaagtccccaggtgattcacaggcactttgtagtttgagaagcactgtactaagattactgtgttgtcttcacatgaatgaggctataatgtagaattaccagtgaatgtgactaatgttttctgacaagggacctctgcttacaaggtccctgggcatggtgcccagaactggaaaaaaaaaaaaaaaaaaggaaatgtttatatgtatgtgtagaggggaaaattgcccactagttctctatttcccattttgatcatctgctagagtatctaaaggggaggggagcatttaccccagaatgtctcctctagtgcatccacctatgggcctggccatgtccaaggaatctttgaagaaacaagcaagaactgcacactaccattgaaatccttctggtcctgacattttgaaggaatgattgcttcatagggaaattaaacccagaaagtcaagtcagttatatttttgagtgactagtgtttgctcagctctaccaggctgtgttgaatatggtacagactctcattttatgatgtatcctactgcatcaggacatttgtgtcaatgtcaggtgatgaggggaaatgaaagtgatgagacgatgagaggagtgaaataccaaggacgcgatactaggaaacccaggtctatttgttatcagagtaaggatcaagccagatagcctgttatgtaatttctccgataaaagattttgaaagcaggtgctgtgggcatctgtatggggaatcgcactcatagaattattttcatttgtaaatatttggtatcaggccaagcaagggaaagaagctttactgtattaccatctttcctggaaaagattgatttttctctctcccttaggggatatgaggtatgatacctgcaaccaaaataagctggctgttaagtgctctctccttaactattgtccaagcaatgtacatcactcttgcctagatgagtgaccatac

SEQ ID NO: 78624 - DNA, 1069 bp, Homo sapiens
taaattatttctaacttcatgctctttaaataacttttcactttgagattgaatcctccttttttggggtatgttttttaccttaatgattttctaaattgttcctatcataagaaaggataagactttataagcattttattaataactataaataggaaagttgttaatctctattttagggtggtttaaaaagaagtgcaaattctgtattttcttgatttgctttactaccttacctacacttatagagcagtgtttcttagattgttgtcagaagctacagaagaatcagctcattccacccagaccttctgaatctgaatctatagggctggagcctaggtacctgcaatttaacagtctaccccagatgattctgatagacaccaaaatcttaaaaagagcatttgaatattcaccctcttgactcatagtatatgtgttaaataaaagtaaatgttagcctcttactttttagaaaaatataagtaggacaaagagtgttaatattttctttctgaattatcttaagaactgtctttggagcatacacagtcttagaaactgctgtttcagactgtgttgacttttctctctagtcaaataattacttatcttgtactaattcttttatattagatagtaaactaaaacccatacttaacttaccagcccaaaattatattaaaagctggcaactcttagctcttctagtctctaacctttctaaatttcaatggaatcactattcttcatgaagtctttttttttttttaatgggagtcacgtggccagcaggcagagcgtgctgacctgggccccctttttattaattctatttaagtctttttttaacattcatgaagtcttcattggactcttcacacttgcattttatgtcctcttactgttaggtcttccagaccctaattgtgcttattcataagattaagaaatgggtttatgttgaagtgttaccttctagggttgttttactagatacttaacgttcttttttccttcttctagaatggagagagaccatctcatgaagtacaaataataa

SEQ ID NO: 78625 - DNA, 1017 bp, Homo sapiens
tctatcaggtaagaaaaaataggaagcttataagtttattttgcatttgctggctgacatatgcctaaatcagtgatacttaaccatttggccgttgagaaaaggaaagttggaaccccaccttacacatagcatatgaaaaatcgatttcagattgattaaaaatacatgcactaaagaaactaaacaaactagaaactactagaagaaaatattaatgaatatacagtgttggagtgagaaaggtcttcctaagcttgttacaaaagcagaaatcataaagaaaaatagcgattggagaaaagatttattttcagtatttaaaatttatttcaatatttaacaaacaagttgaattctgaatatatttatagaactcataaattgttttaaaaaatcaagactaacaggaaaatatgaatatgcaattcatattttataacaagtataaatcactgaattacattttcacttctataacaatgctcagtgttgggataggtttggggaaactttattctcatacaatgctagtaggaaaataatttggtggacaaattgtcagcatgtatgaaaagcaatgttctcacatctaggaatttatcctaaaaaaataattgggcaagtttggaaagacttgtatgcttcatgttcatcactgcaaattattctggaaatgagaaacaacccaaatatctgtcagtagggattaattgcattattacatattccatataaaagaaatactagatagccactaagaatgataacattgtatttactaacaggaagaatgtttatgctatattaagtggaaaaaagttgcaaagtatatctacagtatctcattttaaaaaggagctgcaatacatacatatagaaatacatacagataatctatacaaaatgacctggcagcatatacatcaaaatatagtctttggttggtagcatttggggttattttaatttttttctttttttctctctctctttacagcaaaatatccaatatag

SEQ ID NO: 78626 - DNA, 1086 bp, Homo sapiens
gggttccaggagatgcctcatatacctgtgaaactgcaggctatttcttcttataccaggtaagatattaagggtttttgaatcatacttcatcataatatgaaccccagttggaagctggaatgagttcttgtgatccttcatgaaagcttatttttttgagtagattagaatgtatggtattgcaagtgctatatttatgaatgttaagtgtattttgtattatcttcagttttcttttctaaataactttgcttgatgactcattctgtgaaagaccaatgttgctactttttacatttttttctttctattggcaaagttctagtcactcttttttctttttttactgtagaaatacaactaaataaatattctagctagccagtggcaacaaagtacagttaacttttattgtatacattaatcaactaatgaaggaaaacattcttccttcaaatttccagaaataaattatgtcttacaactaattgcacagtgggtcttgaagttaaaggcttctgacttcaacataaagatgtacttttacttttgttagggtaaattttggaagtgtgaaaaccaatgagaaatagccaaataaagtgaataaaactaaactttaatagtcagttggattattaataattttaaatggactaggacataattggctaatgaagatttttgtataacttcatttgttctctttgttctaatgccaattgtatattttagatataaattataatattgtaagctcattgtaagtggatatcacaaaccaattaagtccattcaaaatgagcagctttcatggtttcttgtgaagcagggaaaatacataatatagtctacattagattcaagactgtttaggacttgcataaaggagtaaagatcagcttaaatgcttttttgacacaaaattacttggctttcagtgaaaataatgtttaaaagtgggaaaaataacctataaattaagaaggtttatgtaataaatttgggaagaatgaacttgaggcttcacagtgtaaattggcagttttcaacatttaagaatcatatcaggaaagttgttta

SEQ ID NO: 78627 - DNA, 2783 bp, Homo sapiens
acattgagagatatataaaagcaatcttttatttctactggagagggtcaatgtgaaaaagctaagactatttggatatatggttagatatttggattaaattaaattgctattttttccttctacactaaactagaacttttacttggagattataagcattaacccttactgggagcatttttcttcatttagtagaatgaatattcctgaaagactaaggtctaaagtgcattgatactggattaaatttcaaatccatgtgaaatgtacacctgtattacatgaagggactgtattctactttagtcattctgaagctgtcagaaatgagggaagaacaagtaacatttattagatctggtataaaatgagacaggcaactctgagaacatcctgaagcatattatgaaatttgcatggtagtcaaaacctctgaaagttttttctcggagtttatgttaacagtggtgacttcagttgaccagtctttgagttggtatatacagaagcactgtgtttttggaatgccaaatatcagttactctggtgatcattaacttttaatttgtaaagttttaaaaataatactcttcagttcatttgcctgacatatttttatatattttgaagtttataaatagtaaacttatccaatatactgaatatatgttatacataattatataataacatattacataacatattggacataatgcatctaatatactgaatttgtgggagttgaagggggatcaatttggactttgtcttgataaaagaaacaaattatgaaaagaagtttttttcttctgtttataaaatttgttctgtaaaaacctattgtaaattcttaaaatgaacagaataattcatgtgttgttttaacatattttttactgttttgtcataccttgatatggctttctacagttatcctctactttatgattgatttgtatagcacaatcattgaaaagattaatttgcaaaaatagacacataattcactgcttgctaaacacctgccttggttttttgaaattcaaatcatttcccttgatgcccatcgaattgattgttttccttcagttaactgttttgtttgccagatcttcatttgcatgtataattcaagtagttcttcaaaatcactgtaattcacaatgaaatcatgtagttttttctgggattatagtgtgcaagtttgtgggggttttgttttttgtttttacttttattcaatctatgtggttcttgagtttgaatagtgaaggtttggatagtgagtaacaccatgtaatctgctctgttgggtactgagttttggatgatgagtatcaagagtttggatagtgggggatttttctgaaaatttatgttaaatctcttcagtttcagagctcagattgctagaattttgatggtaaaggatatctgtatctacattatataacctaggtgtttataagactggatgctgacttcacaggcagggttggactagtgaaagtgagatgtttgaatggcggcttatttttaaatagtaccttaattagtgagtctttccatactatgaaacttttgcctttctgtaaaaccttgtaactgcggaagttcagataatgaatactaggattcgagggaaccctaattatgaacatttcacagatagaaagtagtgacttttaaatgactttcatcagaatagtttgcaataaatgagtgctctgctctttattatattgagaacattagactttcagactaagatttgaaagatgcaatttatgtttccaccttctggtcctcttaatgtattctaccaacacactcactgccttcttattgtctttctccaactgcaaaaactttttcagttctctgtaacccaaggaaatgctgttgaatgaaatgaaactcagtgtggttgtttattttaggagttgttacaactcggaagaaatagcatctgagccaatgcctttctcgtttcataaattaaaagcagatgtttaataggtgggtggttttatggtttctagttatccatacagccaaatagacatagatggcaatatcagaaatcaatataaatactatttgattaaattataaatggcctaatataaggctgatttccttctgtgtttcaactttgattctttctaaatgttagtttttgctacgtttaaaggtgccgtcacccttcttgctttattgtctaggccctaaaccagttgtttgagaaaatcatggcattagacattgatgagcgccacctactgcgtcttggtcatggagaagaagagctggagacagagaaagatttcagcaggtgagcaaatgggagtgagtaacagtgtaaaaaaggattttttattttcttttcatttcttttattaaagaagaagaaagcaatgaatactgaaacttaattctgaaaggttctaacttaacttactaagactatatgttgagctagaaatatggtcatgatgtccctcagttccagttgtgtatggttatgccattttgtcttcaaatatacaattatgttaatgaagagaatgatcttgttaatctttttaacagattgccttttgctttctatttattgaggtaatttttcatgctgccagttcaaaactgtacaactttaaatgattcctttttcacatcttattcaggaatttaatttgcatatattttaggtgccaattaggaggttgatttatttattgaaatagaaattacgggaggctgacgcaggagaatcg

SEQ ID NO: 78628 - DNA, 1024 bp, Homo sapiens
aagatattttacctggagatagaattgtgggttgatagttcttccttttagcactttaaatgttattacacttccttctgacttccatgttttctgatgacaaatccaaagtcattttaaacatctttttgtaatatgtaatgcatcatttttctgtggttgctatcaggacttttttttttctttgctttttgtttttaaccatttaattgtggtatatctgggcttggatttctttggggttattctgttggggttcactgagctgcttgaatctgtagatttatgtcttttgccatatttaggaaattttcagccatgatttttctaaaattttgtctatgccatactctttttcctttctgtcttagaatttgttgacatgagtgttagacttgttaatgttctatagattcatgagtctctatttttttaatctttttttctgttattcaggttgtgtagcttactgatctatctcaaagttcaccaactcttcttctatcctgttcattctgttattgggcccatctactgaatttgttaattttatctttcaggtctgtacttcacgttttctaacaatgtgtgataactgtgatgacttagtagtttgctatgtgttcatcttctttttaggttgtgggcccacctggtacaggcaaaacagatgtggcagttcagatcatatccaacatctaccacaacttcccagaacagaggactctaattgttactcattccaatcaggtaaatgactgtgtgtgtgtgtgtgtgtgtgtgtgtgtgtgtgtgtgtgtgtgtgcacgcatgcgcatgcacatgggtatgcaggttaggggttgagggggaggtaagtgtgggacacaataagttcctcttcaagaaatctagtttcattattctttgttctccatttttctgagcctggcctacctgttccctaatatattctggcatgcctaagtctcagctggtttgtggctcacattccttcccttatttgggaatgcattagctcctg

SEQ ID NO: 78629 - DNA, 1023 bp, Homo sapiens
ataaaacactttacaatgcacatgagataatatttaatgtttctttaaattctcccgtaattctccgttaactgggtgacttttttaaatttgaaaactcccaacacacgttagggcttgtaactcgaccattttcagagtttacatacagatatcgttcctttaagccagaaatgtttcttactcctctgattatcgtgcatacaatgtcatgcaccagataggtactcagtaaatccttgttaattgcaaaaatgaacagaagttttggtcttgtaggataacttttccagtaagaagtggaaaagggaagaaaaggaaagatgcggatgtggaagatgaagacaccgaggaagcaaaaaccttaattgttgagccccatgttattcctaataggggtccttatccttataatcaacccaaacggtaattttactacctattataattgtaatgatgaacaatagtttgccatttcaactggattaggaatgtttttaaattttctgtttcttttaaaactccacaaaactcctgtttctgaaccctctttctttctattctgtcagtcagctgaataactgacattttaggccattctgtagtcataatatttcaaaaagaaacattttcaggtactatgagaaataaatgttagaggtctaccttaatttgagcaaagggttcttacttcatgagcctgtgttacatatagcagtagccctaatgcatgtgtgccataactagtaaattggcattatatttagtattagaatggaaactagaactttggcactccaaatgaggtctgggatgggctaagtcccgaaaaataactataattccattttaattgtctgtgttgaggggtagaggtgaagggagtcattcagaagagattgagagaactggggtaaatacagagcagatatttagaccactggtcattgttgtctaaatttgtattatacaaagcatcatttatctgtaccaactttttatttactcttatttgcagtaata

SEQ ID NO: 78630 - DNA, 1051 bp, Homo sapiens
ccctgaattccttcatatggattagtggtaaggcactgagtatacctatgggtggtagcccacagattactttcttgcctagaaattagaaaacacacagctttcaactgtatatatatatatatataataataggccaggtgtggtggctcatacctgtaatcccaacactttgggaggtgaagttgggaggattgcttgaggccaggaattccagaccaccctgggcaactgagacctcatctctattaaaaaaaaaaaaattagcaagattggtgtgtgcctacagtcccagctattcgggaagctgaggtgggaggatcacgtgaacccaggagtgtgaggctgcagtgagctatgatcacaccactgcactctagcctgggtgagacagagcgagactctatcccaaaataataattaattctacattttaaatatacgtatcctttatacacccaaacctagtctccctccatactttcctaatcctatttatggcaaagacatttttctactcctgcatcttgaaatctcagcattatttttgaatctttttactcccataaaactcctgctatatctcagagattctgccttgaggatagttttttggattttttttttgtttttgagatggagtcttgctctgtcgcccaggctggagtgcagtggcgcgccgtctctgctcactgcaagctccgactcccgggttcacgtcagtctcctgcctcagcctccggagtagctgggactgcaggcgcccgccaccacgcctggcaattttttttttgtatttttggtagagacagggtttcaccgtgttagccaggatggtctcgatctgctgacctcgtgatccacccaccttggcctcccaaagtgctgggattacaggcgtgagccaccgcgcccggccaaggatagttttttcgctctgtcacccgggctggagtgcagtggctccatcttggctcactgcaagctctgcctcccgggttcacgccattctcctgcctcagcctcctgagtagctgggactacaggcgcc

SEQ ID NO: 78631 - DNA, 1465 bp, Homo sapiens
aatgtgcttctggttgtgggtgactttagcattaaagaactatggaatataaagagggaaaaattccaggagttactgagaggaagtattttctttaagggtttgttctatattgttttttttactgctgtgtccacctgagtctggttttcatcctactcaataggagtcaaatggtaaatttatttatgtcattctgtctaagcgaactcttaacggataaactgttcttgctaagtttggtcttttgtttaactcagtgtgtggtatcagctgaaaatatagctgttgattcagtctagccaagcacctgtcagccagcggaaaatagcttcttgctctgaaacactcgggaattctggattagtgcagccagctctgcattccagtaagtgcaaatgttggagatgtcatactgacacaatctttttctgtccttttactgacaggctgtgctggagactattcggaacctgatgaatactgattgtgtggtacctgactggctgcacgatatcattttaggttatggggacccaagtagtgcacattattcgaaaatgcccaatcagattgccacccttgatttcaatgatacatttctctccattgagcatttaaaagccagcttccctggtcataatgttaaagtaactgtagaagaccctgctctacaaataccccctttcaggtaaagtcagaactgggtacgctcctctccagcattctgtagtcaatgtacgttatgccatcaggattgttagctaaagtgagttttgagtactatatttggattttgttttagcagtccctaccttcaccatacaatcactgggataactttattatatttgaatctatttcttactgcagaagttgttttaagaccacagtaaaagtagtctaatacctaataagggatcaataaatacttattgtctgaagagaactatataaatatatttatagcatttgactaaaatatgtcttggcagttatgcatagtctggtatgtttctcaactaatgcagctgtgtgatgttgaactttgtttttaggaaaaaaatctttttttcttttaactttgcgtgctttcacaaatttgaaatgttcataatatagctgggtatgatggctcatgcatataatcccagtgacttcagaggctaaggcgggaggactgcttgaggccacgaattcaaaaccagcctgggcaacatagcgagaccccatctctaaaaaaattcaaaaaagtagctgggcatggtggcgcacacctgtaatttcaggaactcaggaggctgaggcaggaggattgtgtgaacccaggcgtttaagtctgtagtaagctatggttgtgccactgtactccagcctgggtgacagaggaagacctcatctctaaataaataaaataaatacaatagtcatatttaatcttaaattaggtctggtcttaaaattt

SEQ ID NO: 78632 - DNA, 1054 bp, Homo sapiens
gaggaaataggagaagggaatggaaaatggatggaataagcataaggccacataatggaaccaaagttcgaggtctaagacccccccttccccccaccccccccaaaaaagaggagatatgtcagagaggaaagaaaaggctctgggctttcaaccattagtatcctacatttctgtgtatgtgaaatttcttttcatgctggttatactaggtatggaatgtggaaggatgagaaaagtgatgaacctctgtcaaattaaggaattaatgaatagaaaactatgccttaaattctaaaatacatatatttaattagaaaatatttattgaatacttactatatgtaaggcagtagtgggagctatgagtgacaaaagtaaagataagttctttgacttctaagtactcctattttagttgagtgtgtgtacaaattattgcaagtcatggtgttgcatcgtaaacattacatgactgctatggaaggaaatagtaagaatttagagaaagaagaaaatactttcagcatcttagaatttgaagtgggtgagtggagggcattctactttgggaagaatggttggagttaagcctgaaccatttactcaccatttctagaaaagaaatactgttaacttattttgatatttgaaaaatacatattttatttaacaaactttttcaaattgtccaggacctgaacccagacccaatcttagaggagaatcaaggacatttagagtgtttttggatccaaaccagtatcaacaagatatgaccaatactatacaaaatggagcagaggatgtgtatgaaacttttaatataataatgaggagaaaaccaaaggaaaataactttaaggtaatttgggggtatgtaactaaaagtactatgtcataatttaagtaacttttatgacataaatacagagatatttggttagaggaagatttgttaagaaaaaaataatgactgcttttatttttactataagcaatcctcttaaacttttaacaaaatgatgaaatataaaaatttaaagaaattgat

SEQ ID NO: 78633 - DNA, 1050 bp, Homo sapiens
cactgatagatagtttaaactgatattaaaaacctgctaaatatgctatagatggattatatgccagccatatttttggttacttattaagattgttaaaaataagaatgatgacgaacatccaattttggagctgtagcatgacttggagggcttattcagtaatatattcatggcatgaatgtttctaattttaatataaagaagttttcatttcaattaatgctatgaaatattgagtattaaagattatagaaaagcccataattgtgttacaatgcgataataatcattggtcactcaacggtatctctctaccaaagataagaggtagagaggcaaataagaatttgcctacaaaagactgaaaacaatgaaattctaataaatgaaaatgtctttatatcttaccaggtcttcgtaagcatgatgtatgctttttaattaccgtacgtcccacaaaaccttatggcactaagtttgaccggaggagaccttttattgagcaggttggcctggtttatgtcagaggctgtgaaattcagggcatgctggatgataaaggacgtgtcattgaagatggtatggtgacctatatttttgaaagagtatgtgtatagaatgataaatttctttgcctttttccctttttgcttcttaggtaatattttttagttcttttacctactaaattgacacaaaggattttgtatcaaatatgtgtagggtacctaccgtgcagttttagatataggtaacatggtttctcactgtgtcacacaggctggagttcagtggcacaatctcggctcactgcaacctctgcctcctgggttcatgcgattctccagcctcagccctgctagtagctgggaccataggcacgtgcgaccatgcccggttaatttttgtagagatggggtttccccatgttgcccaggctggtctcaaactcctgagatcaagcactccacttgcctcggcctcccaaagtgctgggattacagacatgagccgccaccacacccagacagtttcagaacttctatg

SEQ ID NO: 78634 - DNA, 1065 bp, Homo sapiens
tgattagaagttaatatccaaaatatgtaaggaactcataatactcaatagcagaagaccaaataacccaataaaaaatgggtgaaggacttcaatactattttttgtaggaagacatacaaatgacagatagatgaaaaggtgttccacatcacaaatcatcaagggaatgcataccaaaaccacaatgagatattcaaacctcacacctgttagaatggctgttatcaaaagtcaaaagataacaagtgtttgcaaggatgtggagaaaagggaactcttatacactattggtgggaatgtcaattagtgcagccattatggaaagcagtatggaggttcctcaaaaaattaaaaaacagagctatcatatgatccagcaaacccacttctgaatgtttatccaaaggaaataaaatcactgtcccaaagagatgtctgcactcttgtgttcattgcagcattattcacaataaccaagatgtggaaacaacttaagggctgaatggataaagaaaatgtgaaaatgtggtgtgtgtgtacatatataaaaacacacaatgggatatgattcaccttttaaaaagaaggaaatcctttttttgacaacatggataaaccaggagtacattatgctaaatgtattaagccagatacagatagacaaaaactgattatctcactttacatatggaatctaaaaaaggcaaattcatagaagcagtagaagggcagttatcaggttgtaggtggggaaaatggggtcatgttggtcaaagggtctaaactttcagttacaagatacataagtttggagatctaatgtaaagtatagtgactataattaatgttttatgtacttgaaacttgacaggatagatcttaagtattcttaccacacacacaaaaaatgctaactgtgttggtaatgatatcacagtgtatacatagtttaaaacatcacattgtattccttaactatatacaatttttatttgtcaagtatacgtcaataaagctgaaataaaactaagtgtgctggattatttatttctttgataaaat

SEQ ID NO: 78635 - DNA, 2407 bp, Homo sapiens
ctcacccctaattcttaatagccaacatttattaatctggttttaacatctgtgtgaaaacaaaaataagttgttatcagatatgctgcatttcaggcattcattagattcttatagttttgaggtgccagttttttaatacagagaacaaatatctgattaaaagaataattcaggccgggtgcggtggctcacgcctgtaatctcagcactttgggaggccaaggtgggcagatcacaaggtcaggagttcgagaccagcctggccaacatagtgaaaccctgtctctactaaaaacacaaaaaattagccaggcatggtggcaggtgcctgtaatcccagctactcaggaggctgaggcaggagaatggcttgaatctgggaggcggaggttgcagtgagacgagattgtgcaggtgacagagtgagactccgtctcaaaaaaaaaaaaaaattgaaatatggatgtttttttccttttcaggttgtcttgctcttcccaaattgaatttgcagtttttgactcttcatgactacctgctaaggaactttaacctcttccgcttagaatcaacttatgaaattcgtcaggacattgaagatagtgtcagcagaatgaagccatggttagtaaattggttccacctgtaatgaagagatgcaaacagtgactgataaacttctgtcagaaaccttataagtatatttagaaataatatactgagacaaaagtgccctctaaaataggagatatttactctttgagacatttttaaatgtgaattaacatacatcaaaagtgctaaaatataaaccacatatctgggtacttgggaatgggagtgggagactggggataagggagaagaagtcgtcatgctcaagaagggaagggggaaatgtagagggagtaggtcagaccttacttaaaggccgattggaaggctaggggttggccaagcaggcccgtactaggtcagaacagtttaagtcctggaggaagcttatgataaaggggtgtaccattaatccacctactcttgtcactgttgccacagtattctcaggcagcctctctaggggaatggacagaggattagggctgttgctgcacattgcccggggtggtacattagaaaatctctgtctctctacccatagattctgtggaagaaagtaaatcaccaggatttacttttagggccagttgagttggtcttgttatttgaggaattcttctgcataaactccactccccacctgctagctcatgtctgaaattcctttagctaagaaaagtctttcattctggtaattgtagcagctctgcattacaagaatttgtaaggttaatttggttttatagatatggctgacttgaggcaaatgctctttattcactatttcattcacaatttcatcaagtatgaaattgatggatgtaagttatacatcacaagtgattataaatgagtaaaatactatgagatggatttttattacattatataataggacaccatgtatacatacacgattatactgcattttatgtgaaaagctgaacagctttggaatgtgaactgattcaggtatcttccaggcttctgcttactaattatggagagctaccacagacactgtgattatgatctattttttcacttccatgttttatttcatagagagttctattttttaattaattgttatgtgaaaagttattctgggtgagactataaaatacaacacaaagcatttttgacttaataatcagttgagtcagtaggcaggcaaacactgtgaaatttgtatacccactggctgatcattcctgcccacagctttgctgaaattgttgcccattgtttgcaccctaggggagtgcttgatcagaaaacttctttacaatttatggttaccttgagtttatatgctcagattctgggcctaattttggccattttgcagactagcgatttattaactggcagttcaacaaatagaattcatttatattttacttaaatgccaagtgcaacaaaaatactttgagttcttttggtctgttaataaaaaaaattttttttaattataccattttctggctggggaagaaaatgtcacttcttggagttaattcattcacactggtaataatagatttttctaaatttacatttttaatgcccatcattgaaaattattaaaaatgtcgaaacctaaaagggggccaggcttctttctgtttcatgtatcttgaagatgaaaaccagcagaggcatttttactcattacatggttccaatgattatgttttcagggtgctgaagcccactaaccagcagtaagagaggatgtgcttaagggccagaaatctatactttttaatgcttcaagtagatt

SEQ ID NO: 78636 - DNA, 1027 bp, Homo sapiens
ggttcgaatggatttaatttaaaaattgctcctttaaattgttattttaaatgactgtatatgtatgtctcagaaaaccagggttccagttctaaccaaccattctagctttacacctttatcaggtcattttctctgatcatgtttttctacctagaaaatgaagatctagaatagatgctctcaaaggtcttttccagctaataatttctatacttctgttatttcagggtttggattatgggcatatgctagctgaaaaagttccagttaacatttctgtatatattaatcacaaaagtattcacatttcttgctttacattaagctttccgttttcctgtacactacaaataaataaatggatttttatgtaagcatttgtaggatgccttctatagatctggcactgggtgttagtcactgctgtaagtttttaaactaagtagcaacaggaaacctaaaattatctttgttttaattgaaaccaacttgacaggatggttttagttggcaaaatggtagaccatttcctggcattagaaaaaaagcttttactctgaaaatatttcatgccccaaggttgtaattatttaaaaacaaaaataaatgtttgtaaaaatagtatactatgctcataaatagtatataataagctagtgatttaaaaggtatttttattgttctttgtgtcattggcattctaatgttaaagtaatacatgtacagtggaaaaaaataataaaaattacctctctaattttcagtgcactttaaaggtgtgtgtgtgtacatatacgtatgtgtgtgtttatacatacgagaaaactctcagaagtttagaatgtaaagacaataaggaaagtgaagcaaaacctgatataaaactgccttctagtttttatatctctaagttttttcaaaatctaatttaatacagatttttaaaggttaatacttttaaaatatctttgcaaacctgatttttaaaatgtgcttttgacccaagctagatcttttattttct

SEQ ID NO: 78637 - DNA, 1045 bp, Homo sapiens
ttataagcaccagttgatggggatgaaaacataaggcacgtataaataattaatactaagttaaaaagtggcaagtgctataagagagaatatgctgatgtggacatttccttatttacttgtgatcgctgttttttgtgcattgtttcagactcatatttttcaaaccttagtgattatgctaagtgttgatgcatatatttttcagacttagctctttaagttttgaaataaaaaattaattgattattgagcttacaatcttgatttgtatttttattaacaagagctagagttgaataattttttaaaatatcgttattcatttcttaattttcagggtttgtcatgttattttcaggttttatcagattgctctattttgtactcatatattagaaaactagcaaatagttgatctaatccttatccttgtaaactttgaggctactggtaatttaataacacatctcttcttcaggcacgattggaattagaattaaaaaagacacctaagctaagaaaattctggaacttgattaaaaagaatgatgaaaagatggatccagaagcaagagaacagtatgttggcagagcttcatttcatgttggcttattatgctggattgtggaccttagatgatgttgactggtttgttgtttccctttatatagtgctgagtgcaaataaattattataataagtgcttttacctagactgtcattaagaatattttccacaaagatctaaagcagaagccagagcatcatgcttttcttcttttccttctttctgtgctgctaagtatatatagttgacccactgtttttctccctgcctattgtccgtctccctcatggatggttctcaattttctccactatcttcaggctattaatataacttctctttctttttcttactccttcactctttttttatttttttgagacggagtttcgctcttgttgcccaggctggagtgcaatagtgcgactgtggctcactgcaacctctgcctcccagattcaagcgatttctct

SEQ ID NO: 78638 - DNA, 1024 bp, Homo sapiens
tgtgtggttagctgataaatacacatatttatttagtgcctctgaattgataattcacttacacccatgcaggaggaatgcatggagttctttcttattctgaagactgagtgttaatagatggatgattattacctgtttccatgtactatctcacatggatcttttaaaggcataaaaaaagatttatgatgcctgcactggataccactgttatctctttaacatttatttttatttatttatttatttatttatttatttatttattttgaacataaactcaagattttattgtcttcataataaaagatgacacttagaactgaatcacttggccctttctcttcttatctcctcccagttcaaaatgcttgcatcttttaatagccagcattctcttagatctgcagttgggctcaatgcactcaagccttagcacaatctttgtagttttagcctttttccagaaaattggcttagtttgcccaccatagccactctgcttcctgtcataacgccgctttccctgggcatacagagaatccttgcccttcttgtactgtgtcactttatggggttggtgcttgccacacttcttacagaaagtccggcgggttttagggacgttaaccatgcttgcgtgagcgttatcggcacagaaagcctctttaacatttattaaactaaacagaacaaatagaaatataaatagatgtgatttttttatcagaaactaaacagaaacaagattttattagtattagtaatttggtgatagttttagccaacttaccaaactagtttattattgaaatgctttatcttttaaaatatgcagtcagttcttatttgaggtagttatgttcattttataaagtagctatgaacattgaatgagctaatgctgaaccattactccttggggaaatacagggttaggttcctgcaagccttggtcatgacattttacaaactatcaatacatagccttattttatgtgtgtttctatttaaagacagc

SEQ ID NO: 78639 - DNA, 1137 bp, Homo sapiens
acaaaacatttgccaggtgtggtggcacgtgactgtaatcccagctactcaagagtctgaggcacaagaattgcttgagcctgggaggcggaggttgcagtgtaccgagatcgtgccactgcactctagtgtgggcgatggagcaagactctgtctcagtaaaaaagaaaaaaataaacaaaatgtttaaaagacattgtcaaagtaacactgagtcattactagaacactggtattctatcttatgagccaggattttctgtcttttatcatgaggtcctatttgtgactgaagaaatttaatgtagagttttgtgtatagtgggcagtgagtgaattctgttgtctaacatacagttaattcaagtgaaatgtctgcagttggagatttagagtgtgtcactcaagatggcctatccacttagcatcttggctgcctgtagaagccagtactttggcaatattctgtcttttgcatagtaaaaaccttcatttcattctcactaaagttttgtgacattgcatgctcagtgaaactatgtaagagatcagaaatcagtggaataggatttttgacaggatagtggtttcctggggcattataaattcataatacatgtatttttaattttcaaagctggaaacaattatctagtgacagtgttctgatctatttccaatattataaaacgataaagctaaattagtggccatttgtgtctgcttcgggacagcgtaagtatgtttgggacaaacatgactatatcattgtttattcatataaaacaaagtaattctatttaaaaaagacagtatattaaagacaaatatctgatatttcctccacaatattttagtattttaagctcactgtcaacactaagaagcaagtgaaacgtctgattttcacatttgcaatatagatatgtgtcctgcgtgcttttaggaaggcatgactctagcaaagtgtttccatttgagtattaaatgaaaacatgttggtcagtgcttaagaagttgaactgacattagaagttgtgatctgatattatgaattttgatagatgggttaatatggaaacaaaacatccctaaatgcatttgtgttaataactctgaaacgtttgtattctctat

SEQ ID NO: 78640 - DNA, 1056 bp, Homo sapiens
ccctagaagttgggattacaggtgcccgccaccacgcctagctaattttttgtatttttagtagagacggggtttcgccatgttggccaggctggtctctaactcctgacctcaggtaatctgtatgcctcggcctcccaaagtgctgggattacagacgtgagccactgtgcctggcgtagctggcttcttttgttcactgttattacttgttgttttaatcatctgcttaacagatctggaagtaggtagctcagaagttaataatgtcaaggcccttgtcaatcttgtcaaaaggttttattgattttttccgtatggttgtggtggggctgccacagctccagacctcgtatttcacatagtcgtctgaaaagaggaggttgttgggataggggggaatgtaatagaaaagaactctcatttgtgtggccccttctctttttcttatcatatttaatgatacagtaatagatccagtttatcatacataaattattcaactttggaaggatttaatgaaatgcacgttaagtccttggcacagtgtcaggcataatgcatgctctcagtaaatattggtaacttaaaaaaataaccatccaaatatccttcaaattatttatatttgtgattattgtttgtaacttttcatacttattatttatttatttattattttgagacggagactcactctgtcacctgggctggagtgcagtggcgcaatctcagcccactgcaacctccgcctcctgggttcaagcaattctcctgtctcagcctcctgagtacctggaactacaggcacacaccaccacacctggctaattttttgtattttagtagagacgggattccaccgtgttgtccatgctggtctcgaacccctgagctcaggcagtccaccctccttggcctcccaaagtttaggattacaggcgtgagccaccatgcccggccttccatacttatctttaaaattcttctgacatggtgtctagttcatagacctgttttttttaatcttacaagtacactttcagttaagctgtt

SEQ ID NO: 78641 - DNA, 1008 bp, Homo sapiens
aaattctgaagctctatcatattcatttggataaagagatgtaacaattagaatttgtgtctgttatgtcttcacacttttaaattattttctctctgggttttgcaggcacacagttatgactctcaaatggagtctcataacatttatacactttaagtttaaaaaaaatcctgatcttgtgaatttttattttccctaaaaatctttataagcacatcattttaatgaatctagggctctgttttattatttgttttttctactttgctttctgttaatttcatatttcgaggaatataatgggattattttaaatatctcattatttcaatagcagtaatatttgatggctttcctaaaccaacttattttatataatctcactcattaaaaactgtcaatttagggttgaaaaaagttgttgagatattaaacatttttatatttttataacaggttattgaagatatatatgaaaaagagattgtcaaatcaaggtaggaatgaatttaaattttatacaatgtgattggggtggaccaagttggatcttggctgaacttctaaatgtgatcataacttgaaccctttttctgtttcaaactggtcgtcagggcaatggtgactagaaaaactttaggtgctgaagagtcataaattattttttgccttctaacttttggctcagattagaggtatcaaatcccatagggtttatttggatttagatggaatttgagaaaaagtaaacatgaagattttattactagtattatttctgattcaccttttaaaaatattcttaaaaagttatgaaagtaagacattattaaatttacaataatatagtatacatatgtaatgtataaaatgtataataataaacacagaagtgataaaaattatttttgagcaatatgctgtaaggggtgagtttcaataaatcatcttttctgcccccaatccctggttcatgtatatggttcatatacatctgttctattc

SEQ ID NO: 78642 - DNA, 1852 bp, Homo sapiens
caagacacctccaaatagacctatctaaaaacagagtaattctgtagtttgagagcgttcatttagaatctgtttactatcttgcattgtgagccacagttggctttggatagggaaccacagtcctgtggttgtcagcatcattcctcattcttattatttatttgtgaattgcataagagtgtaagtagttcaatgtagaagttatcatgcccacctgcttctttattctttattccttgtctcaacagatttgccagggcagaagcctagggagtgattttgaatcctccctttcccttagtccctacatttctacattctaaatatcttttgaatctatctggtgttctacatctctgtcaccctaagcttggttgccattgttttctgcctggaccaaggtatcgtaatctgttatattgtccttcctcttgctctgctctagcccattcttcatgttgctttccgagtgatttcatacaagtgcaaatctcatcatatcacttgccttcttaaaatttctgccttccggccgggcgcaggggctcacgcctgtaatcccagcactttgggaggccgaggcgggcggatcacgaggtcaggagatcgagaccatcctggctaacacggtgaaaccccgtctctactaaaaataaaaagaaaaaaaattagccgggcatggtggcaggtgcctttggtcccagctactcgggaggctgaggcaggagaatggcgtgaacccgggaggcggagcttgcagtgagccgagatcgcgccactgcactccagcctgggcaacagtgcgagactccgtctcaaaaaaaaaaaaaaatctcttccttcctttccttccttttcttctttcaagatagggtctcactatgttggctgggctccagtgagccttccacctcagcctcccttgtagctaggactacagggactacactaaggctggctgtccttaaaatcttcagccgggcgcgatggctcatgcctgtaatcccagcactttgggaggccgtggcaggtcgatcacctgaggtcgggagttcgagaccagcctgaccaacatggagaaaccctgtctctactaaaaatacaaaagtaggcaggcttggtggtgcatgcctgtaatcccagctactcgggaggctgaggcaggagaattgcttgaacccgggaggcggaggttgcaatgagccaagatcgcaccattgcactccagcctgggcaacaagagcaaaactccgtctaaaaacgaagcaaaaaaaaagaaatctttaaagaattctaattacccttaggttaacggctgaaatccttcatagtgttgtgtgatttgacctgtgcttatatcttcagtttcctctttttcctcttcctttctaactctgtgccttagctgtacagaacttcgtttatttgaatgtgccatgctatctttcatctcctggcttttcaacattgttcctctgctaggaatcctcattttttttctccccaccttcctttattcattctcagccttctacactactttagagaggcttttcctgacaacttaaacgagattagaggtctctttccccatatacctgcatttttgcagtagaagtcatttattagtttacttctgtcatggaactcacattttagagggaagaaccagacagatgaacggtatagtttcatacactgataaatgctatgaggaaaatgaaacagggctgtgacagactggtttgaggtgtatgaaagacagtcaggaaagttctctccgaggtgacatttgagctaacacctgaatgcaaagaaggagccagttttgagaagagcaaggaaatag

SEQ ID NO: 78643 - DNA, 1423 bp, Homo sapiens
ctctctaaacttgtcttcactcaaaactttatcttttctctgtttctcttcatctgtctcagaataatgttccttcatgtttctgaagctagctttttttcttgcccacttctgggaacttaatagtccctttttctggtatctagtttttctctctccaattgttctttcccctccacctaaaaacaatttcatgtgttccctattcagtaatggtgcttttggctgcaagtgacagaatacctgactcaaactgctttagcaataaggatcttaatgggcttacgtgacttgaaagtctagtgaataaataagcttcagagttgttgaatcacattgttgaactgattgtgcgtgcttctgtctgctctacctttcacaatggcatggctattttcctgtggttttaggatgctttgtaatcaatacctcatgctcccttcacagggggtagggcatggcagatagtgagtgagagagctagaaactcacacaagaccaagggacaactttcccaaaagcctatagcaaaactctcttctcatctgccagaattgcttcacaaaacacatttttctttgtttgttgttttgtttttttgtttttatgatggagtctgtgtttcgcaggctggagtgcagtggtgcgatctcggctcactgcaacctctgcctcccgggttcaagctattctcctgcctcagcctccctgagtagctgggattacaggtgcgtgccagcacacccagctaattttagtatttttagtagagatggggtttcatcacattggccaggctggtcttgaactcctgacctcaagtgatccaccggcctcagccttctaaagtgctgggattacaggtgtgagccaccgtacaggtgtgagccaccatgcccggcccacatttctgaaccaatcactgacaaggataacctggaaccggggctggaattcaacttccttttaagcacatggtttccagggagtgatacgtattactggtcaaatttgaagttgtgtttagaaagagaaatgaatggataagcaatctatgttgttctctgtacctaacttaaaaaggtgtgtttgtggggacaaacaactttagttttgttattctggatactgtcacaattgactttttttcttttatggtaagaactattgcaaatttatcttccatctacttccttcatggccttttcactcactaacttcttagccctttattattgaatacatgttttcttcaccatcctttgggagttgctctctcagtggctattgtagtggtcattgttggttgtaaccacatctccttctcccttcactgtatatcagccaagtagtcagggttagactgacctagttgcagctcagccatgggtcgtgatcagtctaaggctgtcagaatactcac

SEQ ID NO: 78644 - DNA, 1056 bp, Homo sapiens
tgttttgtgaagcaattctggcagatgagaagagagttttgctataggcttttgggaaagttgtcccttggtcttgtgtgagtttctagctctctcactcactatctgccatgccctaccccctgtgaagggagcatgaggtattgattacaaagcatcctaaaaccacaggaaaatagccatgccattgtgaaaggtagagcagacagaagcacgcacaatcagttcaacaatgtgattcaacaactctgaagcttatttattcactagactttcaagtcacgtaagcccattaagatccttattgctaaagcagtttgagtcaggtattctgtcacttgcagccaaaagcaccattactgaatagggaacacatgaaattgtttttaggtggaggggaaagaacaattggagagagaaaaactagataccagaaaaagggactattaagttcccagaagtgggcaagaaaaaaagctagcttcagaaacatgaaggaacattattctgagacagatgaagagaaacagagaaaagataaagttttgagtgaagacaagtttagagagggcatgttggacaagctttgatcacaacacagtagaaggcaaattcatcctctgaaaggatctaagtgaaattgtggatttaaggaaaacataaaagattggtaataattgctccattcattaatttcttccttcatacattcaacatatatttgagaacctaatgtttgccacagtattaagccttccctataaatgatatagattcattctgttgctttccagaagcatgtagttcagtggatctcagagtgtagtctcacaacagctaaccttagtcactaaatgcaaattttggggtcctaagagacactgaatcacgaactctgaggacgcaggccagcaatccatgcttttaacaagcccaattcacactaaagtttgaaaaccactagtttctagtggaagatcaacagagttataaacaaaaattaaggggaatacaggggatggagaacttgggtaaatcagagaggctcccggaggt

SEQ ID NO: 78645 - DNA, 1371 bp, Homo sapiens
attgctaaagaattttattttgatgcttgttaaatttttattttaattaataaggtagtcattcctgtagagggataagatgcttgtagagttgtgggtatcattccaaatagaactgttatgatttgggaaatattctttactacaaaggacttatttcataattacaaattttccttcatatttgcctttgtttataaaatcttcaggaatgacattctctagcaataaaaggaatgaaccgttatgtttctaagctgaaaagaggaacaggtgggtaattatcctgccatacttaaatatagtggaaaatcctctattgagaatgtggataaatgaacaattgtaagttttgcatcataaactgagaactttcttttgacaggggggaggcgggagggatagtaggtgggggtgatctgcttgcttcttttaccacaggtgatttttaagtaacttgggtttaatttacagagatgaaacatgacagtctgagtaaaatacccagtgatgtagaagtgtgcctgtttattatgtagatacagacatccagcaaaaacaggagaatcacatgctttaaagaacactttctcttaggtttccttgagatatgttcctccagtgcaagcaagataatggtttacagaatttgctttacacaaaacttgtcaagaactcatctgttaaaagcaaggaataactagtttatattttccaataatgttcaaggttttctccttaatatgtttgaaattattgattttggcatttttctaagcaatttatgtaattttatttgaagaaaatgttttgtataatgtttttcccagcctaaacagggagagtcctaacagtgttgtgcttgtatgattctgagactttatttgcgtaagtgatactactatactttatttttgacccatgcctttttaagctgtttcatattgaaaggtggaatattgtaaaaattttgtcaaagatgtactgtagtgctatttgaagtacctgtaacaaaacagttggccctctgtatccatgtactctgcatctgtggattaaaccaattgcagatcaaaaatattagaaaaaataaaaataatacaaataaaaatacagtataacagttatttaaatagcatttacattgcattaggtattagtctagggataaagtatacaggcggatgtgcgttggttatatacaaatatgtcattttatgtaagggacttgagtatacttggatttttggtatctgtgggttggggggacggtccaggaaccaataccccatggataccaagggacaactgtacttatttacctttattgtcattgcaagcttcttatggaaactttataggaatgaaaat

SEQ ID NO: 78646 - DNA, 1119 bp, Homo sapiens
gacatgaacagactcataatgaaaagagtccttatgcatctctttgccaagtagaatttggaaacttcaacaatctttctaatcattcaggtaataatgttaactataatgcttcccaacaatgtcaggctcctggtgttcaaaaatacgaggtctcagagtcagatcaaatgtcaggagttaaggcagagtcacaggattttattcctggtagcaccgggcaaccctgtcttcctaatgtacttttggaatcagagcaaagcaatcctttttgcagttattcagagcatcaggagaaaaatgatgtcttcctgtaccgatgcagtgtttgtgctaaaagtttccgatctccatctaaactggaaagacactacctaattcatgcagggcagaaaccatttgaatgctcagtttgtggcaaaacattcagacaggctcctcactggaagagacatcagcttactcactttaaagaacgaccacaagggaaagtggttgccttagattcggttatgtaaattgtcgcaaccactaacaattgtggtctctggtgatcttatttttaaagcctgtattatttaaaatgcatttttattgaaaggcctgcattaaactgaatggtttcacaggcatttgcttgtcctgcatagtaaggaggtagaatacatagaaaattaatacaatgttttagaaacagccaagttaattttagaggcaagaacatgatttgatgctataaagtaggcattttaatattgtaaacatatactttggctgtattgaaaaatataaatccatgatggctgtacaaataatttagcctcattcattttttaaaggaattattccttaagacatgccatctctttttagatatactcaaaagactgagaggcaaaacttggcttttagctgcagcacatagccctgttatatttgatttattttacatttcatatgaaagcataattttgtccacatgtgactcaaattgcattggtaattttttttttttttttgtaagttaaaaaaactacagagacactaaaggtgaaaatggatgagacaattatagtattattttcattggtctttttttttgagatggagtctcactct

SEQ ID NO: 78647 - DNA, 1075 bp, Homo sapiens
attgagaataactcatgttaaatttgtggctaagaaatccacctatgataagtgaaatgttctattctaagagcatatttacaatgtgctataattgaatgcaagtatatcttatttttagtattatgttttgatttgttacctttctagcccattttttaaaatgatggcaactaaatactggcaaatctacctaataatgaaataggaaaattggaattaaaatatctatttcatgttaagaaattcagcctagtcctcatttaatgtagcatctcaattagaaaaatagcttaaaattgtattgatttttagatatttcttttaaagactcatatctctgtatgtataaaattagtattattattctaaagtattacttaaaatgattattaacttgtaaacactaagtccagattctcctttgcctttaatatcttcagccaaagaacaacttaagttacttttcatatgaataaataattttaaaattaatactttttttcctttaatttttagacatctgtggaatttaagaacagtatggagctcatcagagtatatcattgaagaatatgatggctgaaaacaatttaaaaatgctaaagattcaacagtgtgtggtagccaacaaactacctagaaacaggccatatgtttgcaatatttgttttaagcactttgaaacaccatcaaaattagctaggcactatctcattcatactggtcaaaagccatttgaatgtgatgtgtgtcataaaacctttagacaactagttcatctggagaggcatcaactaactcatagtctgccttttaaatgtagtatttgtcagcgtcactttaaaaatctgaagacatttgtgaagcaccaacaacttcacaatgaaacctatcagaataatgttaaacaggtcagaagattgctggaggccaagcaagaaaagtcaatgtatggagtgtataatacttttaccacagaggaaagatgggcattacacccgtgctctaagtctgatcccatgtatagcatgaaaagaagaaagaatattcatgcatgtacaatctgtggcaa

SEQ ID NO: 78648 - DNA, 1233 bp, Homo sapiens
actaaaatacctagtggtctgctgtattacattaaggccttccccagcagcttccaaggcagcctccaagtcactggcaggagaatttggctggaagtgcatgcaggactgcagagattcctctccacagttatagaagggactgttccaggcctgattgttccaggattgggtgcaccaggtctgagtgttccaggagtggttgctccaggactggatgttctgggtctggttgctccaggttgaattgttccaggtctggttgctccacattggaaggttcccagtcgggttcaccaggcatccctggtggtaggaagagtagaggctggggtaggtaggtgctgaggccttctgcgtcacaccattgctattcttcggccagttgtttttctgccacctcttagatttcattctctggttctggaaccaggtcttcacctgtttgtagctgaggttcaggatgttggagagttcttgcatctgctggaggctgaggtatttctgtctctgaaatctatcattgagtacacacagctgggtggaagagaacacagttctggtcttctgtttcttgaccgggaccttgtcttccttttttgcgacactattctctgcagaagtgggttgtttgcctttgggactggtggaagaatcagggctgtcctgaataagcagatccatggaggaaggaagaggagagacagtctctgtgtgaggcatctcagcagaagacatttgcaaggatggatagttttcttcaggcccacaaatcacaggcataggtgaagattctttacagtcggattcttcaaagcaaggcaagctttggggacaagctggatccacactcatgttagtatagaggaagaggaggaaaaaatttaagaggtggactggaaaaaaggttaaggcagctttaagacttttctggaagatgttagagaaataggacctccagaaggaaaagtatcaagaaattgggataaagtgagttgcctgcataataacatgaggcaaccagctcagtccagcagaacgttaaaatcctggcaagatgtgctttgttaaacagatgcttgaaggcagcatgctggttaagagtcatcaccactccctaatctcaagtacccagggacacaaacactgctgaaggccgcagggacctctgcctaggaaagccagagacctttgttcacgtgtttatctactgaccttctctccactattatt

SEQ ID NO: 78649 - DNA, 1072 bp, Homo sapiens
taaaccagtcagtaacagagacaagattagaattcccatgttcttgagtctcaatctatgaagcaccctgccgtttctcatctcagttttgagttgacacacatttatttaacttagttgcatgtctgtaaaaaaaaaaaaaatattctaatgaatctttcaaggtgttctgctagctgctctgttttgaagtatatctgatgcatgatttatgtattagattgattaaaaacacgtccattacttcggggcctttggtggatttttaaaggaagaatatgacatattcaatccagcagttaagattctccacaggtctcccgcgggcgtcagcaggggcggcggcgggtgggaaatggcggagtgtccagcctccatctttggcaccgagaaagtcaactgttcatttgatttcaaaattggagcatgtcttcatggagacaggtgctcttggttgcaccataaaccgacgtttagccagaccattgccctcttgaacatttactgtaaccctcaaaacgcttcccagtcggccgacggtttgcgctgtgccctgagcgatgttgaggtgcaggaacactctgatgaattttttgaggaggtttttatagaactgggggagaagtatggggaagttgaggagatgaatgtctgtgacaacctgggagaccacctggtggggaacgtgtacttcaagcttccccgtgaggaagatgcggaaaaggctgtgattgacttgaacaaccgttggtttaacggacagccgatccacgccgagctgtcacctgtgacggacttcaggggagcctgctgccgtcagtatgagatgggagaatgcacacgaggcggcttctgcaacttcatgcatttgaagcccatttccagagagctgcggcgggagctgtgtgggcagcgtcgcaagaagcatagatcaagatcccgatcccgggagcgtcattctcggtctggagaccgtggtcatggcgatggcggtggcggtggcggtggcggtggcccaggcggcggcggcggacgggagcgtgacaggaggcggttgagagatcgtgaaaga

SEQ ID NO: 78650 - DNA, 2061 bp, Homo sapiens
tataagactaccatttatttggtggccaaggcaaaaacctaggtttcatccttaatttctacccttccatcaccaatcatcagcaacctctgttaattctacctccagattatgtgccaaatccactgctctttatcttattattgcctcccatctctccaatcttatctctaacattttctttttgttttttttgtaaacggatttttatactatattaaaaagccacaaaataaaaaagggatcaaccaacatatatcttacaagtccctccaagagtctcagtatgcaacagtcatggaggctgtgacctttttccttcttttctcggcctgcagttcatttaaggatcaccggagatgacttgtgctctagttcttaaaatcaaacttgttctgccaaatccaagatactgaatttttccaaattgtagaaacatgcatttgccacctgtccaccaaaatacctcccattcgagtcaataaccgcttgaattgctgatttaactctctcaaattctaaaaatatccgtactgcttcatcatcaggggcaccagaatttcaaacaacacactttccccaactttgagatatttttcacgttcttccttggttttaacttccaagtcttcatccacctttcccgcaccaaccatgttccttagtaggaccactttattaagacacttaagtatttcagtcagtggatttgaatctgacttcttggatgcatctttctccgtggcgtcacccacgatgatcttgccaccaagcttgctggtcttctccaccgaaaaggcggtgctcagcccctgctcatgcttccccagaccctggccctcccggaagccgtacttctgtatgatcttgtgcgccaccgtgccccccaagttagcgaggaaggagttgcgctgggccgggttggagatctcggtctgtcttgttcctcgtacactgggggaggaatggcagttttggaagactgtgatcgaggtcttgagtcctcttcataaggaaaatctcggggtaactgtcttttactgccagagaagtgggtgaggcaatggcagctccgcccatacttgttttcctcttctctcgctcctaatcttcatcttcatcagaatccggatctgaactccttgaaaactcacgtgcatcatgtctgtatttatgcctttcttctctttcttctatttcttctgtctttccagctcccgctgtctttgtccttcctctctggcgtttcactactttcttacaatcgttaggaaacataggatcatattcgtcagctaagggaatcagaacttcccctgcagaaaacccactgggaacaggatccttcagcccagctggcacatgcggtggtgtgtccacaatttgcccggtcatctgaggagccacctcgttgtaggtcaatgactggggcaagaactgtaccttgtttcgtcctttggctctttgcctgagtgagagctgccttcttcacctgaagctgagactgtagaagtttgaagtttttggaccagccttctgtttttgagtcactggtttcctctgatcgtacagggacatcttttcttcggtttaatgccggcccgcccgccgactctgcccatgggccgcggtggcggcagcgcggagccggggaggcaggagccaacggcggcaccaccctccgctgagtccgcggggcgctgggcggcgcggggtcaggtagcgcgggctgctgggagagcgcgccccatctctaacatgttctttctcactcactatgtttccccattcctaactccttcctgcctctccccagctgttcacatagatacaccttagggaaagacttccctgactccctaatctaaaaatggatctcgcctcaattattctctatcactaagtctcgacttattttcttcatagtatttagcagaatctgaaagtattcttttttgtgcgtgcttggtatctgcttctccaataaaatataaactctatcaggccagggctgcatgttcagctcctagaatatagttctagggctcaacacaatcaaac

SEQ ID NO: 78651 - DNA, 1050 bp, Homo sapiens
gcataaatacagacatgatgcacgtgagttttcaaggagttcagatccggattctgatgaagatgaagattaggagcgagagaagaggaaaacaagtatgggcggagctgccattgcctcacccacttctctggcagtaaaagacagttaccccgagattttccttatgaagaggactcaagacctcgatcacagtcttccaaaactgccattcctcccccagtgtacgaggaacaagacagaccgagatctccaacccggcccagcgcaactccttcctcgctaacttggggggcacggtggcgcacaagatcatacagaagtacggcttccgggagggccagggtctggggaagcatgagcaggggctgagcaccgccttttcggtggagaagaccagcaagcttggtggcaagatcatcgtgggtgacgccacggagaaagatgcatccaagaagtcagattcaaatccactgactgaaatacttaagtgtcttaataaagtggtcctactaaggaacatggttggtgcgggaaaggtggatgaagacttggaagttaaaaccaaggaagaacgtgaaaaatatctcaaagttggggaaagtgtgttgtttgaaattctggtgcccctgatgatgaagcagtacggatatttttagaatttgagagagttaaatcagcaattcaagcggttattgactcgaatgggaggtattttggtggacaggtggcaaatgcatgtttctacaatttggaaaaattcagtatcttggatttggcagaacaagtttgattttaagaactagagcacaagtcatctccggtgatccttaaatgaactgcaggccgagaaaagaaggaaaaaggtcacagcctccatgactgttgcatactgagactcttggagggacttgtaagatatatgttggttgatcccttttttattttgtggctttttaatatagtataaaaatccgtttacaaaaaaaacaaaaagaaaatgttagagataagattggagagatgggaggcaataataagataaagagc

SEQ ID NO: 78652 - DNA, 1038 bp, Homo sapiens
cctctcaaaaaaaaaaaaaaaaaaaaggaaccttttctagaaattttagtcagtacttttggagcagaaaaattatatttgatttcagaaagtcgattttaggaagcatttacaaactagactacaactgctaagcaagaactaaaatgtttaatatgctgcaaaagcttgcaacattacacataatgtaaccagtgtagattgcagaatacaagatttgaatgattaaggcagcttccttatatggaaatttggacattttatagggcctttgcacttgtagttcttctcccaaatgctagcatggctcacttcttcatgcctcttacatgtcaccttctcagcaaggtctttcctggctactctatgaatgccacactcccactctaatatttcctctgctggttccttgccttaaatgtctgtttaacactcatccctgtctaacatgggatatattttacttctttagtttttcttactgtctgtgatcctcagctagaatgcaggttcttagtgaggtagggatggggaggtaaaaattctgacatcctgaaggaacttagtaagtatttattgaatactacataaaacacaagtactttgtcacttataagactacttacatgccaggcatggtggctcatgcctgtaatcacagaactttgggcagctgaggtgggagggttgcttgaacccaggagtttgagaccagcctgggcaatatagcaagaccctatctctacaaaaaatttttttaaaaattagctgggcacggtggtgcatgtctgtagtccctactactcaggatgctgaggtaggaggatcgcttgaacctaggaggttgaggctgcagtaaatcacatttgcaccactgcacccagcccaggcaacagaaagaccctgtctcttaaaaaaaaaattctttttaaattttaaaagattatttggctaattttaaaagaaactaaaagtaaaaactgatttattaattatgtatgtaacttagtatttccatatacaaaatttgcaaagaca

SEQ ID NO: 78653 - DNA, 1134 bp, Homo sapiens
aacttttacaaaaaatagactttatgttttagaacagttttaggttcacagcaaaaatggagcagaaaatgcagagatttcccatataccctctacctccacacattcacagcctcccctaccgtcaatgtcttataatagagtggtacatttgttacaactgatgaacctacattgacacattattatcacccaaagtccatagtttacgtgagggttcactcttggtgttgtacataatatgggttttgacaaatgtgtaatgacatttgtcaaccgttatagtattatacagaataatttcactgccttaaaaaatcctctgtgttttacttattcatccctccctctcctttaacccttagcaactgatcttttcactgtgtacatagttttgcttttaccagaatgtaatgtagttgaaatcatacagtatatagcttttcatgcagtatatagcttttcagattggcttctttcatgtattaatatgcatttaggtttctctgtatcttgtcatgtatatgtagctcattttttttttagtgtagaataaaattttattgtctggttctaccacatttcatttgtccatgcacctattgaagaacatctcagttgcttccatgttttggcgattatgaataaagcgactataaacatccatgaacaggtttttgtgtgaagataagtttttttcaggtgtataaataccaaggagcacaattactggatcatatggtaagattatgtttagctttgtaaaaaaaactgccacactgttttccaaagtagttgtactattttgtattcccaccaacaatgaatgagagtttctgttgttccacctcctgaccagcattgagcattgtaggaattttggacttttgccattctggtaggtctgaagtgttctctcattgttgttttagtttgcaactacctaaagatatgtgatgttgaacatcttttcatgtttgtttgccatctgtgtatctcctttggtgagatgtctcttcagatcttttgactatttttaattggggtttttgtcttattattgagttttaagagttctttgcatattttggataacagttctttatcaaatatgtatttgcaaatatgttctac

SEQ ID NO: 78654 - DNA, 1009 bp, Homo sapiens
ttaccaacttgttaacccagatatgacacagttatacctaagaagaaattagtctgtcagaaagtctatttttattaaaatgagcaccgtattctatataaaatgtgctatactattaaagtatctgatagtttctgtgatcacatgctttttcatcagaaacaggagtagaaactttctttagagattaatgtaaccccttctcttttaccaattaggaaattaacttgcagcatagtaaaaaaagttatcccaagatttcaaattactctacttaacttctcattgtgaaaccctaaacatgttctaaacattaaatattcagttgttttcatttactctttctattaaatgtactatattttattagagttttagaacaaatgttatgtttagtctggcaatgcatcattaactagaatgtttaattattacactatgtggagtatttatattctaccatgatgatggaaaaaagaaaatctcctatgaaagaacctatctcttttaacaagtcatcattttcttgtcccatgctcttaattcatcagtattgtctctaggctttgttaataccactgctgtgatatgaactcttagcagttacacttttcaataacttcatgggttttaccttttttggggagttatttgtaattgattattttatggtttatgaatcaatatgtaccaaatgcctagaaatctccgaaatgttatttttttcatagtgttaattccttaataattattattaagcatctagtatattccaggcagatagtaaagattaaaagaaaaatgaaatgattatgtaattgtgataaattatatttggtttctagataatttgatgtcatttatttaagtcaatttatggaacatggttgctttctatgcttatgtgataggacttttctcacagtgatttgttctgtagctccattatatcatgtttacatctgttcactgccatcagactaaatttagcttctaccaaaatgttgta

SEQ ID NO: 78655 - DNA, 1048 bp, Homo sapiens
gtaagctcatttttttagagattatatgaccagtcttcttatctgttcttttaaataaaaattctgtcattttatttctaaaaataattatagaataatggtgtgttcagtgggagtctgggaacaaataaaaatcatatttacccacaaaacaattcgagttttaaaaatggtatctacttgttctgttagccagtaagcctggtagagataggaagagatttcaagagtgtgtgtgtgtgtgtgtgtgtgtgtgtatgtgtgtgtgttttagtttgaaaggtacatgaggtattcagttcttgtatccagtggatttatcaagaattatagacagactagaaattgcttctcagagtgattataccttttctaatatcacctactgattttacagtaaaactctaggctacaaaggttgagatgagaacacaattcactttacttgactcttaaaaatagcattgttaaccattttgtgatgtctctctcttcatgtattgggctgtactgaagagataaacctccacttgctttcatgacatagataataaattgatataattcagctgagaagttgaaaaatgcattgaaaataatggagcataacattgtagggttaacatttattcatagatgatgcaattaaataaaacaggcattaacttcaaggtcagtaagtaaagtaataaaattgaatattttaattgaattgtaattgcttcccattgatacatgcaagtaaagtaaaatagatgtcagctctgcaaattatggttcttcctcctaattaatttcttaattctgcatggagttatcagtgcctaggtcttgtgagtttattcatccacccagcttccatcaaggaatgtctgtatgacatgatgaaatggctaggtgtcagagtttacagtaaattttttctgcactttggcaaaaatattgttagtaactcaaagtaatatattcatgtattagagttaaaatgtactttaacatcatcatggatcctatggattataatcttcattaatattgatatttcttg

SEQ ID NO: 78656 - DNA, 1004 bp, Homo sapiens
tgacattgatgatgacttacactaatttttctggaaagaaatgtttgtattaagcagttgaaaacataattataatggttattgcacaaagcccagctttatagggtcttaaagaacaaataccacaaatagttttagatcatgattagattaaaaatcactggttttatttcattttttttttttggctacaggataaagaaaagatcttatcagaataaatttctcacctgccttgggcaggagtcattagatgtaagcaaatttaatggagcctgtgtgctctggggccattcagctgtgcttcaataattgcattttttttttttttcagtatgaaggttgtttaacatatcaagtggcaaaaaaaaagttaaagtacaagttgcctatttatctttcaggtaaataaccataggtactttataaactgagtagcaatgaatgcattaacaaataataaactccagtcaggaaaagaaaatgctgctgatagtgtgcaattattatttctgtgtccctccttcattagcattcacatgacttcaaactgcttctgtcctttttccccttcattcaatttactttcactggaaaactttaaggttcacttaacatatatttgaacaggtcaatatcatttttgatgatttctttttaaattcagcctttacaaacaaattagcaaggttaacttactgcaagatccagatccacattaacaaatgaatttttttcttgttcttttcccccacagactggatttcggtcttctatccacaatcttctaggatccagcttctgttcaatcagtgttttgattttgcaactctaactcgtaaatattacacaccaaagtaacagctaagataaaacagcgttaacaaaatattattcatattaggaacagattttttcattacagatatcctttcaatattgaattctgtttgatatttaaaatgtaatttaattcccttatatagtttttcagagacacatct

SEQ ID NO: 78657 - DNA, 1050 bp, Homo sapiens
tctaccatctctgctttctggatactcctatttcaatcattttttttctaagatttacagaaaaattattgtgctcccttatctatttatgccattgcttaatttttaaaagaagttactcaatctgggaaaatactgtccttaaatagaaatttctcaaaagtttccatcgaacatcagtgagtctttaaaaatacgttaagtgtgaaacattttggaagtgctgcctaagtctttgctttctccatggaaagggatctcagttatttaaattttaagtaaaaccataattatttttctcacagctgagagaatgatttaaatatatgcaaattttttctgaatgtcgattatattttcagtaaattactctggtttgaggtagttttctagatgagacacagttcatttataattttcagagcatgatgtggagccatttgttactttatttttaaagttatggtttttttctttattttcaggaaaaagaagaagtagaggggatatcagtaggtgctatactttctgactatcagcgtattcgagtggaaaatgtgtaagaaaacattaatttgttagttttaaaagtgtatgtgttttaagaatgtgaataagtgaaaaataataatcatattcaaattataaataggtatggtagtctacgtgctccatggaactaaatgtgtgtatttacctaagtaacaaaagtcatgcttttccttttttctatccttatatctcacatgaggaaacttaacttatttagtgtaaggaaaaataatctataatagaattgagacagattttttagtgagaagtattctcttcacttttttcttatttgatttagtatatcctgttaatctcttttaactcatcatttgtaataaaaatcaagagataataaaaggaatacagtaatattttaaagaaaaaatgtttactaaggagtcctctcctctttggttcatataattcagttcttgtctaaaaatatttatatgattgaaatgcttacatataaagccattcaactttcagggaatt

SEQ ID NO: 78658 - DNA, 1072 bp, Homo sapiens
ttcctaatgttatcctataggtgagaattgtctcccttgtggtctgttataatgtatatagacttatgtcacatatttgccttatttttttttttttttgagacaaagtcttgccctattgccaggctggagtactgtagcacgatctcggctcactgcaacctctgactccctggttcaagtgattctcctgcctcagcctcccaagtagctgggattacaggcgcgtgccaccacgcccagataatttttgtatttttagtagagacagggttttactatgttggccaggatggtctcgaactcctgaccttgtgatccgcctgccttggcctcccaaagtgctgagattacatgtgtgagccaccacgcccagccatttgacttatttctttatgtgtccattcctctgcatttcttatcactagattttaattttttaagaacatcgactgtgctgttttctaatgtgttttaactttcctagtataggacctgtcacaaagtgggacttttaaaattactgtttgataaatatatgaatgattgtgtctgacagcttaccagcacatgggataagagatgaatgtgtatatatatatatccataggtatatttttaatatcatttccctctaattaagaaagtaatacatgggttgtaaaaatacttaaaatataaagttggaaataaaatagcaaaaatgaaatactactcaaaaataagaattattacactttggtctatttctggtcctctttctacacttagggctatttcaaaaaatacatattttagtatgtactttatgaacatttgcttcgcttagccttatatcattagtagttccttgtatttcatgtcctttgaaaatatgtcttttaatgactgctttgttttccctcttccaaatgtaccacagttcattgaatcatccttttgtttaggattttagggttttctaatttgtatttcacttacatgtagaatataaatatgataaatatttatataacttgtgcacatttacaattatttttatagactgcatttctggatataaatttgaaat

SEQ ID NO: 78659 - DNA, 1014 bp, Homo sapiens
tgtaatcccagctactcaggagggagaacctgggaggcagaggttgcagtgagccaagattatgccactgcgacagagtgagactctatctcaaaaacaacaacaacaacaacaaaacagaataattatcacaaaaagggaacacatactaaaatctgctgacttgtagtgtgtttctaatagaaacaaaattatggaagatatcacgtgagtggccatgttgtcttgcccatatttgggtagccctgttatttgtcaaatgaataaataaatgccagtgaacaaaaaagtagtttagctttcatgtcaacaagtatatggtaaaataacccatactgcttgtagaaaaataggttgtgttattattcaaatcacaaaaaggattcttgagtcaatgtatacttgtttttaaaaatagccctagtgctctcattctccttgatcaccaggcagatgcagttctgagaaaaggtagtgaatgtcaaattaaattgacttggatcatattgagctccttgttagtctgctgaaaacatttgcaaggcgagagtatagtcatcaacaacccattcattgactgtatcagcgtgattccgcttgtgaaaagtataaggttcaagacttagaacaggaagcttctgatcaaaggagagcccatcactatttccctgaagtgagatcctatcaatattatatagagtgattatgatactgattatattgtagcatggactgatatatttattatcttggataaatggagggcttacttaaaggtttggaccaaaatattcctcattcatgataggagtaaacttagaaaaatatgacacctcctttaagatcataagctgcacctcttacctcatcaacttcttgacctctttgcactgtggaaaaccacatcaacacagtctgtgtcgacacctggaagactggatgatttctttagcaaactggttgttacgggaatggtactgccaggaacctcattcttgcttctactggcctggc

SEQ ID NO: 78660 - DNA, 1405 bp, Homo sapiens
aacacagatataggtatagacattcatagatgttattttttaaacagttacagatgtaatgctaattttaactttttttttctactaggttctgttttccaactagccacactcttctgctcctggctattaactgacttattttctattggcatcattaagtttggcaacatttaaaaatgatttctgattttctgtgagtaaatcaatggtggtagaatattggcttagtaaaagtagtttaatcattttgggcatattttttatatgaaacgtaagattttaggtatatttcactttatgaaaattattactgcaggtttaaaccactactttatcccattaatatcccatagaaaatactttatgttcactaaatatcccatagaaaatactttatgcttccccttttttatgaacttttattattaatgttgacagtttctattatggcattaaaaacaaaacaaaactatagtgctactattttaaacctagttactggattaaatattataatagctcatttgtaagaataaaataatgtttattttgtggtaattattactaaatcattatttagactttgcaaaataatatatcaccatcttggaattatgatacctttctcttttggtcattttagtttcttagacctaattctctctatttttgtttgtacttttgatgcagttagggaatatttccttctgtgacacttttttttttaaatgataatctcttggtagtttcttgtcagtgatatgaaaacgctgctattacaccgacttgagcatggggataagtaggagtgtgtgcaagtgttgttgagaggagtatcgctgctcttttccaagctgctgggttactttgtttcttctacttttcagctataaacacatgtacatattcacactatgtacagtttcatggttccattctccccctattctttttcctctcattcgcattctacttttttcctctcctttttctctttcatctcacatgtgtgtatgtatgcacatacacatgtaaatgaattttcaggtgttaaaaacaaagattgcagacagagatctagatccaatttaaacgcttaagttaaattttctctttttttccctccttcattagattatggtcatctgtaatatttatgtctttttatgagcactggttgttctgtcccttcactgttttatgtctcttggtgaagaataagctgtgaaaccagataaactcttagattagaaagtcttaaacttgaatatgcaaacagatcatttggggatcttattaaaaattcaggttctgatatagttggtctggatggagcctgagatttttctaacaagtacacaggtgatgctgaggccgctggtctgaggttgcattttgagta

SEQ ID NO: 78661 - DNA, 1142 bp, Homo sapiens
gaaaatctgttacactgtatgtttttatcctttaatgatgatcaatgatatgttcataattaaatagagtttagaaaaccaatattgtgtttaccaagaaatgttggtgggttttttgcctttgagggataagtggggactctagggtttgactccgctttgttctaggttccactgcatggtatgatcttagtttagttaacttctctataccttggctttcatatttgtaaagtaagactagtagtagtacgtacaacatagggtcattatgagcatttaatgggataatccatgtagaatagatcatataggaagcatcaataaatattaactattacatacttacttgtcactagaaaaacactttctctttcattggggccatagagcattgctcatatttaactaacttcataagataattgttatctgtcatggtttctctgttgatctggttcttagagaatttagctgtgctcttctgtctctttaggggtattgtgtggtggaaattctactactccttgttttgtctttaattgtgtttctttttagtacttaatgtatcagctgctttggcagtgatgaatatgatctcaaagtttgtgcatttcagtatgtctgctttgggctttgctttcgcttgatacgaggtaagaattaattaaatattttccagggcttaatttttctaaagggtcttttgagtgaccacctattaaaaacttcttaactaggaaagttttgtgggcacaaaacggacgtatcaccaagaatttaaaaagtttgtatgagaaaacaaggtctcactttgttgtccaggctggagtgcagtgctacaagcataattcactgcagcctcaaaattctgagctcaaacaatcttccgccttcagcttcttgagtagctggaactacaggtgagtgccaccacaacctggctaatttttttttttttttttttttttttctgagacggagtctcgctctgacgcccaggccagagtgtagtggcacgatcttggctcactgcaagctctgccttctgggttcacgccattctcccgcctcagcctcctgagtagctgggactacaggcgcccgccaccgtgcccggctaattttttatatttttagta

SEQ ID NO: 78662 - DNA, 1059 bp, Homo sapiens
tggttgaaatggagatggggacctagagtccctctctttcaaagcaacagagtttaaaagccacttggtccttacagtttatgtacgtgtgtgtacatacactccttttgtgtaagggctttgtcttactttggtttgaattcatagtgcctaattctgtacctggcacataaaagatgttcagttaatgtgtgctgaatacagaattctttgaacaccaggccttcccttactgatttcaaacacctcatgcataaaagtgcaactttatgaagccatctaatagtaaagtaattgtttctctgtgaaccaattaaaacaaacatacttctggcataattcatcaatttaatttttttaaagtaaaacattgttttaattacaaataattataggaaatgaataagaagtattcggaatgtgtcttcagtataattaaaagctgttatataccacaatgattggtttagattcagacacttcaaatgacctgatgataaaaaataatcttacacaatgaactttggaattgaatgttctcaatattcagtaaattgttgtttttcttgtaaagttcttatttatgttttgtattgcttttgagtaatcttgaatgtaatattataataaaccacctattgttttttgtatatcacttgggttaaaactgagaactgtgaaagtatctttttatcactataaagaaggaaccaatgttttaagctgataaaatgaaaaggtacaaattctcaataaccaaatatggtagttcctcttaaaataatgaccagttacagtaagaaatatgtttaaaattacattctggcttacaagactgacaagatgctgtctaccaaagaaaaaaattgaataaggtattttttctttgcaatgagagtaccaaactaagaatccacttaattaaaatagtgataaatgtagattacattaccgaagacagtgaaatacagctgctctatctactgagagcctgcataatttaccaagactgtacaaagaagcaagggagcagccactgcagactgttcaggaagcatc

SEQ ID NO: 78663 - DNA, 1086 bp, Homo sapiens
aggatatattgcttttgaagcttccttgttgaagatttggcatctacttaaaaatgcactgaatggtattgggggaaaggaaatctttcctattgattatcaaatcaacaggatgtcagccattccccaggtcctttttgaaggttcatgaggagcctgtttttctttcagggttggttcttgaaagcttgtatgtgagagattttattattttattttattttacttaatttttttgctgtgacaaatgtctgttgttttctaaacaagaaagccagtgtcccagttaggtgcattgagttattttcattcacttgcagtcctgttgtattaatactgaataagcagagacagcctgactggtggtgaaagatggtaatccagcctcagggctttttctggtcaatcctaaacctctgattgccacgttttcctaatttcccatttccagggcatcactagaatgaccttgcttgctgaatatgatgctctgaatctccaagattttcacatgcatttgaaagtgggcagccaggcgattgtttacaggactccaaatgaactgtgcactcacagcaagtttgataaacacacatttcctccttttatcagtgagattgcaaaatgtgaagtatgagtttccagttttactgattcccctcaacccttttcctgtttaaaaacttagacatactaattggatgctgatctgtccctgtttttcattctgcttgctggtagttgacggcttagtttagtacttacctaggcaagatttggcaaaccttcaaaaatgaactttccatgtattcaacttaaaggagattcatcccaaggaatgtaatgtgaacactaattaacattaatgactgctaatcactttgctttttatactcctttaggagcactgctattatccaatgtagttaagtaaaatgcttgtatatgaatcaacaatgttgcatccttttagcagctattgctcacaatcaagctttgcataaattaaagttgactaaaattgattttaatatgctgctcttcttcaatagtaaactaaaatatctagttaaatatcctgcatat

SEQ ID NO: 78664 - DNA, 1047 bp, Homo sapiens
atctagtaaagtcattttttttcattgcatacagcattccattagtatattaatattaagtggtagttacaagtgggcattgagatgagtgtaattttcttgactttattagtaagttaatgcagagaagaaaacgaatgataaacgttcagttgtgaaagaggttttagtgggggtaaatttatattatagattggattgaattgatccttctacatttggtgcctataattttgggccatccttagcctgttttagacttcttcagtcagataattcagccttccaagagacatgtagaattaatgctttctagtttcctatgtgagttaactgaggcatgggccatttcaaaaggagataaagagggttaacctaaagatatcagtggttctaataggtgatttttttccattaaaatttattttggcatgttcttttagaatttaactccatgcttgtctttaaaatctaagcagtatattttgtatgaactcatttgtagaaagcctcaagcaaggacttaagtgtgaaagttaggtgaaccaagtttagaaaattcagactttttggagtatatgaattaaaagatttaaaaaacagttctttcttcagaggcagtagaatggggccatcatttgtgctcctgtatgtaaaagcaattaactctcaacaccagcagaattatgccatacttatttgtatacagtgctgagccacgtggtcactttgtgtactcgtacacagtgggtgctcgatgagcaattgttaaacttaccaaaattaagcctatctaactttgacaaaattatgctaatattgatccccatagatatctttcaaaagacattgacaatcagaaaaggcagaaactatcagacatttatttgtctttcttgtgcagaatttgctgattcttctgtactccctactataagattggttttggagccattgaaatgccccatggtctattttaagaccagttctcttacggattctttcctaggtagtaattttgcagggaggtgggaagggagggagaac

SEQ ID NO: 78665 - DNA, 2901 bp, Homo sapiens
aatcacacctggctaattttttttgtctttttagtagagacggggttttgccatgttgaccaggctgttctcaaactcctgacttcaggtgatctgcctgcctcagcctcccaaagtgctgagactacaagtgtgagccaccgtgcccagccaattcttcttttttaatctcttctctcttccctccctcccttcttcccttttttccttcctcctcctctttaaaaaacagttggacattggggctaaagcagtgagcttatagttaaggacctgtatattcagttgctcatgatatttccaccttaatattccactggcatggtaaactaaacaaattcaaaacttgtttgttatcttcctacacaaacttgttccatattctgtatttccttaattaaaagcatcatcatttacctcatcatctaagtcaaaacctaggccctactgtgagacttccattttttctcagtccctttctccactccatccccctcaaccatcaccattatagctccagcacctattgataatgctggtatgacttctaaaatctgaccccttgacttcattctcaccactactggtttttcatctgtactatgcgagagcctcctaatcaacttgccttcagtattgccctatgctccatccacctcgtctaccaagttgttggcagctgatctgtataaatgcttaaatgacccatgattaagatatagtccaaacacattaggctaacacagaaggctctttaagaagagggcctggcagtcctactagtctgatcctgctattctcacacaagcacctctgggatcaagttataatgaactaattagtttctaggagattgcttttcatgtctgagtcttcggctgtgcttttctttatgcttatctctttgtcctcctgaagaaccccttctcacctcatattcttttgtgaaacctgccctaatttaccttcctcctttctgttccatggcagcttgtctataactctactgtgggtctcattgcatcattaggcttgtttttgtggctgtcgcttttgctagattgtgagacctcaaaaacatgatagtgctgttcatttttgtatctgtcctagcagagttcctgacatatggaggctcttaaaagaatattgaatattaaaagaataagtttagtaaaaaaatgtatcaaattattccaacttaggctgggcacagtggctcctgccttgtaatatcagcactttaggaggccgaggcgggcagaccactttcaggagttcaagaccagcctggccaacatattgaaacctcgtctgtactaaaatacaaaaattagctgggcgtggtggtgcgtgcctgtaatcccagctattcaggaggctgaggcgagagaattgtttgaacttgggaggcagaggttgcagtgagctgagatcacaccactgtactccacagcctgggcgacagagtgagactctgcctcaaaaaaaatttttttaatgtaattatcggatacaggggagccatgttactatgatatgtgatataaaaccattggcaaattcattttgtcttttgttttcctatttagaagcttaaatggaatgggcatcatagtggaagttttcaaaataaggcatcctatcagtgtaaccactaactgtaccaagaatagtttccttctgcacactactttatgaaaatgctgagcagaaactctttctaattagttttagtatatgcatcttagaaaacctgattatggtggaaaattactttgtgaatctcttttcacttcacttcatgagggaaaaacctgagattgttgggtggctctgaggcaaatctgaaggatttggaatgggagaaacatataagatggacttaagattttcagggaggacgcagacatagcattagttaaacaggcacacagccctgtacaaattgctcctggctcctcagaactgcacagcttgcctcaagccctttcagttcccaggattttggatattaaacctggtcccttggcataagaaatgcttttctagtattgactctggactctaaacaggaagaattggcattggaacagaccagtgtcattttcactcccaggtgcagctttattgaggctgtgccacatctggtcctttcagatgataaagtcaagcgtgcatgaggaagtacatgaaggaagatctgtctggaaataaaatgttgtaccatatttgtcaattactatagttcctaaacttatcacaggttcaaagccttcatctataaattccccctaaagcctagaaaatgtgactccctcattttggcaaaatcatcattctgtctcttcaaccttgaacttttctccacttggtatcagtgattgtgtgtatatattgcacatgcacatgtataccctttgtatttatcttttcccagagtcagtgcctctctataaatttatcaactgacttatttttatatcctatattcctttcttctacaaactatggatttcttcctatcttatcatctactctatatatcttacattgtgttgagtatttttgacttttctttcaaatatctttctttatattttcaatctctagtgtctgtatcctgttgactggttgggtttttttgtttgtttgtttttgttttgtttttcctatgctaccatttatttttaaagaaaccttttgtagatgtctccttctggagttgtgttgtctgggatgctaggtgtaagtctctgtcctatagtcttctacttcatttctaggcctgtagtttatcttgtctttgccatattcttattaaatgactgagaatacattatccagattgataagcataaattgctttatttctttgttgttgtatatttttgaagcaca

SEQ ID NO: 78666 - DNA, 1082 bp, Homo sapiens
ttcaagccagtatttcttgatgtcttgccatttttcacaaggggaaggaaagaagattcctgtcccttcctctacaaaggtacattgcatttcactttctcactcttcagagaagttcagttttttcagaagttacctcatgaacttctgtcatgaaaattttctagtttcaagtagctacttaaatgacatactttgagtttcatacaaatcaaaagttaattaaggattttgatttgaaaaatatatgaagcactgaaattcttttaaaatttgtttgactaaaatagttcttattttgtatgtcagaacattttattttattctaaaaagaaactgataagaaaaacccttagagtagttccaaaattttctgcttagttatagatagcataagaagtagacacttttgaaaggaaatcacaaggacctgctttcttccctctgggaagatacatgctaataaacattttgattatcaaacaaggtagaaggcttaaaagaatcctacttttagtggtcatatctccaaaagggtgcaattatgatcttgacagttttcactttgaagtgtgaactactgagtgtaaatcctgcattttcaaaatttctttctcatggtacaaagaatttgggcattaagtttttatataaaccaatattataaaatgatgagactcacactaaagtaattgggttgcttaaaaatcacaaacttgatcactttggaagaactccatgataataacagccctccaagaaagagagataataaattacaattaataataaatttaattaaaaatgggcagattagcaataattaagaagaaattttcttttccatccatgctgtctttggagaaatggatgctttgccattattatctttatgctaaccatcagttatgacataaattaatgctaatgttaaattcttgacaacttatgctttggaagtttgtacatgataattatagttgaaagatatgttatcaagttgtctgggactaaatagttccttcttttcctgtgtagaaatattaattttactataggatattttaaggacataaatatca

SEQ ID NO: 78667 - DNA, 1101 bp, Homo sapiens
ctttaattaagaaaggtttttttttctacaagtctagatgacttcatgaataaccttgaatgatttgtaaaaacatttatgtaataaaaatatttaactgaataaactaatcaaaatttattggatacattactcttctctttaaatgtttaccatatatggtacaacaaatttatgtattaatacatttgtatttgtaattagtagtagagattattaggggtgatatgaactagatgcaactacagacaaatgtgcaattcttatgtttttattttactacataaatgcagagaaacatagtatagcaagctttcaagttctgtgtcgactattcaagcagtaaaacctggatgggctttcaaatccgctttctttttcactctcttttgctaattatttccattttaattgttgcagtggggtctgatgaactggatagctacatgtatcagacagtggggcaccatgccattgacttgtatgcagaagcaatggctcttcccctctatcgccgaaccataagaggaaggagcttggatacaagacaagtgtacaccaaatgtgaaggtgatgaggttgaagatctctatgagcttttgaaacttgttaaggtatgcagagtaaccaattaagtatattggatttagtgtgtaatttaacaaattacatttgccgaattatttagtaatccgtaatttgcaattgttagtagcccaactattctttaaaaggattttgtctttttttggttagaaaaaaactgcaaatgattagtatgcctttatattaaatgatatttaaaaataagacgttttgtatagtttggcatccaggattatcaaatgatattaaaataagttttctgttcctaaggaaaagaaagattagagctgatggccatttaatctctttattaacaaatattttttgaatgcctactatatgcctggcatatagtgctagacactggggatagaatggtggacgcatacgttaaaggcttattctaatggagctcactttctagtggaagaggacagacaataaacaataaataacatgcttgatagtgaagagtaatatgaggaaaaatgaagc

SEQ ID NO: 78668 - DNA, 1743 bp, Homo sapiens
gatgttttttgaaagagttccaactttaagaaagagaaaattctttgaggatgaataggaactgcactctaacttctgtattataaaagaagaagcagaatctcctgttaggtttaccaaaagagagaaactcccttatcccttgtggccagggggaggcaactgggactttcaagctatcttgtgaagttaaaaagcagatgtttatatagtatataatacatacatggtatattataatttcatcactggagtttctatcttgttttcagctttcacatgaattattttacttacctagtacagaaccattaatatataatcttccttgtgttcatggttcaccagcagggtggtaaaatgacaagcaaagtatatttttaaattatacctctcagtagaatagagacacttatttagaatattgttagtgagaaaaaatttgatagtaaatagaattagaatattctgaagtaaaaagcctggaaaaggcagtcgaaacaatagtaattgttgtagaagaaaacagatggctgtgggttggtagatggagatggtttagctcatcttgatgaaaatcagcaggacattgggaattattgaacaattcactgaatgacttattttcctatgagtgttatgaaagaaaccttagtgaggaatgactggtagagatgactccaatgtccagcaaagttacgggttttcaatgggtggtgtgaaaaggaatttattcccatcaatgaggataatgcgaacttgtcataaaattcacaaaaccatctctttagatttgtagtaggaacttttgtggcatgttaattgagttgcttcaggcaacaggggagcctttggttttatttgatctcacactattgttgctctgtagcttccattaatcaaagttacaatgtggttaggactaaatagagccttaaagaaaattatcttctaggtttttgaagccagtgagatgttttacttattatgctaacatcagaatgtttcttgccaagaagcccaaatttctttgagtaaattggtttgattgtatcaatatcctttaaaatgaatgtatttaaagatccagtctaattttgagacgagagaaggccgaaaggtttttaggtaactttggctatgttctctacttcctactgggaccaggagtggaaacatttatagtaacaatgtgagtaatattctgaaggaagccaatctaacaatgtgtgagttcagaaacctgtcagccaaaatggggtagcagattttgatgattttgattgttgaaggggcccttgcactatcacttttcattccttttgataggaagttttcacatttaatggaaagcctggacctgtttggcttatattcatacatacacacataggtatatgtcaaaataactactttgtaatttttttaatagcattttgtgaacattttccatgtcattaaatattattctacgatagcatttcccatatgtctttagaacacaaatacccccattaaatttacgtgttctgtgggtagataaatttgagagatagttcatattctctgctcttattggagtacctgaaagcatattagcttaggaagatttacaccacagacatccatttaacactttttatccccatcttttatagacttctttaaccttaaatctttttatcatccgatacctattaatgtcttatgggatttgtattccgcagaacatactttagaaaa

SEQ ID NO: 78669 - DNA, 1042 bp, Homo sapiens
gtgtcttaaaggttgagtggcagttcatccaacaaacccgaaaggaaatcccaggcttgggagacagcatgtacaaagacatagatgtaagaaggtataaagctttcaggagggttagtatagggtgtgaagagagagagaaggtgagattgaaaaggaaggagaggccaaactctgaaggtccttctatgctgataagaagtttagatttatcttatttataattttttcctataagccagaggttgtaagcctggatgcacatgtgacttacttgtctttgttcagtaaatgattacacacagatctttttctagacccagagagtttattttcatatgactcatctgcctaacatcctaatttctttaaagaagaacttgttagaataatgatgataaatgtcatttccatttgcatagtacttcatacctttcagaacaaatagttttcaaggaaaacataagtaatttattaagtaatgtattttgatcctcacaacaactttgtgaacttgatagggaaggtgttatactcacaaaggaaaaatacagagaagttatcatcttctgattctatatagcaatgaagagtactaaaaagtgaccatctcctgcctcattgcttactcgtattacctacttaacatggaattataatgcaaacaacataaataatatttgatcatcttagcagtaggcctaacaattccttgaagtgggaagcccacatttgttggaacatttccatgaggagctccttgaaatgagcatgagacccttaaagagcatgctaaagacacaataagtagcttctaaatggttttgaagagtaatagtagggtccgactttgttatagctttgatttgaatgaataaaaggtatgcagtttggggacagaattttgaccttaatgagtttctttactagaggagagaggcatttgaggttggaaatcatgatgtccaggaagagaagaaaaagagccaacagaactagaacacatgggaagaagagactgttccacctcaggccaaaaaga

SEQ ID NO: 78670 - DNA, 1018 bp, Homo sapiens
aacttagtggttcttggtggtgaacttaggagtccaatctggtaaggagtggagtagctaaaaaacttgcttgggacaagcacagcagttttacttggctcttatgcttatttgaggtggcttggtttacttggtgctgccattggttatggttgtcttttttgaacaatccctcccacccccaataaatgatgcatttaagatgcctgctctttccagagggagtctcgtattccattcttcttgcctcctatcacagtttcttcctgagaaatgatagaaataaaaagctctatctctttttatctgagtcacagttgtctcatctgtaaaaggagaggtgaagtccgacggctaggaagtagaggaagcaggatatcaaacccaagtaaagtcaggctccagaatctctttctcgctctgttgtctcttcttgatcagttccttaaggctgtggtgacggtgaagtgagataaggcatgtaaaacagcgcagtgtagagctctccgtaagtttttaatgaaaagtaaatatgatttttgttagaaggtagtagctgatctacagtagaagaaatgtctgagcagtaaccttttgaaacataaaacacaattttgctttgaaacaaagtgcagtagatttacagaaaatgaaaatgtttatatggaacagttggttgtatggctgaacatgtaagatttgattatcagttgaatattgtatcgttaacagaaacttctttaagtatttcacagtgatatataatggcatttaaaaaaaccttttaaacctaaattcactgatttttaagaattgagggagcattgcaatgcataattaataccgtagggcttggtatacttaattgaaatactattcctattggccttgtttttctcaattgaaatgaaagttgattctcagtttgtggtcaattttctacacttctgataattttgtggtggacctgagttccagaataataagtgagaatagcttagaaagagagagaaaggct

SEQ ID NO: 78671 - DNA, 1739 bp, Homo sapiens
ttagttgccaacttgatataaagtgctcttatgtatttcttatgctgtaatgtttctttaaaaattataatttttaaatgttctattttcaaattcaggcaaagtgtgtagattcattcttttaaatgagtttcaatgctgacattatttactacaaaacagcaagacaaccaattagatgtagttgcaaacatgcactataaacccctctttaaaaaaaacaaaaaacaaaaaacaacaacaacaaaaaaaacccagaatatgctctcatgttcacagaagaagaagctacagaatgggacctataaatctgattcctgcatgtgtcaaaacagtaatgtattaaatgcatattattataaaaatttaagacatgtcttaaacacacttacatttttataacacgtggcaatattaaataatacctttccttgttagcatctgtttgccgtcattgttggcaagacctatgatttattgcttaaattaatgaccaagaccattttggacctgatatatgcccctaagcttattacatcactaaataaaataaaatgtatgtgcctatgacagagttatttttataattgtttatccctttaagtgccctattcggtgattcactgaaaggttcataatggttggcttgtaaccagaaaataatctcagaaaggtaaaatacattgcttgtttggaaataaaatgccagagtgatggtgatgataggggtcccagcaagaatttgcaatgctcaaactctttcttttctcaatgctctcagtgacctcttactgaattttttgatacacaacctctctaccaccatcccaactcttaaagctatctgttaatgctggcactcactttcatataaaccctgcattatggctaaagtggttttttgctcagacataaagctgtaagggttaaattattctgtacttaggattttccaggtaccattatcaccatgcattaaactgagcaagattattttcctatttttcgttcttttcttttgggagattggaactttactattttttatattgaactgtatttgacttcatcgtctttatctttcctttctgacggtgcagtatgatagaaccttcagtatttttacaataacctgttattcatctaaagtcactctgctgcctgacttgcaatacaatattatatggctttgtggtttctttgctccacatgaagtatctcattgactgtcagttctcctgtcatctgatggtaaggtcaagtttttgagaagctgatgccttgcttctggattgtagtatctacaccttgaaacatatggagcttctttgggaacctgagagtgttttttgtgagaagattattattttgtagatatttgggaacaattctcatttattttatcactcataaatggacgtaaaacttattatgattattcttttgagaccgggtctcactctgttgcccaggctggaatgcagtggtgcaatgtcagctcactgcagcctcgacctcctgggctcaggtgatccttacacctcacgctcccaagtagttgggactacaggcgtgtgccaccacaactggctaattttttgtatttttagtagagacggggttttgctatgttgcccagtctgctcttgaactcctgtactcaaaccatccacccacctccgcctcccaaagtgcctggattacaggtgtgagccaccacacctgacctgacttagtta

SEQ ID NO: 78672 - DNA, 1051 bp, Homo sapiens
ggaatatgaatgttgattaagcatactcccaggctttgaaattctgaaagcagtgtcagaataatggatgttgagcaaatgtcaagcatttgttaatttctctgttatttggagtttatctaccatgatcaatcaaataaactagtgcttctctcttgtggcatgtgtcattgatatggtgattaggtggctagagagaccttctgctttttttccaggtaacagattataaacgagtagacagagcttttcagttaaagatttgtttatggcttggtttagtagaaatttgtatattaactgaatactttggtggcagtgtgaaaatccgtggccacatgtcaaagacataaattctgggaccatttataccaggagaactagtattggaggcatgttttccatcaaagtatagttttcagtagtttatgaaactttgatgtaaaactggacaaaagaaatggatcctagatgaatgctaaccttaacatttgtagatagacttttcaatccatttttatgtcatttttcctatttcaatggttaattctaagttagtgattgacttttattcgtgagtgagagtaaatttgtttcatgtgattcaacataatttctattatttttaggaagtaatgctacagtgttttgatgtcccaagtaggggtatcaaaaaaaaaaaagtaaaaggttcctttcagagtttacttaactgtggattattgtgcagtgctaacattctgcagtgtgaggagttggttcccttttagaatgtgaatgactttaccaactgggatttcattaggggttgagactaggtacgatgtgtaactgtcctacccttcagcacggggtaacttggactgaaaagggacctttatgtgaaattttagtggctggaatcaaggtagatttgtgattggagatttgtcctttttctataccccattttcttttcgtagtcttaggcttgtagcttacatgattcagatggagactagtgtaatacttaccacccttgaccatgtccaacaggtacctctgtggtctt

SEQ ID NO: 78673 - DNA, 1080 bp, Homo sapiens
ctacttgggaggcttaggcaggagaacggcgtgaatgcgggaggcagagcttgcagtgagccgagatcatgcctctgcactccagcctgggtgacagagactccgtctcaaaaaaaaaaaaaggtaagttgtgtttttgagccatggcagcatcattggtgctaaatatacaaatcacactcctctgggattattactttggccaaagataatgtgagtaaattagctccttcttttagctgaaaaagtttattttgttactttatccttgtacttagtaagtgcagactctccttccttaactattagcccttattttatgcccaccttttctctgtgctccccaaatgtagactgactactcagaagctaaagacacattccctttaactaacctgtttccgttacccgtctctctggtggttgtttataaggcaggcttcttagaggaagaagaaaagtaaagggttagataatctaactaggcagttaatccttgaaaaccagagtggtagctcaatttaggattttcagttacattttaaagcatttcttatttgcttagaaagggagactatagtaatttttgaattttatcctatagcttacaaagcattttcataaaactttctcctttttctggtggtagtgatggagggggttggagatacttctttaggcctctatttgggatagggtttgaaataggatgaaacttatttgctatttatttttattttcttcctgtgtttctttctgtatcatataagctcctactctcctattatatcattgaaactcatgctttttatcagaataaagaggtaaaattcttccttgtctttggaagggacttatacttactgtagagttggaggaatcactacaaaaggctgagtaaaacagagaaccctgaaaaaagagttattgtccatttatttagcacagtttctgtggtagggaggcaacattaaacattattttaaaaactgcatttgtgagatattaatagatgccttggtttgctgcaaattggttaaactttttttttggtaatatttaaatcatagagataggact

SEQ ID NO: 78674 - DNA, 1006 bp, Homo sapiens
aacatcagatgaaaatacttttggggagcaataagaatgtaatcaactcctgttggttttattcaagttggaatgctaattttgaaatagtctcattaagttttatattattatgtcagctgaccttttaaaagtatttacacatatagttagtacactcagaagaaagtatacctacttaacagtaatatagtaaaactcctttaaaaaaagctttttccctattttgtaaaattccaattatgttttcaaaagaatttatatatgaagaaaaagcacctaagcatatatgatgatatttaacatattgtggtgataataagaggctctttgcctaatagatttaccaagcacaatatcttagtttaaaatggctttacggtagttctttttgtttatgtggtcacatatatcagctgccaaagaattgtgttttctgacatagaaaatatctaagattcacatggtttaaagagaaagggggatttagacccttgtcctctgtgcttctctttcattaaaaaagaaaggaaagacggaagtaaggaaggacataatttatggctttatgtttaagatttaactactgtttaatgatgattatatcagactttctcaaactttgaatctgatttcttaaattcatacctctttcctagatgcatttcttttaaatatctatattattattttgtactatagccgtgaaatcactatcattgtcagtgtgtataatacttttgtaaaggattaacagattaaaggagaatttgagtagctttgacctacaaatttataaactgcaaagacttttctccatatgtgactagcagcatttttacttcaccatgatttaataaagtttatataaatcaataatgctgtttttgtaacttgtattttttttttaatctggaattctctctgttctttgtagaaactcaactagattatgaaaaagttagttctgttaaatagcaaaattgcatgttgactccttgcaaga

SEQ ID NO: 78675 - DNA, 1041 bp, Homo sapiens
tggcttctgtgtgtagtcagagtgtgaccaccatccatcacctcaatagcagacatcagatttgttcatcacttggtttccaaggtctaataatccctcaagaatttagagtgttgttgactgtccccatttacatcagtgaaggctttgcaacaggtgcagctgtgtatactaattgcagggtgtgcctaatctgtccagaagggagagtacctccaaatttggtatcttaaagagtggagtgaccttttaaagtcccagaatgagaattgccaacaattccaacaggctaattatacccacaaggagttgtgaagtgcttttaagttttcctgtacacctaaaagttcagtgaacggcttgaagtcattaacatatgacagatgcactcccttttcaagagcttgtatgataagttttgattgtagaagtgggaatttgacctctagcttatcacttgcttcattagcgtgcttgaggacaaggagttttttttttgttttttgttttgacgtgagtgttatcttactcatgttccagaattctatctgcctccttctctctgctgatctgaagtcacagtagataaccttgatgctggttttttaaaagcatcacgcattgtgtagtgttacatatattttatatataaatatatacactatgaatatgtttctgagcatgggtctttcaaagttttgattcattattttagatatactacctcccatgtgatttctgttctttttcatggaaaaggaagaaatacactttttggctcataaagatgactgaaagtccgacttctacatttccacaaactgaccacttcttgaagtgaatgagaataagggaatgaagtttgggactctgcacacacatggaggaaagtatgctacccaaagaatgaacgaatgctagaggtgtacccataaagagatgcggaaatgaagcttagaaggatttcatgtggtaaactctgtgactgcagcacttaaatgaaattgctttttattatctggttgaaaaatcatccaaaat

SEQ ID NO: 78676 - DNA, 2939 bp, Homo sapiens
atatcagccttgtgcaaattccagtattgttccaagaatataatgcaaggctgggtgcagtggctcacacctataatcctaacactttgggaggctgaggtgggcggatcacaaggtcaggagttcgagaccagcctgaccaatatggtgaccaatatggtgaaaccctgtttctactaaaaatacaaaaattagccaggcatggtggcgcatgcctgtaatcccagctactcaggaggctgaggcaggagacttgcttggacctgggaggcagaggttgcagtgagccgagatcgtgctactgcactccagcttgggtgacacagcaagacttagtgtcaaaaaaatatatatatatataatgcaaataaaattgtaaaagtattataccttttaatatttcagaacaaaaacttatttaaaaaatttattctgttggggcacgggcctgtgagccagttagagttgcagctgtgggaacgattgggccgagcagaggacgacatgttgtttttcgtggagcaggtaacatctaaaggaactggtttaaatcctaatgccaaagtatggcaagaaattgctcctgggaatactgatgccaccccagtaactcatagaactgaaagctcttggcatgaaacagcagccacatcgggtgctcatcctgaggttaatgcagagctctcagaagatatatgtaaagaatatgaagtaatgtgttctttgtcttgtgaaaccacaagaaatactacaggcattgaagaatcaactgatgggatgattttaggaccagaagatctgagttaccaaatatatgatgtttctggagaaagcaattcagcaatttctacagaagacctaaaagaatgtctaaagaaacaattagaattctggttttcacgagaaaatttgtcaaagaatctttacttgatctctcaaatggatagtgatcagttcatcccaatttggacagttgttaacatggaagaaataaaaaagttgaccacagaccctgatgtaattcttgaagtgttaagttcttctcccatggtacaaattgatgagaagggtaaaaaagtgagccaagtcataagcgttgtattgtgattcttagagagattcctgaaacaacaccaatagaggaagtgaaagctttgttcaaattgaaaactgccccaaagtgataagttgtgagtttgcacacagtagcagctggtatatcactttccagtcagacacagatacacaaaaggcttttaaatccttaagagaagaagttaaaacatttcagggcaagccaattatggcaaggataaaagccatcaatacattttttgctaagaattgttactaattaatggattctagtatctatagtcagcccattcagactcaagcacagtatgcctccccagtctttatgcagcctgtatataatcttcaccagcagttctcggtctatagtattattcctcagtcttggtctccaaatcctacaccttactttgaaacaccactggcccgctttcccaatggtagttttgtgaatggcattaattcaccaggatcttataaaagacatgctactgctatgaatatgggtcgaccattccaaaaaaaaacctgaagcctcattttaggtcatccagtggttcagaacactcaacagaggactctgtatcattgggggatggacaattgaacagatctagttcaaaaaatttttcaactgaaagcataatcctacagtaactggggattaggagcaaacttaacttcaaaaggagacttccactttgcagatggaacaaaatggggactatggtaggggcaggagaactcttttcagaggtcgaagatgacgacaagatgtcaatctcaagacctcatccttcaacagctgaatcaaagcctccaacaccaaagtttgacttactagcctcaaattttccacctttacctggaagttcatcaagaatcccagataaactcattttggagaataggatgtctgatgttgttaaaggtgtctacaaagaaaaggataatgaagtgttgagagttagttgcccagtgcctgcagatgagcagacagaatgcacttctgcccagcaactcagtatgagtaccagttctccatgtgcagctgagcctactgcattaagcacaactcagccaaaaaaaaaaaaaaaaaaaggatctaatagaggattcctctgttcagaaggatggtctcaaccagacaactataccagtttctcctccaagtactacaaagccatggagggcaagtactgcctcaccatgtaatcgtaacataaatgtagctacaccgtgactctacaggaaccctgaaagttaagttatgctgaagtgtgccagaagccccctaaagagccatcttcagttcttgtgtagccactatgggaacttcgctccaatgtagtgtctcccacgacaaacaaagacaatgaagctccttagaagtcccttgagaaaccaaatgagaagccagaagcaagggctagtaaggattattctggcttctgaggccataccattcccaggggagcagctggaaaaatcagggaacagagatgccagtttagtcgtagggctatacctcagggagtgacatgacgtaatggcaaagagcaatatgtgccacccagatcaccaaagtaaaaaacaacaaaactattcaaaaacttctctctcttcccgttaaacttgagctgtagctatattgaactgttttggaggggagagggtaaccaggaaggaaacaggagaaagtacatccttaaatcattatggattttggagttgtgagtgataggatcccaaaattcatctctgatgtgatttataaatgctggaggatttctatctatctatctatctatctatctatctatctatctatctatctatccatc

SEQ ID NO: 78677 - DNA, 1028 bp, Homo sapiens
tctcgctcatggtaataatatcataatttagtgcctactaaattatgctgaacattgcttgttagagaagtgattttgtcacttgagtaagaattgataccattactctctaacgtctcatgttatattctaaacccttttgacaaatgccctttgaaagctacatttatttctagaatccagtcacttctgttttcctctgcatcaggctaccatgattaaaatcttgaaagccaaacaaattattgaatttgaagttactgcaaattggtgaggagaggcgggtgcttctaggtcttcataaccttcttgtctattttcttgtgataaccaagtttaagccagggacctcctaaagaaaatatgtgaagaattgaaattgtgaggttaaatattttgtatatgtgcatacatatatatgtatattattttttaggtaacttttcaggtaaagatctgacggctcttttagtaaatatctggattaagtcttatatcagaaaatatggtaatttaggagaggctggaatttcagcagtgaaataattgtgttagaccacgagatggttatttaacctctgttggaggaagtggtaccttacaatcagtggtgaataaaagaagttaattattttccttgatcttctcactctgtggtttgattactttaaaggcctagaggtcttcagagacaatttaatcactgtagctattgacctagaatagaactgctacagtaggcccacataaaaatgtccagtgtcaatatgattatgggttattattattaggaccaaggcgcagttttttgataaaactctacttaaacatcttagggctgtaagtagagagaaatttaacaaatttaactcttagatttgcagaactgataaaatcatagaacttttaagatgaaccggattctaaagaagttaccaatcagtttacagacggtggaattgagacctacaaatattaagtgatttttccaattagattttaagcacttcaagaataaagacaatatt

SEQ ID NO: 78678 - DNA, 1119 bp, Homo sapiens
aattactatgaccctgttggcttttacatatataccgtaccttgtggtacagtctgaagacatcccagccaagcaatagagattaaaatgcataggatcatagagtagaaggaaaagaagtcctgccatcaccacaattcccaagctgttattcagtgttccctatgtgctagtcactgggctcaagaaataatgtcattcttgttttgaacctcatctgtgacatatcaaagatttttttgtgttgttgttttttttctttcagaaacacattaaaagaacacatgccaaacatcatacttcggaagcaattgaaagttattaccagaggtatgaccttcctgccccactagagggtatcatagtacctattaattgtaataataattatgaataagttaggttattaattttctatgtcatatcccaagacattgtgttttaagtattttattcaaaacttttagtatgtttttgaatgagttttcaaatgctttgttttgtagatctaaagagtatggtaaggctgtcttgacttgtgtgtgtgtgtgtgtgtgtgtgtgtgtgtgtgtgtgcccatactatgtgagatgtagttataatattatgaaatctcagttggctacttgaaacttattataagtgcatatcctgtctaaatgcatatgctcatatatacatatatctacatatatttgaaagttctcaaactaattttcatttcttagattagcaagttgaaaaaagaagattgaatttggatgtcattttattttgcatcataggtattaggatatccattttagaaatgaaaaaagatgtatcaagtaaaggcatttggagatatattgtagtgtataacggtcacattttaaaggggattttgtatttttaaaagacaaccttgggtattaaatcaacagcatagtatccaggagatattttaatttcagcctaatttattataaataaatttcaacttcttgttctgaaacaatatttaaaatagctctgtttttttattttaaaatttgtattgtcattgtaatatgactgaataatttataacactaaatggtaatggtttgcattagaaattgttagttggtttcttaaatc

SEQ ID NO: 78679 - DNA, 1105 bp, Homo sapiens
cccagtgctcctggacctggccaatgaggtaatgttattgttatgattttatttaaacctgcgtgtaacctaaggggcctatctagagtaactttgcttacaattataactacctttggaaaaaaaaaggatttgaggtgcattagacatttaaattgctccctgatctctttgtacttttagtaattggacaaagaacttcacatattaataaatcagttgacataattagtctacttcttttaaggcaaatgtataaacagcctcttggtttcttattttgtggaaaatttcaaccaaacagctcaggacatgcttttcttaggataggttgtcttaatttagtgtgagaaatacctgtgtcaagtaaagagatggatgccaaaaaaaaaaaaaaaaaaactgctgttataaaaatgaagagagaaattgtatacttaaagatgtacttgattcatttttttgttagcaaacttttattataataaaggatacatgccttgtagaaaagtctccttctttatatgaagaagcatagtgttcttaataacaccaagtaagaagtgatttattgaacttattcgttaactctgatctgcttctgtttggggaaacaaataacagccttacatttaaaaagggaaaccctacagatttcccatgaatgaagaagctgtgaaaagttcataatagttgcagagagcataccaaaaaaataaaatatttaattcctaaactttaaaatatttatccactgtaataagagcaatacaatatttagtctgacttggaactgcttatgcaaacctcgtagggatggaatgaaatgtacactgtttttgcgttgcattataatggaaaacatagaagcaaggcagaaaatgtgtgtttgcattaaagatgactcggtactgtgagcattaagtgttgcagtagcagcaagttctacatgttatattagcaaggaaggatggcttccctcacagcttctgtctgctgctatacactgctgcagtcaacaaatgagcaattacctatcagttactagatggttttaatagtctaagcaatgtctacacaatcagataggatagttaacatatag

SEQ ID NO: 78680 - DNA, 1059 bp, Homo sapiens
atccttatttggatttgtcatataaggacatttgactctgtttttgaaaactgtcactaaataacaaaaagggcttattatttgaaattgcattcagaacagtataaatatagacagttgcatagaaagaagcatggcttgaataaaaaattatattggcctaccaacagaaaaaattgaggagagatgaaaaaagcctatttcactgttttagacgaatgctttttctaagttgttccatcctttttgctccaatgttatattcaataaatttgacccatttattcttttcaacagcccaaaccatacttgttataattttattataatggaagccaccaagggtgggaaagattttaatgaatgatgcttgctatggttgattaaaattgacttattcttcagtgttgacaaaatactggagtatccactgctcgcacaacttgatagttttaattttctacttctgttttataaaggtggactatgcgccctcattaatggctcggcttatactggagaggtttctacaggaacacgaggaaactccacgtgagttacccttttttcctaatggtactcttttactcccttccccaatttaaaaataatttacacagcatttcaagtcacttaatgagagccagattccaaaacagctatcatgaacagttaatgacaattaaatgcaatataaaagaccacccacaacttaaatactcttcagaataatgctctcttctttgtctaaattccacactcaacctctccattgagctaaatagacaatgtgtatcaaactaaaaaattgattcatcttcgtatatagaataagatacatcatttgaaaaaccattgtcaggaactggctctaaaagaaacattcatcctttttattttaattcagcaagaccggagaaatactacttccaaatgcaaaggtgaattccactggtcttcctacaagaaaataaaaaagaaaaaaagaaaagaatagagctacagaaggaggttcaagcctaaattaatttgccactgaaaaaatacattttgttattt

SEQ ID NO: 78681 - DNA, 1050 bp, Homo sapiens
tgccagtcaaaaatgctgtattaaaatatttctctggacagaaaatggtttcaaaaatcttttatgattatatgacaaaccataattgagggtttatcatttcaaaaagtgacagaaaatgttaaaattaatgccaggttatagaagtcaattaatttgctgatggtgctaggttatcttcctttcttttcttcgtctttttcattctctctttttccttccttttcttttttttttttttttttcttaaagaactttaagttactgtggcttatattctgacactttcttccccttcagagcatgggcctggctggcctttggcaatgaaattcaatgcacatggctccgcagtcaaatcatcaaatttccctgtgtgtatattagagttttgtaatgtgtttccattatgaaacaatgcggggataattgtctttggtagcaattagctaacaggtttgttcagtgctattggcagaggcatccatcacccccttccctgaccacactttttgtctagtgtggactatggagatcaatagaattctatataggggaaatcacctcagctttaatgagctgcaagtctcagtcttggcttgtatttttaattttttcctcttaaaactagaaatcaggcaaaaaaatcctattcttttgggggtggattgtactgtgtatttactattactttcattagatcaatgctcagttttaaattgtttttacttctgtaaaaaggtatagctaatagcatgggacatataagccatgtaattttgataacatatactttaggaatatccactttaaggagtactgttgggtttctcacgcgataatttttagggtatgatatatacattctgtctagtgtctcagtagttaaaaagaaacctgagtggctcttgtgatgacaaacaattttgttgtacacattttgttattgcccctgattaaataatgttctatagccttttagactacttttgtgttgtactgttgcttagcctcacaacaaaactagtgtactgataggatacgtatttt

SEQ ID NO: 78682 - DNA, 1021 bp, Homo sapiens
gagtaagtttcacactaataatggtgactttctactaggagcattatagaaaatctctgttaatgaaaactctaagtatagaaaactgttaatgaaaattttatgagtagacatgataatggaaatatccttaaacaggataaaattgtctaaatgttcagtccttttatgaaaatcaatcctctataacttataaggtgaacactattattaatagggaggttgacattataataaaattgtaaatcgaccatgtttactgctactgagtctgaatataaggcagattaaaatttctgaagaaccattgagaaaatacctcaatcctcattataaactgatgtttttgcttatgtcctggagattttatacagcttacctttgctttctttcatgttgctgtttaatctttctggctttgggatagaccgaggttaatagtcacatcatttgaaactgagccatacagttgaatgtaatttgccgtaaagatgaatgttttgtagagttcctctttattttcttaagggaatgtgcttttcaacataatgtgtataatccctgcctccacacacacaccagaatgggattatgatttccctgatgggattactaaattttgttcttactttttgaatgagcttaattttagttttcaaacaaactggtttataccttttgccagtatgctaggccatcaaaagatggtacaatcatcttcaaaacctgagtttcagtatgctaggccatcaaaagatggtacaatcatcttcaaaacctgagtttaatagaagaaagtatgagaaggcatccagtaggtgtttagatctgattagactttgagtggtccctttctaacaataagaggatattaattcctttggaattcatgttcttcattcctctgcagattgtcaagagctatttgaatcctaactatattccaggcactatgttaggtgctacagtggatggaagaaaggataaaactcatcaaagaactcatagtttagtggaatgt

SEQ ID NO: 78683 - DNA, 1038 bp, Homo sapiens
aaaccgaaggagagtactattacagaaatagctaaatcaactctcatttatttaaaagtacttttaaatagatttggtattagttataaataacttgcagctcactttgtaatagatcatgacacagaactatgtgttgttgaccgcagttaagaaccaaggttgaagatgatccagcaacactgtaaaatgtgttgaagtaaggtaattctgagtgtagtgagaaagaccaactaataagctattgcattatctttagcaaacttcaggtctgaactacggtttacaatgaaagtaataaaggaaataaagtctgtagacatggcaatttactggatactggtagtgaggaagtaaaaggaacccaggatgcatctgagatttaaaagttgggtatctcatgctaagaggaataagagttgctttgaatgagagaagggaaaaaatggaattcacttcaggctatgaaattcaggttccagaccacagtttatagaagagttttataaatgtggaagtgtgggcttctttctcagagccccatatttagatttgtgaatcatgtataaacggaatggtttttccaagcaatttcaaataggaggaagcactccgcattctacatgtgaaccctcatttgattcttaattattcaagtgtttatttaatccacaaaattattaatgattaaattttcatttgtatacctacatatttcaagaatgaataccttattgagaagtgaatacattgagcttctctagctcattctagagggtaatgcttccaactgttcgcaagcctcctgtttattgatcacactttttttttttgagacggagtctcgctctgtcgccaggctggagtgcagtggcacattctcagctcactgcaagctctgcctcccgggttcacgccattctcctgcctcagcctcccaagtagctgggattacaggcgcccaccaccacgcttggctaattttttgtgtttttaatagagacggggtttcaccatgttagccaggatggtctcgat

SEQ ID NO: 78684 - DNA, 1066 bp, Homo sapiens
tgatatacggattttaattatatagtacactgttaattgtacaactatttttagatcaggctactaacttgttcatttaaatgaatagctcatttgcttgagggaccaaaatgtaagctttcttgaaaactcaagagaatcttgaaaccgctgcaaaaatatgttaacctggtaggatatttttatggtatttgtctctccttaaaatgaagctgacctgtacctcgccttcgttgcataggttgtttgacacatagaattttgactttttttttggtacctaataaagtgcaagaaagatagatctctgtgttggataatgggcagaaattgaatagcggtgttttccttgaaagttgttgagatttttctcaggagaattagacgaaagttatttctgaatagaagcactgtccctggctgtaattagtcacatgggtttagttcccaggaaatgtttctttcagcatactaaaagtgtttgaattttcatatcgtttaacatgccttgaaatttcgcctctgctcacctacctatccctctcctacaatttaagatataaagtttaggttgttctttcccgttagattcgggagcctgccgaaaaagaacacacttttgtgccccctttccttgaatacttccaatcctgggcaacatttttaatgacttagaattaactgctttctaattatgcactgaggcagacaccatgatgttgtatgggcctttgccagcaattggaaacacaagagacataaatgagcaggctaccagagggaattattagagaggcttcttgaagtcatcaacttgcaaagcagagacttgcccttgtctcattgaataatacagacttggtcataccagtagccactgtggtatcacctttagaagcatccagttttctttcttttcatagactataagacatttgatctcatcaggctttctggataccccagtaaatttcggtaggtctttgctgccatgaactttctcctctgatcttgaatgggagttttcgctttacctgtatctcacctctcatgttgggccccagtg

SEQ ID NO: 78685 - DNA, 1660 bp, Homo sapiens
ttaaaacaactgacttcctctggcaagtttcctttcatttgaatagtgtttattcaacatattcagacttttaaaaaaaagtttattgcctatgattcttaatcctgataagcataccactgttctaaaatttatattgtgaggaaaattatgtcatcagtttattttttcttttgatatttcccttttttggctgaaaataaatgactacttttcttatgtcacggagtattgtcccttttctttttttaaaaaacagcctttgttttattattttagccaggagtttgcatatagtttgatatgagatctgtaatttttataggatagcgttcttagtcatggccacttacatattagtgatctcttcctcacatgggttcatgagagttggaatgtaccatgactggggtccatacagagaaggtgctcctattttcttaggcctctgctggcattatgggcaacataaaagaatgtgtctgccattaccatgtggtgactcgagtggcaggccagagagagttccctctagaaggtaatgaaaggtatggacaactgctttggtcccctctgactggccaggccttagaattaggttgggaatactgagtttcccaggcacattatttttttaatactattgctgctgtaatcttttcttttataagaagatgattcattgtttcctattcccgatatttttaccacttatcagtggtaattgctttcagaaataattgagtccaaccctatggtttgtatgaagtaaatacctaagtttgatttgattcttactattacttgaacttagcaaaatagtgctttagctgtcttctctagagaccacacaagaacactttatttcggtagtcagcttaaataatattttcactttctacagatagcaatgggcattaaacttgggaagctatgtaacttgccaaggttgcagagccagttgtagagatagggctggataggatagctgggtgatgctcttttggagattccatatgaccttttcacttgcagtgcaaacacgtgttcacaaatggctaagtacataagtgttgctataagcatgtagttatatgactaacagtgggcagtaattaaaataatcatgcttcattttttctttgcagacccaatactatttttaagtgaataagatgtaatttccttatttatttccacagtatttactaacatttttttctttttttttttgagacagagtctcgctccgttgcccaggctggagtgcagtggctcgatcactgctcactgcaacctccgcctcccgggttcatgccattctcctgcctcagcctcccgagtagctgggactacaggcgcccaccaccacaccctgctaattttttgcatttttagtagagacggggtttcaccttgttagccaggatggtcttgatctcctgacctcaagatccacccgcctcggcctcccaaagtgctgggattacagacgtgagccaccgcgcctggccactaacatttatcttatgtatcagtgttcttatagtatagagcttgataaagaacataatcttaaaagaaaacaagttagacccgaaattatctcagaacttgaatgatgataattagataattattcagtatgcattttaatttg

SEQ ID NO: 78686 - DNA, 1029 bp, Homo sapiens
aattagatttaaagtgttgtgacaggtaaatttagatagatcattttaaagccaactatggaaaaaatattggtaaataaacagaccactaatcttagtctttcttgtttacatgtgtacaccttgaattttgttgcagagatgttgcaaacatgtttaatttattttgatcctttgctaagctgaagtaaaatctctctctctctctgttggcttctaatttggactgcattcaaaagacaaatattctcatcttttaatatattaacccttcttaatttaagaattatgactttccctaaaatattttaccccattctaaatttgccacacattgtgctctatatttgttttataaaatgcatattttatctttactcttaacaattgaagggaaaaataaattactaattctttcttaaatgtccttggttcataactacatcctgagcagttgttatggcacaagatctagccaggaactataggaaagaaaaacagaagtgttcttatcattgaagatttgaatgtactgataggagttcatcctatcttttaaacttatccaatttgtacttccacacataagtatattgtattaagacaggtcaaagttgaataaatgactttagtttctccaactagaaaatatttttcatgtgcatatttattcatttattccacaaataagttactaagttggatactgttttagacactagataagtcagatgaagtgtctgctttcatggggttatggtccagtagggagacaagctaccaatgaacacagataatttctaacagtttctgagagtccatgtaattcttcccttcattatttattcattcttttcaattaacttttgttgtgttctctgcatgccaggaactacactagttagtacaaagtgattgattataagcactctgtgctcccagtgctcatagtcaagcaccgtattgcatgtgtgatccaatgagaatgcagttttctctctgatccagtgagaatccagtgagaatgca

SEQ ID NO: 78687 - DNA, 1054 bp, Homo sapiens
ctgccacagccactgtctggtgcaaattcttgttaagtctggcctaataagaatggttctggagatattttattctttccagtgaatgtttccctgttagtagatgctaacaattattttgagtgacacctgggaggcatttgctgtgcccctgcctcaccctcgcccccatgtttggacaaaccagcaaattttacaggggtgcttgtgtagcatttgtgtattactctgtgggactctgagagagtataatctgtaaagccaaataggcttagtgaaggatgtcccttgtcgtaagaaattaggatctttgtttctaagagttcatctgcccctgctgctttattcctcacctgaagcaataatactctgctggggaggtgattatgatgtgacaaacaggggattatgacttcaggtgaaggacaggcagcaggagcagatgagatttagaataccaagactgtgtgtacacgcagatgtcagtggcagagagtaagagaccagaaatggaacatacgattatgtaggctgaagggaatggagatggctgggtatttcataaggaatccaccatttaaattcttgtctatccgaaggttaaaaatatgatgctgtttttagagtaacaggaacatgaaattgagggtgggaggtgggggatttgggctctgttctcccctttctgaagagattgtcatggtgagagactttcttacttactccccttattgaatgtgcttgtgcatgcttctccctggcactgagaaaaggaccataaatgcatatgctgctggaagatgaaatgctttctggatgtttgttttcttatcggctgaatttgagattcagctccctggaactttgaagaaaggttgttgtgaccacttacgatggtgtgctccctgctcctggccctccctcaccactgctcttggtagttagctcatgtccacgggtcatctgcttttgggtcactaatgatttattggaactattttggttgtaagtggcagaaatccaatcaaactagattatatacacaaaaaaggag

SEQ ID NO: 78688 - DNA, 1077 bp, Homo sapiens
tttctcctcaataaaatggactgagtaaaaccttttttgccctattactctgaagatcagttatttaatatatgcaaagcactttcacagtgcctggcagtcaaaaaaatattagttcccctctgcctgtttttctgtataccactgatgaagtttagaagtcttccgactagacatttttaattgccttctttgccacataaactactcagctaatttcagcactcagcttggctgacatctctttgagaaaccttcctgccttctaggattgggtttgatgcgcctcctgcgttttgctaataatttcgtaacatctatcaaacatgtcatcgcttgtttacttgtcaacctcctccaattaatgttgagttccatcttatctactggttttatccatctttggttgtccagaatctggcatatagtaggtgatagtagatatttattgattgtatttactgatgtctgacagacaataatgttttgaatcggccattgaggaatttgtcaggcattgtgacattaagccttagtacaatcaaatttttttctttgagaattcaactcgaagtatagtgaggaaaatgcctgatttttctgaaaaacttttacgcacttttcaaatgtgtagacttttgcagtcctatttcatgaaatagagcataaatgtatttaacataaagatttttaaaaacagaaaataactgagaactaaatgacaaatgcactttataaaggtttttagataaatatgtataatcttatgttggtcggttgctttcccaaaacttcagacagttctctcatttgaaatttgacatagaataccgtgaaaattctaagcagaggataaactctagtttctttaagggttgcatgaaactgggcctggagcaagagtacaaatggagccttatatactatgtgtctaaatatgtaaagttacatattaagttaacagaccttaaataaaatatattctattctacatgaagagctgaaagtttagaattgcataagaattcctagattccttggatttccaggctccgtgtgtcagtgcagggagaggtg

SEQ ID NO: 78689 - DNA, 1024 bp, Homo sapiens
atagagtactttgagaaaaatgacttctcataatggttataatggataagtatcattttttcagcatgttgaatgtgaataacaagacttttctaagtgaggaattcatattttctgccatcattcattggttttaacaaaactgagcaaagtatagaaatgttatcttaggcctttagagtgatattcgtaataaggagacaattgttgagaaactagaatgacttaaatcaaagaaaacagatctataagggaatgtcaatgaattatagtttctctggctagaaagacatctaaatgattactcttttcaagcatatgtaagatttttacaagaggggtatattgaccagtttcacaaatccaggggaccagacaattgttgagagaatgacttcgtgttgacacccactatgacaaagttaatctgagtcatgtatagctcagaaatcttacaccaaaccaaaccaacaagcaaaggattgagtggccgttctaggaatggaaacacaccattatgatcatccagagagggtaagggaaaaataaatgagagtttaccaatatcgggagtatagttattgtcaagaacccaagaatacagagtctatttctgaggctaattctagaataatggagatcaggtcaaaattgatactaaaaaggcttggagtctagcttaatggttctcaaagtttactgtgtgttaaaatcacatgcgggttgtttttaaaatattgatgttggctttaccctattttaattggtgtgcagtgcagcctggactctgggatttttgttgttgttgttctgtttgaaaactatgatgaggttagtctgtatctaacattgaagtcagactcttctttaccgagcctcaacttgctagctagccgtagcattcttagcttatctgcttccaaacagagtcttcatgaaatagttgctttatgaagaaatacaagtccaggtcagcaaacatttacaggcactgtgttaggcagtagggactcagcccctgcct

SEQ ID NO: 78690 - DNA, 1193 bp, Homo sapiens
attcaagtatttcagtggttttgtttccaaatgtgataactgtctactaaatgaaattaagatacttttgtccaaggtaaatattttaatggcatacccaaaattaggactgaaattttgaagtatttgttttagctcttcacctgttttactcatatcactgcacttttcagtaacccctagacatcatacatctttgtttgaatcatttctcttcctattttctccaccatttcaaatggtgtcatgtcactgggagctaatgcccactatcagctgagcacattcagcttctgtctacattaccactcggcttcagttccaatttcctggtattcctcattcagatcagacctcttagatggtgtgctatgagaactgacagccccccatcctgctctgcttgcccagggcctagtcacacacactccactgtgccaagcgtggccacccccacacacctttctgttcaggattttgtataacttttaattgacatttatgtctgacattgtagatgtacttctcattgtagaacatttatctacataggaatagttgaaaactgcttttcacttaactattacatggattaatgttacttaacaatgacaggtttccctgctgaaactcaagtgggcagatagtttcttgtttctaaccattctccatctaacattgcaacccaccactcagcactattctcactaattgcttgagtatacagcaaatccatttgaaatgatagagagagggttaagtcctgagtacagtataaactgtagtagagcccagtataaggcatttttttttctatatatgaaacaatcttttaacagggtttatcagcgacttaatttctatacatatctttcctctaaattcaccccagctacacaagtataaatttacccaattgtttctaatataatggcattctatatatatctttccctctgaaagcacagaacaaagttctgttgttttgccaggttcctggccttcttttataaattcttagtaaaatttctttcattgtggtgagaaaaaaatatattctatcaattattttaaaaagcaataattcattatagttgatcataaatgtcaggaagcaaagacccagctgaagcatttttgtcactaatcatgctgtttttcttctaattagttaatttacattttgcaaatta

SEQ ID NO: 78691 - DNA, 1248 bp, Homo sapiens
aagacaacatcatagctttaactgacccatatttgtatctgccaaatttaagttaattagaaatgtagacgctgtttatctgtcagaaaagctcatcttttttcttaaaaaaaaaaaaaaaagaaaaaagtagacacactttttccccctcagcatttatcatctaaataatagtcttgccaagatggcagcctcataataaactcttttcagtggagtgatgggtaatgaagcttgcttgtgaaggcagcgaaaaatgttgtctggccaaatgcatgaatatgatggctagagaatcagtggactttctcagtcatcaatctttttagtagcctcttatacatctgaatattttgatagatgatctaataattgagttatctatctttctaaatatcagagttgcataaaaattattctcacatgctactgaatattaaatatattaggcatccagtaaatttttcataaaagggccaaaaggtgaaacattgttgttattctataaatatcttttaatatattgagtgttgagccctctgacatatccagctcttaactctctctgtgagaagtaggtatatattttaaaaagagaacatacctattataagtaggacacgtaatactttggccggtaaaaagtagaccctggtacatgtgtagatacaactcagtattgtaaaatggaatacacttgttggtctaacaccagccacacatttaatatgacacaaattttccatacaagaagcacagattatatgcatgctaagaattactgtatggctttggtgtctccatgattttgagaggaagatgatcctaccaaaaggaaaaacaaagctcccaagtattcttatgatacacaggtagttctttcccctcatatggctttgtatgtggagggaggaattgtttttgtttttttgttttttgtcatgcatcactctattaaaagcttatcaacaagtatgcttcactggaattgaaaaagtgacaaggaaaattggcaggaaacagatgacttagaagtgggcttctcccacccccctaccattcacagttcttcaaggtgaccttacagtgatgacttcccagtaaccaacattaaaatagttctgccctggaagagcagacatttgtttgtgggtctgacgggttaccaatcctctgcatcttgaaaggcactcaaatgagcagggccttgtaaattggatttctattagccagccctgatgatagctc

SEQ ID NO: 78692 - DNA, 1531 bp, Homo sapiens
tttttcttcttacgacgaagtgttgctctgtcaccagactggagtgcagtggcacaatctcggctcactgcaacctgcacctcccaggtacaagcaattcccctgcctcagcctcccgagtagctgggactatagacgcgtgccaccacgttcagctaattttttctattttagtagagacggggtttcaccatgttagccaggatgatctcagtctcctgacctcaggtgatcctcctgcctcagcctcccaaagtgctcagataacaggcgtgagccaccacgcctagccaaacaattattttttaatggttttcaactggaaaagcatttggaatgaaaatcagcaacacaatggccagaaacaaaaatggcaaaaatgtcttaaaccttgttttctatttaattcctaacaatgatttcatcttacggttgtgctatttataaaatttgagatgatagacttttttctctttatttttctggattgaaaataataattcaggacagtaccaattgtggaaatatctctgtgggttacactgaggaactagtactttctagtaggtggatcttttcttggtttcgagactctccataatttggttggaaaaaaatgatattttattgtaagagctatcactgagaattttaaattcttagatatctatttaaaattatacatttaaaaccatttgaaatgtccatattggggaggttttaggggagggaatagtcttttcttaatcaaagtagcaaacatctgtgttctttctagcctgtcttttgattagcatggcctcatccatcactggtctttgatatgaacaccaagaagtcgtgtccttttgttttaaatgataaatatgcctttgtcatgaatactcataggcaacccaggatttacatctgaattgtcaaagtgtaactgcccagctcctgtgatgagtgacattattagtgaaataaagaagtttttaatttgtcatggataggccttaatgagactatgtgggttgtggtgctagaaaaagttgtccttcccccactatttttctaagatttgtcatttatcaacaagaggcaatctgccgcaggaggttctctgtgaacatttttactttagtgccattagtctgtctctaggtttcattatttaggctagatgactggtagtacttatcaaaactaatgctatctgaagtacccaggctcctgttggtcaaacaaccagcatcatgatttgttctgtcaagttattattatcaaagacagtgtttttttaaactttagctttatttcaaggtctatgtcaattatattttctaaatacatttctttgacatctttgttcccactaacccacatctactcacatgtatttatgtatgtgctatttatataaatacattgacctattcatatctacctatacaatttcatgttaatcatcaaaaccctcagggtgtccaatttaactgttgtatttgactcttcaactaagaaattaggaccattaaaattaaaaata

SEQ ID NO: 78693 - DNA, 1035 bp, Homo sapiens
cctttaatttagcatgttgggaatttacatgaaagttaagctatatattttagtttgatttagcatctctccataaaaatcattaaaatggttcaatcagtataaaagcctcacttaaattatattgtatttcaggtcatatccctcaccccacaaatgtattaatctttgattttcagttttgattgtttcaaaactaaactttagcactcattttttgaacaatatttcttgagtgccaaaaatatatattttaaggcaaaaaaatacatgattaacccttattatcaggcttgctcatcgaattcttttttctaatttttagtatttcctaaatcacctgtttcatagaaaatgaagtcttgttcatatttgtttcccaaaagaaaacaaacgcctggcaactctaaagcccaaccccttacattaatggagatttttgtactgtaatgtaagtgtctgagtttttgagaccctaaggctttcacccaacttaaagacaatgatgccagtgagcttctgtccagagttaatcagctgcagaatttgtaaactgcacatgtgtcaaagttgaaaatgttagcactctaatagaagcttgaaaaggttagatctgataaaagccatcagcagttaaagaaagtgatttatgggaatgtaatgacacaaaatgcctcatttatcactcatatatagataggttaagcttcctgtgtcatacttttaaaaacttgaccacttcgaattgtcaaaataggtacttaattgcccttcatccttttcattttgaatttatttcatttgaaattggtaatttcatctacgattactttactgtcattcacttcatatggttccatttaaagtcattcatatttaagattttcaaaaactgcatcaccgatctttttgaagttttattagctaaagctgttgcaaagaaagattaagccagtcttatatatgctaatttacacttttatgtaacacaaataccatggagatatgttcaagtttcattttctctttcctaac

SEQ ID NO: 78694 - DNA, 1069 bp, Homo sapiens
tgatccctaaaaatgggggcaaaagccaaagttaagagacatgccaaattgtatttctttcccaggattattaaaaaacaattctcaattatttcttatacattctaaggaagatatttataaacttgggatttctaaacatttattggcttatttgatgtcatttagtttatgcataaatatcttaatgctattaaataaaaactattttacaaacttcgttacgtcacagtagtattgtaaaacacaaaattttatgaatgattatcacagttttagactccttaatgtgacaggtagacttgctgaagggcttcatggagatctttcagaacatgaagtaggcagaaatgtcccaggacttcctttgcccctctatagccaaaaaataaatttgagaagtttggcaggtttcactttgtcagcccaatgctgcactttcttcaacagtgacgttccaaattcaattgaaaaagaagtcagaacagtttcttcaacaagacaaaggcacaaaaaaaatttacagggaaagggaggaactgtactaggaaaaaaacttaagagacatcctaaccaaatgcagttgatcctgtttgttgcaccttgattccatcagactacaaaaaaaaaatcacattttttagatagtcattgaaagttgaatatgaattattgtgaattcttaacacctagaaattattaattttcttaggcatgacaatgccattgtggcattatgtatgaaattgtgtcaaaaaatgtcctttctttgaaaaagagatacatacaaaaatatgtaagggtagattgagttggtgtctgagatttcctctaaatatttcaataaaataaatatataagttcatagggaaagaaagatttaaagagggatatagaatctggaagatggatatctgaggtgagggatctctctgctttgtatacattgaaattgtttgcaaaaaataaaaaaagtcaggggaattatctaaaagtaccattttaaatataaaattataacatcctatattttctagtattttcttatcaccagtataagtttttaagt

SEQ ID NO: 78695 - DNA, 1048 bp, Homo sapiens
tttaattcctaaatagtagcacaaatcatttttttgtttaaaatgattgttgatgtataacttcagccttatgtttctggcaaatgaattagagagtttataaatcttatattttaagctttgttttttatcactgtttacaaaagcattttcttgagttacagatataatttcccaacttaaggactattaaactaaatgtatttctagatgcatctttgttcagacattttatatacatatatacatttaaattaaaatcttgatttttttgtatgatttttaaaacctgcatttacttggcactttaagcacatatgcagtattttcatctttaagcaacaacaagaaaacctgaaaatctgagactctcagaatatacattgatttggagaaaatgtgttcttaatatgaatttatcatttactcaacttatattaaaggttagttagccaaatgtattgtatttttttttcctttttgtgaatcgtgtacatacattaagacaatacaagaagaaccatttcagcttaaccttccagagattaatcatttagtttgaaggagttctgttgttattttttaaatctgtgattagaaaaaatcatgtgtttatataatcatgggcatcaaaattgtctcaatctatgaatcttagcagtttgctcttgtaacaactatgaggaaatgtattagaatgccttaattacagagcaagaaaaagagaaggcacagtcttttcgcatatgatctttcaattgttcagcaaaggataaagaaggcattcaagcgtggtttcaagaactgtcagcaataagaaaatgcaaggtactttgtagggccttcaagacctttctggaaaatagatttaattaaaaagtaaaatagacttttcaaagaaatcttaaaaatgttataaaacttcatgttaatatattaataggggtattgtcttcttatcctagatgagaaaaagtcatccatgaagctattatatttgattcatacaacagtggagcttataaatatttttctttaggtttgattt

SEQ ID NO: 78696 - DNA, 1020 bp, Homo sapiens
gccacttcttgcagtggttccctatgacccagagtaagagccaaaatcagccttcatggccctagatcgttctgccccagttattgttctgacctcatctcctaccacacactccccgcttacccactctgcaacagccattctggcctctttgctcttcctcaaacttgtcaagtacgttgctgccccaggccttttgtgctgactccctgttacatgaagcactgtcctgaggtacatacgtagctcactgtccaaagtcagacacatcaccaccttctcagacctaatctgacccccccaacagcctacagctttcttttttgttccatgtttctccataatccttacctcctaaaatgatctataatatccctctgttttgtttgccccactaggataaaagtttcacaaggacagggatttttgtctgttttgtttacccctgtatcactaggattaaagtaataagagcctattatgtgccaggcactgaatggtttattttgaataggcataatgtatttttaaaatgtaaatatcatgtaccaatgttaatagcacaaactgctaatgttacaacatttgatgttcccaaagtttctgagacttggaaggaatgttacaaatctaatatatatgccatggaaaataaacaatcatcagtctttgagttttgcggtttgaagaaaacaaggctgggtgcagtggctcatgcctataatcccaacactttgggaggccaaggtgggaagctgaattgcagccagggatttgagactagctgggcaacatagcaagaccctgtttcaacaacaacaaaaaacaaaaacaaatttaaaaagccagacatagtggcatgtgcctgtagttccagctagttgggagactgaggtggaaagatcccttaagcccaggagtttgagcatacagtgaacagtgatggtaaccctgtactgaagcctaggcaatagagtgaaagcctgtctctaaatgcaaaacaaaacaaaacaaaacaaa

SEQ ID NO: 78697 - DNA, 1049 bp, Homo sapiens
ataccaacttaaagaaaaattattggtattgttttatatgttatcagtatgtttggagatcgtgttacaatatacttataaagccatttataggaaatgcacactgtgacacgtattttaaccattactggcaagtatcaaacttcaaaattaattatgcaaatattccaaatgttagcaagtttaaagtaaagcatgagatgatgtcttggatccaactgaaaataagtatgtattctcctattaccattttgattactgaaaattatacaaaaaccatgttattgaatttaaaagatccacagtgttggccatctctgcacatatcacatccaaaaaatttgaaaaattagtattctgaatgaaatatacaaagttttattctttttttaaactctgattgaatatgtatctaaaatgtcatatttactacaggaatccacattgcttagcaaaaacaacaaatttattttgtactggaaaagggcttgcccgaaagtttcactgaatatggtttgttgaaaatgctctccaaacaaaagttggggggttgaataattttggaaaatgttgcctactacattagaatattaacggctctgagaaattctgtgtcaaggaaacatgttttcattgtttaagcctacatttcttaaacttatttgatgaaggacctcttttttgcatctaatacctgtgtcccctttggaatgccctcttggactctcttgtgtggacgataatcacatcagtggtgggatatgagtgaggtagatgtggggggtggggagtaccacttttaagctacgtaagaggagatagtaaatatacttaggcatcctaactaaccatacctgtcataactgaaaagcccaaatgacatcaccttagatccgagattatgcagggaccagacagataacagaaaggagtggaaactgtggtgataccgagagatggtagcacttctacgtgaaacagccctgctcagctcatctcatgtggctatggagatataatgggcccactatggtcaaatctcgtaattc

SEQ ID NO: 78698 - DNA, 1126 bp, Homo sapiens
ccatctccaaaaaaaaagaatactacttatgaaaaattgttcaaatcataggacacagaaatatatacaaaaaacagtttttagtacaattagagcgaaaggaacaggatccaggtaaagaaaagcttcctgtgacaccacagacttcagtgtctctggggcagcgctgatagttttgttgagcaaattgctaacataattcatttgatatgtggcagtattattaagctaccatgtagaagaccaattagaggtgtttggtttgtggggctctttgcttttggaagtttgttttgtttgtctgtattggggagtggaaatagtagagagaaagaggaaggaggccaagtgggaagttattgctgaaatacaagtgcaaaatagaaaaggaacaaaaacagatacatggaagtggagaaaatatatatgggatattaaggacatgtattgtcctcttctgttaaatttaggttggaaagaaaggtatttatgataggagtagttacattccttatattcagtaccatttaaatcatttgcattgtttagtgtccaacttatttgcaccaggaattgaactgagtgcttctgagttctggtgtgctatgttctctgttttaatgcttcatctatttcaaaaacaaaaacaaaacaaaactgttacctgcatatcatacacgtatatgcatatcatatataaatatatggttccacacacacacacacacacacacacacactgctactttgtgagtaaaagaaaacaaggtatcattaaaagttggaaacgtgtctttttttttttttttttttttttttgagacagggtctcactctgttgcccaggactatggctcactgcagcattcgcgtccccctcttccaggctcaagtgaccctcccacctcagtctcccaagtagctgggactgcaggtgcatgccaccatgcccagctaatttttctatgttttgtagagatgggatctcacaatgttcctcaggctggtgtggaactcctgggctcagcgattcttctgcctcagccacccaaagtgctggaattacaggagcgaggaaacattttctaccaggaatctttatgaaatgtgtttgtaaataacaaaa

SEQ ID NO: 78699 - DNA, 1049 bp, Homo sapiens
agtggctgctgaacaatgaaaacacatagacacatgggtgggggaacaacacacactggagcctgttgggggtgcaggggagggagagcatcaggaagaatagctaatggatgctgggcttaatacttaggtgattggtcgataggtgcagcaaaccaccatggcacacgtttacctatgtaacaaacctgcacatcctgtacatgtaccccagaactcgaaataaaagttgatgaataaaaatgatttaccttcatttaaatagcttagattctgttgcctataaatatagggcactaaatttttatttatgcaggataactgtcctggttatgccaaagatatattaaatacaatgtttaattgatgactcaaaacataccttaagtttatctttctagaactttgtatttcagaagataaagtagatgaggctgcatctgtctgcactgactttctcctcccaatgacaaagaacgctatctgttttgaagtgacttttaatttgttgaatattggtggtgagtggaaaatgaatgtaaatgaaatatcatattgctggagcaggtacaagggatgtgaatgaaagcttcctgttttatgggctgctgagaggtgatagctcttaaaaagcagtctgctaagtgatcccaagttaatgcaaattaacagttgttttctttcagaactgtgtgactgaataaacatttaccatttgtttcatttctactcatctcttgaaacagttgctacaggtcttaatagtaagactcgaaacatataatgtattagccttggcacatcaaaatattgttcatcttccaaacttgagatattccagtttggcttctcactgagtttataatgttctgagggtatgtatctaaaaacgcatcttactaatctcctggaattgatttttttaaaaaagtccctgtaacttgtcactattcccagcttaaacatggtctgtcaattgtgagattgatgggcattgtggtacatttcaatcttaggaggggcctgaataagaaatttaaactattaaa

SEQ ID NO: 78700 - DNA, 1721 bp, Homo sapiens
cttccattgaaatttttatcaatggtatttgcatagacaaaatggaatcaaactattgacatgtacttttttattaaaaaaaaaaaaaagcaaatttatgtgaatggtttgtcagtggagataatttagccaaaggcacctgtgttctctaaggactctgcctgaaaagacttttagggggagcttggtgaattttttgtctttaaaataaagctgtttttgaggtataagagaagcttggtttttgaaatggcacaatgaataacaaaagccccttttcaccccccagaaaaggactaaaaagaacatttgttagactcttggggaagaattgtgctgttaacatgaaagtctagatacaagaaaagggaaaattggaagaagaggaggagcaggtaatactggagaaatgctggaccctgaaagcaacttgttttgcaaagatgattacactcaagtttgggttcaaaacgtaagaaagcatgcttatagtgaataaaacagctagaagataaaacttggcagaatatcctgccgttttgtacagacttatgcgtgggtatgcatgtgtttctctctccattccttcctcttctcccacagtggccctctaagtatattctggcagacaagtggccaataaccagtcttcataatggaggtcaggtgatttgtatttctggatttttagaatagacagggcttatcattgatttgaagatggaaagtacactatttcactaccccctgtcatttagtggatgtggttcttgagtatgtccagaattataaggctgttaatgtgtcttgagccctgacctaaactgtagatgagaaggctctttaaatattaaaatggagaacaaacaggattgcttatgcagtaggaaagtgcacagtattcagaagtcaggcctaatctttttatggggcagctattgggcatgctacatttctgtccaaaatataactcttttgaaaactccctctttaacaaaaatactaagttgatggtctctcttaaaaaaaaaaaaaaaaaaaaggccaagtaagggaatatataacttcagagttatcaaatatatttatcccccttacatgtcaaagtttaagtgctgtgttttgtatatacagtcatcatgatatttgaaaaggccataaagaaaaacaattatataattgtttttaaagaacgcagaagcaaggataaaaaggcctttagaaactagagaacagtattaacaattatagtacctgaagtcaagctgcaaaattctgtcctaattattggggatgattaattaagcgtaaagttacacgccttgaaagaatttcagaattatttttctttgatttttctaccaaaaaaaaggcccaccccatcattttctattttagcagtttccacaacttaaacattaaattcttattgtttgatttctgttatattagtagtgtgtgttttgcaattctaatcttcacgtttttctttctttatcactgaagtaggccttttgaagctgggaaatttttcatagcaatattgacagtgttcacatttgcatgatgacagccaaggaatggagcagtaatttttgaaattgcagaagtatttagaacactgataaaagctgaaatatatttttgatggattgaagttaagcatacatgatttttcctgctgtcaaaaggctctgaatttagtgaatatttgcctgctg

SEQ ID NO: 78701 - DNA, 1033 bp, Homo sapiens
ttaccagcccacaatcttgttttaaaatatatggttgctgactggcacatttggcagtaggtttttgtttttgtttttgttttcaaatcatatatctaatttcagtgtggagattatttttcaactccctgtttctctcatatttcatatgttggtgttttaacacaaaatagtgaactttaaagcccatagttgcttagaactgacaaaaagaaaacctttgttatatccttgcctaaagcaggtgttataacaatctgctctttccctctctctctaaatgaattttgtcacagcctttcaagtttccttgtggtgatgagctaatgaaagtagatagtacaatttgtgctgaccaggtagcaagtgccagctcacagctgaggatagtttaaaaaaataaataaaatatagcatcatatcactgatttacccaatacacagcattaatagtgagagaccttggtgtgtttatctgtttgtattggtgtgcatttatcgaattgtttatgacaagactaattggggtaattgtagacactgaaattacctgtcagctatatgtaaccacactccctttctttctgacaaatgatgacaactgagggaccccgtagcattactcatgatggcttttcgagtggtaataaggacaataggggccctggctaatttgacatggacagccttcacaacaagaagccagctaaatgacttgtcaggaggggagagaagtcagaaaagtaatggagtcccccatggcgctctgacagggagatgaggcaatttcaacggaaagtgaaaaggcttcagtttgtcaagtacttagaacaatcagagaacagctagaggctggaacctgacaataaatttgtgaaccatggtagcagtttcatataggtcagttacttcataatggctgtgcagtactcagagggtcctgttctcatcacatacttcacgtctaccaaccagagctttgtcaccttaaatttgtgctctgttttacgtcgtgggaataacagttagggtt

SEQ ID NO: 78702 - DNA, 1017 bp, Homo sapiens
agaataaacattttctcctgtgaaggacataaggagcatctaagaaatggtggtggtggtgctggtggtggtggtggttgaacacttcattaaatcacttttcatatccatacatatttctttaggataatatccagataatagactttccaagtcaaagggatcacagagttttaaggccatggttacatatttgtaaactgcctgtcacagaatgattgtagcaatttcttcttctgcaagtagtgtgtaagtatgcccatttctcagcaccctggcccaagtcagatgccatcacttcatggatagtttttacactctcattgttactttccttccccttgttttcattcagaatgcttgcattttactttgagattttttgccatcggtcattttataagatacgccttcaccggcacatctaaaagctaaggcacttaacaattagaaagttgtatgatagagaccttcagtctccagttataattccagctctttctgaccctcaagctctggaacaggtcacacttttctctgctcaggacactagatatttcagattatttcaagcagtctcctgcccactttcctgtgcctttgttatagctgtcactgtagattgtttccgttgtgcatataattgcttcattgctagtaactggcttaatgttgtcacagaccttattggctcttcttacctcagatttacatatagcatcccaaggctttctttagggcatttatcatttttcctccaaatgatctggtgacagtatacagctattcaagttttcatcagccagcagatgatacggtctttcttctttgctgccacaagccagaaaagagaggaaatcaggggaaatgctttcattactgcacttcaaggaggcgctgtcatggagtcagggagggaagtttcccaaagttcactgaactgacactggaagaagctcttgtgggcagccccatccctttgtgacaccgcaacgaaagcacttcatcatctcttgc

SEQ ID NO: 78703 - DNA, 1073 bp, Homo sapiens
ctgaggaatcaccacgctgacttccacaatggttgaaccagtttacagtcccatcaacagtgtaaaagtattcctatttctccacatcctctccagcacctgttgtttcctgactttttaatgatcgccattctaactggtgtgagatggtatctcgttgtggtttttatttgcatttctctgatggccagggatgatgagcattttttcatgtgtcttttggctgcataaatgtcttcttttgagaagtgtctgttcatatccttcacccactttttgatggggttgtttttttcttgtaaatttgtttgagttgccccgtactttgctggccacactcagtaagagtcaagattacatccagttggcttcataaaacaggactttctaggacagctgtgctttgcttgcacctcatgggagttcaggggctccccagactggaaagcatagaatccagtttctctaggaacccaaggtgtcaaaacaataaatccccacttctctgccatcagcttgcactaccacaagccagaagagagaggactgtaccccgccatgttgtggtgagaaaccacacccataacgtctctttgggttagggagccttccttgctttccacgtggggttcagggagcttgagagttggcatcaaggctcactggagtccccttctacattgtatgtctgtgttctctgtgtagagttcaactcaacctcaggccaagaatcagctgctggctccacctaaaacctgtttattccttaactagatactcctttcagcagctgtggcttctaggaggcaaacactaactagagggaggtggcagcaaaggctatatatacatagtgaatgtccacattcagtgacagcctgtataagtctggtgactgtcagtatccattctctatgcgtaccaaaacaaaccacaagttcaaaaaatcattccagtaaatcaccccttctattcagacttcaaacaaaagaagattgggggtggaggagggaatcagtttgacctcacactcagagtgaagtatctatgctgtgagttgttttacctgttgt

SEQ ID NO: 78704 - DNA, 1809 bp, Homo sapiens
cctagagtctacatcttggttagatcttacccgtgtggaaaccagaagcctgggtcaggcagcagtgcctatgacaggccctgattagattaggactacatttatcaactacacagagagcacacttaacctttcaactcaagagtcttgatgtacctttattttaaaacaaaaaggtgaatgttactctgccaaagtcttgatccaatagcaatgaagtataacatgcagctttttctaatttcatctattaccagatttacacagggacaatatgcaagatgtataccctgacaagcgttttatctgttttctaaatgtataaatatgatatttcgatatttatagaaacctacttcgtaattttacattatgttcatttttttccttaagagcttagaatttttctttggtttctacctggatttacttactgtatatatgtatgtacgtatgtatgtattcattcatttagatttagtagattagaactattctagtaatcgattaatatatcatgaaaatccatctgtggaaggagtaacaagctgcttttagaaacttgatttctttttattctcccaagtatttggcttaaatatttctttgaaacatcacttaattttttcaaatatgtggtttaattttctaggaagtaacgactaaacttttaacaagacaaattgaataatacagttttacagtaggtttttcaagtacgacccattcacattcttctgatgagcctttgatcaagtctttcactgctgggcagtcttacctcacagatttaggatatgtcagggacatctgtgtcctcctaaatctgtattggagagaatattcagggaacatacatggtggtgatagaatcatggtatggggaatggtctgaattcaccaccaatgaacacctgaactctcttcattcatttatcttctagttcctcactgagcacctaccgtgttgatcaggtggagagaacactccctggcctcttgaaactaactttctactttcccagttctgcatcagaatccttgttctatgccagtgccaagtcacatagagctaaaaaatattcttcttggtaatcatgcacaggctgtagccttcaaaataaaattattcttcgtgctaaaaggatggtgttttctgtcattatattgtttctgcagtatgcttgttcagttatgtaaactcattttctgtgacatttataggatcctggcctagaatgcaggtttaaaggaggaaaaggcagcaaagagctttggtagaaataattatttccctgagtaaaagaaagataaaatgagttcatttaaattatagtaaaagtggttgccagtcgcccaacatagtgatctcttttttttccttacctaaatgaaatctaaatcttagagccattttgaacgttttctaaaacatgaggttgttttgccaattcgctttcatttggaaataatttttaaatttcctattatatcataaactttgaatttcaaaaactgctgcatgaagcgctgttttcatctttttgtcccaatatttttgatgccacacttctgatcttaaggttatataattttaaaggttagtctgaatttgatatttactggggaaaaaaatacttatcagtagggattaccattatcttggttgttgatgggcacattttttaatagtgcttactttactggatgtgtatttaataggtccatcagcaatatttactgagcccagagtgtgaatagaatgaaaatgttttcaacgttgtggctaattagtgacgggagaaaaaa

SEQ ID NO: 78705 - DNA, 2871 bp, Homo sapiens
tctcactgcaacctccgcctcccaggctcaagcaatcctcccacctcagcctcccaattagctgagactacaggtgagcaacaccatgcctggctaatttgtgtattgtttgtagagatggggttctgccatgttgcacaggctggtctcgaactcctgggctcaaaccatctgcccgcctcggcctcccaaagtgctgggattataggcatgatcctgtgtacccagcatctcaagtcttcaaaggcaattggaagatatatctgatgacctagttaattctgctggaattggtagcctctgaaatgcttgggtgatcccttctgggtcttcacttgcttgattttaggatgtttctcccccttgtgaagagaatgcaatgttcagcgtgctcaggaatgtaatcctgaatatcagataccaagttaccacgggcctggcttagactgagtataagacctctgtttttagggttgttggctttgtcaccgtcaggtcttttctgcctctcacgcactgctgttaggaagtcctgaagctactgacccccacagatgcctcagattgggaggacacacgtcaggaaaggatgagagtgacatgggatcagcctggaaggcagcccgagaaagtggaggaaagtagagggtctgtgttcctagtgctatttaattaaatctgaaactcctttttatgggtacttatcattttaccctctgctacctacaaactttttcttctgttttgcctttaatctaaagtattttaataaggctcccttccacattcctatcctctgcaattgttttacatctctccttgcaattatcccagaaaatagtctctatatgacttgattttgaaatgtttcttagaattaatcaataacaccttgaggttttccagtttaatttgtatgtatttatcttggcatatagtgcacatctctctagcatgcaattttgtagttgtttggatgttggcaggttttaggggtgggaggggagaaagttgtatttttagctatagtgattcactttgtaaatggtgtacactgtcgtctgtcctccagttgatttactgcatatggaatcaactcactctaagcacaccctacaatttcagtggtttacaaaaccaataaaaatataaaatgctgaaataaatatttaagattccttttctgcattgcactaaagatatgatggaaataaattgtaaaagaaagtatttgcacttgaggaattcaggtaaaagtcatgaagctataattgaaaacaggattgtaggagccgagtaagactggggggagataattaaattttactatttgtcttatttttaatcatatattcatttacacaaagccagtcttgatggactacaaaatacaccatatgttgtcattttaaaataaagttttgtatttaaattaggcatgtgtgctatgtggctgtatgccaccactccctgcattaaaatccttctcaacacggggcttcaaggaaaccactaccaaacaattagagttccctaaacaatgaatctattcgctatataatttttagatgcacctccagccttactcctccttcacagaccctctgctctagctcgcacagttttcttattctcttacaaacatggcagcttccttcagtaaagatcaactcacaacccagcctccacctaagttcatttttttcctttggtgttcaaatctcgctccctacagaaaacttttcctggagactatagcccaaagacagatttcagtggttcccaagtcagactgcatatcagatttaatggagacagctgttcaaaatgtagattcctgagcctgccccagaccaccttactcagattgtgtctaaatctaggaatatgtgttctatcttgctcctcagccaattcctatgcaactgcttggcattctccattcgtgttttgggaaccacatgggtgacggaaagaatcagtaattctggagtctgttggacctgagttcagatcttagcacctgcacttattagctgaccaggttaccagacttctctgggcctcagagactacaaaattgcagtttcttttccaaagattttttgttttgttttttagaggaaggatgctctgaaagttgaagataccacccaactaagttggtacatcaagtagtgtgaatatagtcttctgaagatggtcctatgaaacagactgcttttctgagtggggtgtggtagccagtctcgtttatgatgtggtcatactgagtagcagtggcatttccctccctcccttcttctaaagttcaaatgagttttctctcttcaatctagaactcccatagtcatttacgtttagaatgattccaaatggagagtgagtctcaatttcctgtgcactgaagcacccgttgtatggtgtataaagatattgggaacactagtgcctttttgggacctgagactatttagatattaaagtagatttcagagccatttaaagcagatttttcagttcctcattcaggaaaagagaatggcagtctcagaactggaagggacctcagcccttttactgagtcttcatgcctttatgccaataaatgcttggatcagaaaatctcattggctcaccaagctgagtcaggaaacctacctgtaataagacatgtgtaaaccaaaactatcaaacattttaaattgttttaaattgatgttttaaccaatggctgccatccattgtactataattgaattaactcgtatagatagaatcctattaggcaggtggattcctttatagactaccatatttagacacacacctccaccccaccttctcttgaaagcttttgaaaaggaatct

SEQ ID NO: 78706 - DNA, 4755 bp, Homo sapiens
gtatacacagtttttccttcaacagggactccactcccagaagtagccatggattgtaaacagactaattaagaaataggatcctcgtattttttccatgaagctgataattagcagccttgacttttcaagagtgtctctagttatcttaatgaatattgaaaaattcccccaataaaagtaattctcatttctcataatttataaactaaattattgttaaatggtaaacacaactataacaaagttatgtggcaaaaacaaacgacaaggaggagatgtggctgctcccaaaaggtgggggtttattccattagatgatcaaaaatgtgatgatgccacagccattcacattttacaagaaaatgaggcaaaaccgcattttaatactgccagtttactcctagtaaatcatcactctctaaattaactaataatttagcatttttgttcctgctttaaaatgattctatactaagctgcaaaatggtgatggcattttcagattttgaatttttatgacaagttcaagttgcaagcaactcttttaaaccacaagagaaagagaaagagcttacgagcaagcgcacttgtgtgtgtgtagatatgaactaatgcatacagaaggtgttttcatgagggatttctgaatgtattataatgcaaattacatttttaagctgaccaaactattgatggctttattgaatgaaataatttattatagaaatattttagtcagatgacgtttcatcatcagataacactaaacacaatagccatttcctataagactgttgtcttgagccaagggcttaaaaaagaagataaaacttgctttgttccaaacgtagcattgtactaacaattgtttattacactacagaagaaaagagttctgccagccagacatggtggactggaaaaacatgccattgtgtcagatcatcccaagaaatcttcatttttccctcctctcctaataatgtttgacaagtggagatgaatttttaaaatccaagtctcttttatgccattcattgggataatactataaaatctctcctcgggtactcagagtattacaacatcaatgacctgtcagcagctgcatacagtttttatttttaagactctgtaaagctatggttaaattctaattttctaaaataggtttaagtgtggggagagccaaaattaagtgcacttttcttgctagaaatcagaccacaaattgtacattgtgcttacaaagatgattaaggcggtcccagccgcacaccagcagttcggcagattaattggagcatgcagatttgtgtaaaaacatatgttgggattggagtagcttttttttttttaatgctgtttaaaagttttttgcaagttcctgtgtataattttcacattatctaatcctctcttaaaagcctgagtttaaattcatatatgcccaatatttaagcattttgtcaaaatgggagcatcttattgatacctttcgcccagttagttggtggcaagctttttcatttaggaaatcccagtgttcattattttttaaattgtttcatgatgaaaccagagccacttgtttaaacaaggcataactttaggacccaaaaagagctagagcctcagagctgtgatacacatgaacatacagtaaacacgggaaacgtaagttggaatttgctgaaaatatgattaaaactgcttgcggaagtttaatttacccctctatttgttaggacttgttggcttgacaaacactgtaccacaaagccagctaaacccacactgctcataatggtggcacagacacctgtaagagacatttcagaatattggccagtattttaataatctgcctaaaacctcattaaattaagatcagcaagtaactctaaatgaagagacatataacccattttgatgtaatataaagctcatttatcctgactttccacaggtttccagagttcaatactgacagggttcatacactaagagaaaatgaacgtaaagcaaataaggaatatttagaataagtaagcatgcacatccttaatacaaagttgacttcactttaattagagttcaaagctgtaaggctgaaaatatgcatttttaaggtaaatttttattcctttaaattgtctcaatcctatgattttataacactgttattaaaaataacacttaccggcttacaggagagatttgagataaaaacacaaagtgcctgtcagagtacctggcactttagcaggggctcagtaaagagtagggaggaagtggaggaggatcactggtagccgtgtaagtggtgctaagtttggacaactaggcagttaagccagttattcctagggagaaaaaggaaattagagtctaacaagcaataattgctcaaagcaattgtaaaggactacacatgtaactcccttgccatccacagataatgcaatttagacaatataaaagtttaaaaggtgtaataatcactggtcttttgcccttgtttacttaagaatctgtctgctgaaaattttcctgttgcccttattatatttgctttgcagcagtgacgaataatctatcttattctgtggataaaatctccacacttcacggagatttttttattgttggaatttagttggatctcatattaaataatgcataaacattgcgttatccaatcttatctctttttctttggtcctgcttgctaactaaattctccccctttaaaaaacattctttatatgcttgatatctctcctcctctttgctactttttccttcagtaccataaacataattgttgcaccatggtgctcttgctagaaataggctggaattcctgtaagctccacttgatcaagacagctcccctgttgattttgtggtatggcaggtgtgatttttccctgcccaagtgacaccaccaaatactgttaacttaagtggacctgttttggccatgaggagatgggttatctttctgaattagctaagaggttgatttcagatgtcagggtgctgcccttgtaaaggtttagtgtacacgtacagagtcaccaaaaagggcctctgtggttcttacttttgcacatttctgagaatggggtgaatgattcacatttacatggaggatattcccagctattaagccagccaggggaaatatctataagtcaatcacaaaatagctaaggtgttctcatagactttggttcccatcataataaaattacaaatttagtaaattgcaaaaagaggcactaaagtgatgataccatatttcaatagtctgtctgatgctcttctaggctctgtgttaaccaaagagtccggtaggcctcacactttggcccagtgagccctggttgttcagttgaaaagcggttggataatcactaacattctgggatcatgacttactaacccgggagtcgagtagtcatgaattgaagcataggacatctgtgaggcagaagcaagggcctctacaaagacaagttacactgatacacacattcacatacacaccttagatcaaagaagagccactgatcagtgcctgagcggctgattggacttgggacttttctacacattgcaacttgaaaacttgctctccagtgacccagggaaaaactattctcgttaccttgtgcagataactaattggaagttgagcacctctcaggagttccaatactttttacagaaagaattggtgttaagctataattcttgaactgaagatttattgtaactgagaaactgcttgccgaagtttaatttacccctctatttgctaggacttgttggcttgacacacactgtaccataaaggcaactaaacacacactgctcttaatggtggcacagacccctgtaagagacatttcagaatattggccactattttgataattctgcctaaaacctcattaaattgagatcagcaagtaactctaaatgaagagacatataacccattttgttgtaatataaagctcatttatcctgactttccagtggtttccagagttcaatactgacagtgttcatacactaagagaaaatgaaagtaaagcaaataaggaatatttagaataagtaagcatgcatgtccttaatacaaagttgacttcactttaattagagttcaaagctgtaaggctgaaaatatgtatttttaaggtaactttttattcctttagataaaattgtctcaatcctatgattttataacattgttgacacagtgaatggtacagattgggttatgttccttatcaccttctaactctattaagaatgctacttgcccttttacctaaaaaattataatatttctgaaactgtgctaaatgtatagattttttaatcgtagttgtttgttcactgtgtgtatcgtgtacttcccctgagtggacacatctcattgtgacaatctctcatttttattctctcagtattgtggtctttttaatcctgtgtccttctgattgagtctgtggacacaaatttcataaggtcaactgttttatgacacacaagatcatattagaccccagtatactggccaccaatatactgaaggctgcccatcccacatctaacctgctttcattctctttctgctgtgtctgcttttatctctgttcttttcttcatgatcaatcttgaaagagtcatctgcattcagggtccctacttcctcatgtctctgagtct

SEQ ID NO: 78707 - DNA, 1413 bp, Homo sapiens
acaaatgctattctattcactttatagatagagaaatcttggggctatgccaggaaaataaatctggagtagtcagtcatggattagctgcaggggcattacatttactagaatgccttactctcgttgtgcttaggagggaaccaaatagaaaaaaattacaaagcccagaactgcagaatgattcacaaaacctcaagaatgacaggtaagatattttccaccacacagaccctcagcacaaccagaatcgagtgcaggatggcctcccagacctgtctagcactggcatccagtcccctaccaggcatctgtctgctcatgcagtcaagcctcttctgttcacctcagatgttcatacatcggggcttgaaatccccatgagatgttgccctgtcgggaaccatcctctggagctggaccagtgtgcctttttaactccctaaacagagcatccctcttcgtttggaaatgtctgtggctcagaacttcatcttgcagatccagcattaattaagctatgcctttaaaatataatcaggtaccatctttacagacttaaaatttctaactataaagttgacctttgaagttcacatatttgcatttcccttttgctgagcttaattttctattttgctatcatgactctttgaagaaaaggcagagtataaatacattaaaagccgcacaaccgacatacagaaactgtaagattctcattttcttaaaggagcactattgaaaatggtgcaaagatcattttgtagagtttgtatgttatggaaaagtagagctgtgaagaacacagatgcctgctgaacctaggaatgacataggcattgtagagatggcagttgtggttcaatgagtgcaaatccatgtgtcatatacaaatacagttcactttaatagtttgctatctcttcactcatcttaaacaccttaaggtatttggaaagggaggaagaaataaaacagatgaacctgctgagatatggccaggaacagtagtacttcattttgattgatgtttttacaaccttatcttctagataaaagcgactgtaaacaaaagcctacctaaactgattgtatttaaaggaagcaagagccacctgtgtgcagcaattggctcccaagtgcagtctttcctcctagcagccaattcttgctgctcacagccttgcagccaccactttaaccatcagtagtgttacttacagggactagtactcttggtttctaccactctttaaaccacagcatcatctcccccttaatatcctagacagaatagattcctaccagcaatcccagcaatcttgcaattcgctcttcagaagtgtacaacttggacatatttttaaggctcattttcttacctttaaaaatgactttccgtggccaggc

SEQ ID NO: 78708 - DNA, 1101 bp, Homo sapiens
actgaaatacaagctgccctcatgaagcttacattttaaaagaagtgtttgtttgataactgcaaggccaggttatccataatttttgaagacccatttttaaaatcatttttccttatctgatcattttttctaatgatctagacatttctaacttctaatttatttttttcccctttctggcatttgccttcatgaatctgcaaaattgggatgttttgcttttggggactaggttggctagccaaagagattttccttatcattaaatatttcttgtgactaagagaaaaatttaactgcccatttagagtgagttgggatctgacataccaaagcattgtgtcacatttggttaatgatagatttatagggcaaacatgtatcagccctaatccttcagttatttgactttgccgaggatgaaattccaataattttttattttaagcagacttttatatatccaaaacccataaatctctttgttccttgagataaacatctgaccgaactctgggttaccctgtgatcctttgagaactatgccaaggaaaaagaaactccattccctccattagcgaataattaagggctacttgaaaaagacatattttgggtacgcaagatttatgtagtcttttccattttataatgtggttctaatttctaatattcagaaagttagttagaaatggaaagttcagaaatcacctcaaaattcatcagagcaagtctgatggttgattaactggcaaacaccaaaatggactgcaccactgtcagccaggccttgccaactccatgatcactatccattatggttgtcatatcaattataaattctctggcatcaaacactaaatcagctgaaatgatgggtttgcctttggcgtgtttccctggggaaataactgagaaaacatgtaataattcacacgaccaattttgttaaaacaaacacccccaacttttggaagaaggctggggtataaattccagatcgatggacatgatttgcacccagtgtccacatgaagtgttctctcgttttagtacttaagtaagtaagtgttttcaaagtaaacataacttcgggta

SEQ ID NO: 78709 - DNA, 1046 bp, Homo sapiens
gtaattcagctcattgggaagaaaagtattaggtcaatttcagcagtttccgtgattacaggtagagagacaaattatgtaatagtacataaatcccacacctttcaccgtcttattaccaaaagagatgtaaaagcatactagtttaaaaaatatatgtagtggttttctcatagagctgaaaacatgggtaagccaagttaatggcacaaacataagatgcatctgtatactagaggtattttaggagcaaaactggggcctttggggcatactgtatcaccctgtttaacaagttctgaaccttcttttctgggaaaacaaatctctacctcatacgttcacttagacccgttgcttccctcagttttcctcataacttattccagctgtttatttccatttatatgaacaagctgtggcagtgttctggatttactcctcttccctcatgtttagattctgccccataacttctgaaccccttcacagcgtgagacatttctcttctctgaactttatgtagtgattctgtaattctcattccctagcttacttccacctgtttgtcaaaggtttaaaatatgctccctcaaaagtaattattttcatttcttttgccagaattatgggttgcttttccatctacttcctaaatgtggtgatacttaaattgaaataagtagccagataaactttttagcgtgaaactattgacatcaaacttagagttattccctgtgtagataggtggatcccaactcatatactggggttttgatcagttgccttgcttctggacccctgcttgcctatcacctatccaggtgtagtaaatatttttcagagtcaaatgactgttatagaatgctatataaacacaaggtataatgagacagtaaagcatagtagttacaagggtaagccatagagccaggcggcttgggttcgaaacctggccctttttgggccccagtttcttcatctgtaaaatgaggatagtcatagtgccctcctcatagggtggcagtgagtaccaaattagt

SEQ ID NO: 78710 - DNA, 1728 bp, Homo sapiens
cctggggacccacacacctgtgcacaggtagcctaattctactgaccccaaaggaatctcttctttggggatgctgaggaagaagagaacatctgcagctgataaatctcagtgggcctggtgctccaaggcttctaattatacccagttcctacatcttctagaacaagatcaagtgatgagctgccatctcatggttctgtacctgcacagaggggaatcccaaagttttaaataatcttgaatacaacttggctaccccactaatgtggatccccaaataaaccaggccgtgacatccaattgaacttgtccctgtgcatacagtatctcgcagcccatcctgtattgttagttttggcaagtacactacagcatataataaatcatggaaggcaaaagctttttggcctagcatggttcagcctgctgtaatgttagaatacagaaagcagttctgtttttagacatgcttttactaacccaacattcataatttattatttcactgtaaaattcctgcaacactacaccaaaagtagtgctgccctttaattaagtgccctcggtaggaaaaacgtgaaactgatgtgcaaaacatctctctgtgtgcagtgattgatagtgattacatctttatgaacccagcctaaaggtctcaacttcctgatgggtgaagtagtccatagggccacttcctgagtctgcctggcggggatcagtcactgctaacaaaattgcagataattcagagggcacaacttagaaatgctgaggttttattaagcccgtagcgatctatactttgtcacaagcctatatgaccttattcctcatttccgtaagcaccaatgaccaaactttatgctgtgtccacacttaaagaagttgtaatgcagagagtaaagggacccagtgtgtcatatggatgacaggaggtacttccagcccaatgggtgcataagtagaacagtatagccagaagaggaccataagttgttgcatttttttaaattctgttttcaaacattcttttatttttcttagttgctattaggcaagtttaattttttaaatagtaccattaaatgttagacttaaatcccaaggctggcattccccagctcattcctgtttgcactgtgaatctgtcctccatcagctaggtagtcacatcagcccaagctcataacaccttactgaaaggtaagattcagagtttccatatctgaaatacttcaggtttctggaaagaaagggaacacatccatccgagaaggtagtatgtgtgttatgtgaactctttggtataagtttggctattttcagtcacaatggtagcaaccaaaacaaaaattttgtgcagtcctgtcatttaatcatcttatcagtgccccaaggtgacttttttcaagagctctgttgataccatgtgtgtgtgttattttctggtgtttttacagatttgggccaggcttagtcatctattggtatggatttatccaggagctggactgcaaccgggaaaggggcatcctgctcaaagcctgtttccccacgaacattgtcaccttatgccacagcatagcttgaccctgaagatcctggaagagaagctgggaggaaaaggtgaatccggaagcaattttactttcctgcactgtaagatcctggcaacatctgccctgaacttcagctgaactcttgctgcccgtagtcacaccacta

SEQ ID NO: 78711 - DNA, 1053 bp, Homo sapiens
gctagtatttttatgagtcgagttttttaaaggcacattctgtatactgcttagtatatgcattttataccatgtaattataaaacactcgagtaagttcagcattagaaatgtttagctttgtatgaactgagtgtgccagaaataaacctggagcaatttttaaataagcaaaataaaggagatttttctatttgttcactttaatttattcacttttgtgtacttttatgtactgcaaatcagatttcagtctaaagcgaaacatcagtaagttaataataaacctatcttttgggaagttgaatattaatctgtacccaaaacgtatttagtaaaatatttgcccccgccaccctgccatgctgacataacaacttttataatgttgaatagatgatatgggaaatactaataacaacaatgtaatttttgcagacagctttaacttatatacattgcttgatttttttcaaaagactaaatatgtcatttatactttgtttattttctaccaaagaaggtttgtaaaaatatgcctgctgcttttccttttgaaggacacaaacctggtcccaacatgtgtggattttaactctgagtggggtgcattaaatcaaaagagagaggcagaagatgaaatgctaaagaagggtcaggcaaacttctgtttcagtataaaattcatcatgcaggcttctgagtgaaatagaatgatttgaaaccactactgtattgcctggatacacacacacacacacacacacactttatacaaaaatgttaaaagcaggtttcctggcatgttctaaactgttttttctttaggaataaattacatttatctgcacagatgttgaaaatcctgttaaacccttgtcaaggatttgtttattttacattaaacaaatttattatgatgaacgtgaacaaataaattaaaaaataaaaaaggtacttgcgttttgtatttattcttttacctgctgccctgacataatgtgttgtgagaaggtattggtgttcctagcaaaggcactacctcctctttat

SEQ ID NO: 78712 - DNA, 1055 bp, Homo sapiens
ctcaggggtctaaagtagaacgctggacctccaggggaaataattttcttgtaactgtaggtgtgtgtacctgttcattatctgcaaggcttgattccccctggaaaagatgataaattgttggtcttgagggggtgcattaactcactcaggccgccaggggactgcttagagccctgatgaggtaatctacctaaatggtccctggtgggccacactaattaatgctgaagtgaacagttaattcacttgcttctcactggggagctacacccattgctttcttttctctttggaaccaagatgccttagatgtctcctctttttaactgttcccatctagagacctggtatctcaattgcaataaatccttactgcttccatatgctttctcacttcacttttcactttttccatgtcatcttcccctgcgttggcctttgccagtttccctccacatggacatgtaccctgcattttctcattactcttgggctctttttctctctaaaagatcaggatcccaggaccaaaatatgtcctgatgcatacacctggttggggagtggggagcaattggcctaacctctttggggagaaacacaacttaagcaccctccacatgcccaaatactcaagtgcatatgtggcaccagaaggatcgtaaaacttttaactaagataataagattttacagggttaaatatggcttgaagttcatgccttcagtaaatgatttggcaaaaggagcaaaaagagaaaaaaaaagtaaggttatatagctactttcagcctgagtggtggtgttcagctgattaaaatagcaaaatgtctgtatgatttagcgaatcactcctagctcattcatcttgggggtagcttgccattttcatgtgatctgatgggagcaagttgtctcaaagtataactattttgtgacaagatgagaggagaaaatctcaataggcacattcttgattagggttaaggaacaaagcaagcttaacttgagaggaaactaaaaggcaaacaatagaagtttgcctgcaatgt

SEQ ID NO: 78713 - DNA, 1031 bp, Homo sapiens
gttggtcaggctggtgatccgcccgcctcggtctcccaaagtgctgggattacaggtgtgagcctccgtgcccagccaagttattttttgatagtgttgctactttatctgcattgtgaaagtggaaatagaaaatagaaatgccatcatttctatttctaaaaattaagttaaaccaccttaggaaattctgataggagatgtgaaatctgaatatgctgtaaaaattctttcaaattgccgtacagtgtgtttgcttttttgtctgttgtagatgacggctttgtgggtaatgtcagaatcaaaggttgatgtctctatttctcacaaatcggggggaaaatccactaactaaccctctaaagctaaaatatttaaggactaaagcagatgtggcataactgctggtttgctaggtctcttgtggtttataaagatatattttatgtcttttatgattacgggatgatgccgaaaattttgggggtaataataccgtcacattggaaagactgcgtataacatctctggagaagatacagaatgccacccggctgtcaaatcaaagtaaaagatgtttaatttgtcattaagaaaaggcagtcaggaaattttatttggaatttggtctttgatatgtgaacatcataaatgtgaggatattaagtcatgtattcatgaatagattttttttttgctttctgacataatataatatgttttcataataatttttaaagctattgttagatgcgtagctgttagaactataatttatttaaagtgagttttaaaattgtttagatctttgatttttttttccccattggcacctttactagatgccagtataaactggttaaatagcatttggtttaaacagaaagaatatacgtatgcatatttatgatattttgtttgttggatctttttcttaatattacttgactttctgtgttttaatctcattttttcatattttgggttgaagccactctaaagtttaacacctaggagatttctcacttatg

SEQ ID NO: 78714 - DNA, 1088 bp, Homo sapiens
aataaaggtatttaaattaaatattttaatcatgtatatgattcagtcagtaacacatgagtagccaagatacctttaaacagtacttcaggctacagtcggacctttatgtctgcgggttccacatctggggactcaaccaattgcatattgaaaatactcatgaaaaaaaagacaacaaaaataacactgcgacagtaaaaaaaaaatgcaaataaaaagtgtagtataactatttacatagcatttacattctattaggaattataagtaatctagagatcatttaaagtatacaggaggatgtgcataggttatatgcaaatactacaccattttatattagggacttgaacatcctcagattttggtgtctgagggagtcctggaagcaatcccccacagataccttgtttcagatgaaaaagcatcatactctatgggtaactggttaactcaccttattctgatatatgaatgccattcacattatgctggatatgggtcaaacttaagttcttctgcgaaagccacaacataccaggcatcagaaatgctagagagttttgaccatcattcagaaaaacaattgtttaacagcaaccaacaattcaaactatttaacaggcaccagctgtcagaatgaatgctcaactaatcaaagcagttgctggccatagtggttcataccagttgaatttagctgcattaaaaatttgtccttttaaggttctgtttttgtggagacagccattttcagggcttcctaaatccttgtaagaaatatttttttgcaaatacagaattatttatttctaagaatataaagatatactactaatttctaatatacaaatcaggaggaataagaaatagctattgctttctatcaaatcttactgcttaaatggattaaaaaaatatggctggtgtataccttcacatgtttatattttaaatatgtccaccattatttctctttcttttgtccagttgatgaatagaagcaaatatagtagagagatgattagactattttctgctgaggtcaacttgtttacccaagctaagaaaagccttttctgaat

SEQ ID NO: 78715 - DNA, 1021 bp, Homo sapiens
acctccctgcccagggcggcacccagcatgcaccatggccaccgattagagttgtgggtggctggtgatttctgggcacttgttgtacctctgctgtgctacgaactaacagtaagagcttgtagtcacctcaagaatgctttcatctagttgaatgtatgcaaggctttgtgcagaattctctgtccgactcaaatttttaatgactgcctgtcctccaggttgggagagaggactcaaatagcctaagctgggggagttgggaagtctgcattcatgctctgtgatcctctgtactggctgaacctcagttaagtccattaagttccctggactttctgtttccccatttttcaaatgagagggacacgttgcaggatggataagctcctttcccatgctcctaggttttggttctgctcaaggacatttagtcagagcaatgcccggtcccagcctcatgggtcattctttcctctctttccccctttctctttgcttttgcttttcactaactgctttatttctctcctgaccttcttcacaacatgcccctttcattactttctcccactagctttgtctcccatctttctctctgtgccgctcctctgccttttctgcacctcccttgtagctttaggaaattctcctctgcttgctctttgaaaatgttttccttcttcatccacacttcaccccactgcagagaagaggttcagtaactttgatgaggatggtcctgtaaaacttttactttccaatctttaatgagctgaaagatttactcagctgtaattctgagctcagaaaccaagaatagagacccctaactagcgacatgttaatttagatttcttttcttacatgcactaacaggcatgaggaagtccttggaactagagatgccccactatatttttctgtcatttaattaatttcgactttcaaagtgaaatgttggctctagctcactgaaagtagatgcagtctaaattattatttcatgtaaatttcttta

SEQ ID NO: 78716 - DNA, 1018 bp, Homo sapiens
tgaggaggcaggtggaattgtaggaagttttcattgactctcccgagcaactaaggacgccacgagagattcttctcagtttgaactttatcagggtctacgcttaatcaatagagtattggaaaaagaattaattactaaagcagaataaaacagctgcattttaaactaaggatccatcaattcggtaatcttccagttacaggctaggtgccgtgaggatttgactccatgtaatgaggaacccggggagtttcctcatgaacaggctgggaattcacattagcctgtttcagctatttgtcattagtacaactcatttctcctcttctgcattacaatttgtattttatgtactgtggaacccacgaaattcccacattcatgggagggagggcgttaaggcggaaatcattgtcaccctgagaaagagtcttaacctagctcggcctctttattctggaagctgccgcgggagcggttcggagctggaccctgctccattgtgcccagggtgggggtcagggcccccgcctgttgaagacacactggtttgaacccagcctggaaatgtttcatctataatttccataatggtggatttcaaggagggctgaggagggttatgggagatgaattaggtttttagtgagctcattaggaagccaaacagagttgagacacaaggcagtgagcggggctgtaatcagttctgctcgctttgttccctgcctccgggacatgtttcgaaaactttctggcgggggctgccgagccggtgctcaggcgaagctgccgtcctggtggctgacttgttgatttgtaaacctcttaattcattttttttgttcaatttaatcttttctttctgaaggaaaattagttgaatgttagccctctttgcactattcacctcttaaattatgctcattttgaagagcttgttatgcctgaataaacatgaaatgacttggcattttcccatcagaggcacacccattttaacaccatgtattta

SEQ ID NO: 78717 - DNA, 1078 bp, Homo sapiens
cgccgctggggccgcgctgccgcagccgctgcgccgccgcctagactactagcctgggctgcttgttttgtctctgaaattgacaaggacgcagggaatccgctgctaaataatgtttctggtaactttcacgttattcgcccccccaccctccgctccctgcccccggggaggcactggccctagtctttcctagtcctcggcgttctcgtgctgattattagcgtttttcttctctttattttgtttcatttcgccttttgatttattggatcctcagaggaggcgaaggggggttaggggtgggatccggggcttcctcctcacactaactccacttctccctccgttggctcgctacggttctgttgcctccggcgggagcggggcctcccggcgccccctcaaatccccggcctcgccgcctcctcttccttctctaaacgttgctcttggttcatgctttttcatttttaaatttaataacattttttcctcacaacttttaactccgttgttttggctggtttggtttctgtgtgctcaacttgtgctcggtacttttctcctttctgactttgtttttatttttattttctctctctctctctctctctctctctctctctctctctctctctccccctctcctccttttcctcctcctcctctcttctctcttacctccctccctctctctcatctttatcccttcctctcttttctgttcgccctcttctccctgctctttttccctttccacccccctcctctgttctccctcacctcctgcgccccctcccccttcccgggttctgacagtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggtaaactgaccccccggacccag

SEQ ID NO: 78718 - DNA, 2956 bp, Homo sapiens
cggctctcccccagacccatccgaaacttgggtgccggaaagcttgcgaccctggagagttcggtgcatcttctggagatagctgatttctttagccatttttagtggcagcacccctccccatcctcccacatttagctgctttcttttggggtaggggattaagtgttgggagaggatggcaattgtacgtctatgagagggaataatgtggatggatggaagtggagtagaaactacccctttgcctgtgagacccctgtcccgtcctttttcactcacataccagtcaccataccttcagtatccatcctacttcctttatagctgtttcacttggaaactaatgtgtgggagcacctcctgcagcaaactgctcttgaatcttaattcgatgagtcagtgactcttaaataccgattaagccttcaccctctcccccctcccccttttaaacttatgacctgtaagattcttgtaaaaaatagggttagggaaacatttttagaatttaataggattaaggacacctggagtgtgggcgatgttgagctagagtttacctttgtgaatattggacgtgtcttcaggaacggagaagaattttgaatgctaatttttacctttcagctatgtgaaaacacatgatttacgttgatgtaaccgaatttacattgctgaatatgttggtgatttcattaacttttagagcattccggtttaagttttagcttatttgggctttctccttgctttccaaacgaaatacttcgtcttttaaatgttttgctttaacgtgacagctgcgtggagaaataatggttggcaacacttttctattgagaagggatttaattccaagcagaatattagcatccgttttcttgtaattaagttcaacttttgtttatcttcggagggttggaaagagttaagtgagttaggacttagtcatttggatgcattcctttaaatacagtgcattactaaagtcagacctttttgaaataactttttaaagtctgtaccgagtcctgtttaacgtaaaatagctagagaaaggccaaacaacatttcctcctcccttactccctccccaccccaaaacacacgcttctgctgagcgggtgtagaaggaggtacattgctgcagtgtcagtgcagtgtagaagcagaagtggcagccatgttctgtctctttttgtgaatcgccctcatttgcatagcacactcttcattcataaaaaaaataattaaacatccatcaccttggacatcttgaaaggatttcccaagaaaaaaaattcgcggcttatttgtctgtgtgtagatttttgagttcagaaggtaagaagaatgtgaaattttaggttaaatttaaaaacatacgcacacacaaacaactacccctgttctgagaatgttgacacagttatgtgggaaatatcagttcggggaggtgctgggatcacgtgatcgcctccattcataaaatacctggctgtccattcagagtgcagtacagtctctccctgccttctgcagattagacctactttgagggagatcaagaagtctatctcagataatggttatttaggagaagaactgctaaaaatgctgaaccgaatgacggtaacttttattggtatctttcaaaaagtttggattaaaaatgttaagttttcttttagagatgggaaaagacttcttaccagtttaatttttttcttaaagcagtgaatatctccttgtttccttctggttgcagctaataaaaaaagcagatgatggaatgtgaattaacacaagtaaaatatattttttctaaatggccatttttttaaatacttgccataaataaattgagacaacaggtttttttgtatagtgatagtgcgttccactgctattacagtaaattgagaaaatactcccagtgatttaatccccaagatgttgatatttgaaacaccgatggcaatcttcagtgagaggattgctttaaatatttttttttcatctaaatgtacttagtatgggacaacttggaaattatctcactcacccagacttttaaaatcgttttttcacaaatttatcctgctttattaataaattattccctaggagctttgtaatactttttaagtttgggcagggcgataataatatttagcataatattttggtaaactcttcatgggaacaaaatcttgggggttttactttaaaaaactctattatattagaaaataatgtgttcatctgataatcagttttactagagccagcattgtttgcttgtgcattagataaaccacagagtgaacttatttggaatgtagcttttaatatagtaatttatgtctcatctttaataggtgaaccgttttgaaatggaaatttattatttatagtcattatgaagaaagatacgtatcatggcagaagccattaaggccttagcacagtttaaaactgccctgtaacatggattttatttgggccttacatttttttcccttttctcttttttaaagccattgctcatagggatttaattacagtagggactatttttaacattctttagtttctttttcacctgatttcaaccttcaagaaaagtgaaaatcaccagtttcctgggaaaccattaaccctttctagatagccattgtggtaaaatccagtagggcctcattctgaaatcctcgagtacatgcttattatttgaaattaaagttttatgtagagaaatggataactcctaggctgactgtgagaatatatttaatcaagaattagtgggggatctgttatgtgtagggctttgctttaatgccaaaccaagtaaggaagaaataaattagaataaagcatttcttagattgtttcacatttatgtttaaaaatcttacttttcaaaaatagtaaacatactctagagcaa

SEQ ID NO: 78719 - DNA, 1049 bp, Homo sapiens
tagggccaggcacggtggctcatgcctgtaatcctagcactttaggaggccgaggtgggcaggttgcctgtgctcaggagttggagaccagcctgggcaacatggcaaaaccctttctctactaaaaatacaaaaaaattatccaggcatggtggtgcatgcctgtagtcccagctactcgggagtctgaggcatgagaaatgcctgaacccgggaagctgaggttgcagtaagccaagatcgtgcactgtgctccagcctgggcaacagagtgagactctgtctcaaaaaacaaacaaacaaacaaacaaacaaacaaacaggatattcttcaactttgtattatcatttttaaagagaaggagagtggcgagagatggatgagacagactggcttctagccaccttagttttccttagcaatgtttcctagtcttgatacttgaagagcaagcaaactgagcttctaagtgagccaaaaagaaaaaaaaaaaattattggatgttgtatatagactctactgcttttgagtccgaactgtgttttgtgtactaggccctagcatataacacataagaagcataatttgacttacaattactggctaatagcagatcatccaatttttgcatttaccctatctcagatttagtcaggtggtataaggaaaaaaatgaaagtaagctaaaatcctttaggaaaacaatgagcaataattacatcaaaagaaatcaactaaaaacccagcacagctttcaactgcatctagttccatacacatttttgcttgtgtacatacacatattatttacctgattaagtatatcacctgatatacttaatataaagacttaggcgtatatctagtttttaaataatcattttagtactgtaatatttcacattgttttaccaaaagtttacctacttgttatctctttaaagaacactttaggtttccagctctttgctattacaaataacatttttaaggagcatctttttgcatataaatattttcttctctttagtaaaatttcttaagata

SEQ ID NO: 78720 - DNA, 1012 bp, Homo sapiens
caaacagacttaaattgactcacccaaggcgtaataaatattataaggtggatttaaatctaatttttatgctacctacaatgtgaaatactcttcctattgtggatgtattttgttcaggctttcaagtatcattttaattctcatgttcaggatttggtgagtaagtctattctgtttaaacattttttgacttacacattttgagcctgtccttttaaagtttttgcctgatttatgaaacactgtagtttatcctaaagaagtcttatggcagtatcattttactaacttatggaacattcttctggtctataaagttgtgttaggttagtgatcagtatccacaagtaaaaagaggtggatatatttttgtgctagtttataatagcaggctaatgcttggtgtgcatttcttttctgggtcatcatgatagtttggggtctatctttataaaaaatgatagtaatattcataaagcttatctttgcttctacattaagagaagtaaatttattaaaatttcttgtgtcagtataaggactttttaaaacttttaggttcaaggttacacgtgcaggtttgttatataggtaaattttatgacacggggtttgatgtacagattatttcgtcactgaggtaataagcataatactcaataggtggtttttttgatctgttccctcctcccaccctcaagtaggccctggtgtctgttcccttctttgtgtccatgtgtactcaatgtttagctcccacttataagtgagaacatgagatatttggttttctattcattcattagttaacttaggatacccatggcttccaggtccatccatgttgctgcagaggacatgatctcattcctttttatggctgtgtagtattccatggtgtacatgtaccatgttttctttatccagtctgccattgatgggcatttaggctgattccatgtcttttctattgtgaataatgctgtgatgaacatacatgtgcatgtgt

SEQ ID NO: 78721 - DNA, 1126 bp, Homo sapiens
aattcattgcaaggagacattaaaagttcctaatgtagaataagaactaggtaatacatgacaaacacttatgggggactatctaggataattttaggagtcttcagtgtttcatggaatcaaagaagtttggattaggagagggctttgattagcatcttttcttccttaattttatagatgagggtgctacatcttggaatgataaaataacttgctggaactattacagttgcatgtgtcagtctcagtggaaacttggtcttcatgactgtaagttcagtgttgtttccactgaatgttgccttggtcaattttttcctataattttgcccctggtaaccccagtgtctttaaagggaaatgatttgtttgggaagtcatctttttctttatttttagggatcattgatatcagtaatcaacactgattcttaaagtgtaggtaatataagttggaagagaaatacctcatttgcctccttaaaggaacacaatagtataataatgttttttgtcagaatctcttcatgaatccctccagcaagttaatgaaaatctccaaaaacactattcagattctcatgatagccagaagggtattggcagtagattgattatttagcttatagatgagttgcttgtttactcttacacatttgaaaaatacagaaaggtacagaaaagataaccttatctatatccttatccagaattgacatggatatcatctttgcgttagatttttaaaaatccattgttttttgtggagataattataattgagttagaccattaaatctatcttatctaaagataagagattttaaaaatgtgatttttagcttggggctacttaggacatttggttaggcagtgtactaatagagatagtaagcgtatatgtggatcagcaaactgttttctttgataatcaaaagcccttgtttgccaaaccacaatttagaatgaatgagtagaaatttaacatctcttataacttaaaaataactacttgtgaactctatagatcttcattcagaatatgtaattgtaaagtagataataccttaaaagagaaaacagtgaatcactttgctagtgggtgagcctagctcatcaccta

SEQ ID NO: 78722 - DNA, 1257 bp, Homo sapiens
ttaatgtgctgaaatacagcagtttgtcctggttataatattgtagcaaatggacatatatagacaagttttatggtaccctgtgtagtttgacagtatttgcctctgggatccttcacaacttgttccgtggcaatcagatgtgctggaactactgaaatgatgaattgaggtagtagttttgtagtcttttattacaagagtagtctttaaaataaaggacaaccttaaagtctgtttttggtttttgacctctttcaagtaggctactttctgtagattttcatggaagtagtaaacaccttagtcaccacatgttaactaatgtgttctttggtttctcaaacaagactgatggcttggctgttttttgtttatggaaaagctaattcctgatctttgcatctattttagtaatagttatgcacgagtgcgagctgtggtgatgacccgagatgactcaagtggtggatggttaccacttggagggagtggactaagcagcgtcactgtcttcaaagtccctcatcaggaagagaatggctgtgctgacttttttatccgtggagagcgactcagggacaaaatggtaatgaataatgtatctaatactataattttagataatgaattatctgtttaaagttatgattagtatactgttgtgagtttttttcacctgtgaatcagtaattatgtttctggagctgtttctgtgttaaaggcagtgaaatacaacatttttttttcaaactgagactgacattgatacacatttgttgggggatggggttgctgcttttccatttacgcttaatgcaggagttaataaatagtccccctagttattcaaccggtaacatcctgccttcccttctctcagctattccctagaccagagattggcaaactaatccacaggccaaatgcaagcccaccaattgtttttatattgtctgtgagctaataatggtttttatagttttacatggttggaaaaaattaaaaataataattttgtgtaacataagaattatatgaaattcccatttcagtatccacaaattaagttttattcgaacatagccaaggtgattcccttattaattcccttattttctagtctcataagactatctggtggccagcctaatttttaacactattgtcttccatgcagatgtgtggtttcttacctgtatacattttaaaatttcagtttaacctttgataatgttatttgctcttttttaatta

SEQ ID NO: 78723 - DNA, 1252 bp, Homo sapiens
atgataataataaccagtccagaatcccattcttttcattattaacccattgaaaaggtaataaattatgctattaattactttctgtacaaccatgaattttgtagtttttccccagcagttgttttgcaacagttaattatttaatattgctagcataccttgaagagggggaagaagtctgcctattagcatttctgttctctttccccggagccttgtgggaactggttcctgaaaattaagatttagaaaatgtcccaaattattataccttcctggttgcctttattttctcatttagcttaacactttcacctttcttcagcaaactctttattattacatttcctctttcttctttcaaaccctgcatttggcatctgacatatttcctctttacaatttattttaaactaacatcattcctttctgtagttactgcttttcactggttgatttggtctgtcagcctcatcaatattgtcttggcttcattgttctcttttatacctgattgtggtatatttcgtaatttatttcacatcctttccattatcttccaattgccattaaactgtaatagcctctatcatagctaaattaaagcccaaactctgacctcaaattatcgaccatacttattagctttccaaatgtttctgcactacttttgttttattacattctaaattataatttgaatgtgtcatgcttttaattgagtggttgactgtagtattcctttggttaatcaaccactgagtgccttctatgtgcttgacttcctgtattagtttccttgggctgccgtaacaaaataacgtagactgaatggtttaaacaacagaatttattttctcacagttatggaaggtgggaagtccaaggtattggccaattttctgtttctggtgtgggctgtcttcctggctttcagactgtcactttctcaagatgtcctcacatggtctagagaaagagctctggtgtttcttcctcttataaaagcactagccctatcagattagggccccacctttatgacctcatttaacctttatcatttcctccctggctctatttccaaatgtagtcaccatggatattagggctttaacatatgaatttgaggggagcacaatcccttcagtccatagtacttcctattccattgtactgtttgtctgttgattgttagttgagtagtattctatgatatgcatgtacactctctaaattatggtaactt

SEQ ID NO: 78724 - DNA, 1053 bp, Homo sapiens
aaggaatttctaatgttgcacagataagtatgatgtcagctgttgtcttgagatgtcctttaccatgataaggaagtgttcttatgttctccacctccccagactagaatttgatactaatttttatgaaatctgattttgcaaatgtctcacagactttttaaattgaaatttttgttgagataattgtagattattaattgctattgtaagaaataataaatgctgtgtacactctaacctgttttcccagtggcaacattttgcaaaactatattgtcatatcacagcgaggatatttctgttgatacaatctatcatattcagatttcctcagttacttgtattcatttttgtgtgtattttatttaagtctgtacagttttatcacgttttcactaccacagacaagatgcaaaacagtttaacaaccacaagaatctcttctttctgttgattttatcaccacatctatttccgtttttgccaggcaaccactattttgttctctcaattatttccgtaattttgtctttcaaaaaatgttataaaagtgtaataataagtatgtaacctttcaggattgaccttttttctttcatgatcattctccgagggttgatccaggttattgagtatctccagagtttgttccttttattgttgagtagtagtctgtgatatgtatttatatgacttactgaaggacatcttggctgtttccagtttgggactaaatataacgttgctgtgaacattcacatacatgttttttctgtgaatgtaagttttatttctctggggtaaatgaccaggtatgcagtggctgggttgtatggtagttgcatatttagttttgttaagaaactgcaaaacttttttctagagtgggtttatcatgccacattgccaccagcggtttatgagcaatccattttctaagcatcctcaccagcatttcaagtagccactattttttgttttactcattctgagagatgtgtagtgataataacttattgtggttttaatttgcatttttctgatgactaa

SEQ ID NO: 78725 - DNA, 1053 bp, Homo sapiens
caccctggaacttttttcagatgaaggaaaagggttggagattgaagcatttttacagcctttagaatccattaacaaactcttcagaatttactcacataagttctttgaagtgcttaatagttgtatctgtcactcaaacacctctgtctccatactcaaaaatcctcttcataaataatgatctcccatcctcgcatagcaagtaacctattgtggggtagtggcatcacctagtcaccaacatcaccatcactactaagatttattgaagatttactatgtgtcgggcagtattttgaatactttattagttcatctaattctcaaaagtcagctggatggtgagtggtagagactggatgggacccagcaggtcttggctacaaagcctacaagcttaactaattactctactgaattcttacacagtagtaactgttttcttcttccttgggaagtgaatgtgtcatgttcctggcctgttctatttttcatagcttaatcattttattttgaacacttttcactcatataaaaatcaatttttgttaaacaccttcttccgctgtctcttaacctggtgtagtataaggaaaccgtttgttttccctctcccttcatctgtatcagattttaataaatttatgtcaacagtattttcagttttcttgaagtccagagttcacctgtttatctgtttatctgtattttcgtaaataacatctgtttaatgttaacagacaaaaacataaaaaataaaaatagattttaaaagttatttttgttaccactggattgaaagactttaagatcttcttaaaatatctgtggttccaaaaatatttaccttgctagtaaagaatttagacttgtatgtcttaagcaacttagatttgttaagatctgtgttggaatgcaaagttgtgctaccaaatacaccacataactgtattttcctcctttattattatagtcactttcctaaagccggctccagccagtctatttgcagcaattatattgtactccaacctggccagatctgtttgt

SEQ ID NO: 78726 - DNA, 1005 bp, Homo sapiens
cagcagagttctttgaacatttttttaacttgcaaaataaaacatagatttgtgttttcttcctaataatttctgcatttcctatgtacatttatcactttttattatagttaaaagcattattataattagctcttctacatgacatggttagccttttagttcttcatgttatttttaataagcccatttttctcgtgaagttgaatttttctaaaagttcatattattgtattttgacatagctttataatcatgtacatttgagttttgggaattgctattcatagcgatggtagcgatatatacttattgacttgctaaatactttttagagtgaaagtatcttattttgtggtggtggtggtttttattctggcaactaatgcattgagggttgttcccaataggcaaatgaagaggattcttccagttctctagtgaaggatcacctttttcagcaagagacagttgttaccagtgagccttatagaagctcaaatataagaccttctccctttgaagatctgaatgccagaagagtctacatgcaaagccaagccaatcaggtaagaagataaaatattttttcggcgcgttgtttatatgtgtagaaattgaatgatgtcatagataaggacgttaaaaccatctgccctttaccagacacagtaaacaaacaaacaaaaaccccacaaacaaaaccaggagaatttgatttataatgagccaaatccagagtgaaacaataaacatatacaccataaagtcctatatgggtgtagcgattgagcaaggggacatcacaagcattcttattttaccccttatctcacaggaaagctttcaatatttatcattaattatgatgtgtttactatatgtttttatagatctctttattagattaagaataaccttgtgttcctacagaactaaatttttattacatgctttttctgcagtaattgaagtgattctattttttcttcccttattctgttt

SEQ ID NO: 78727 - DNA, 1132 bp, Homo sapiens
aatattcatagaccctgttgactcaggtagttttcaaagtgtgtatgtgtttaagtggtgtgtgtgacttttttctgagacagtggtgagaaaattgacatttttactctttagaatagttcttagaaatgtatatttaatatactagttgaggtcattgtgttctatcaggaaaaaaaattgttctctctgcttccttttgtgtaatgttcttctgtttttctttttttcacttgaccaaatatctagcttattctgtgtttacttcaagtcgcatttcctttcatgccttcccagaccatttaatccatagttatttcctcttgttaatttctaaattcttacagattctacttataaacatagaatggcctccatattgtatcattaaatgcagagaccaagggcacagtacaaagggtcctattttaaagatctgtgtgtgtgtgtgtgtgtgtgtctgtgtgtgtaaaaatttttggaggaatgcactaaaaaattttttttatgatagttaacttttaaaactgggtctgaaaggtctaagatggaaggaagagttttacttcatgtgcttttatactatttgaaaattttgctatctgcatgtattactatttattttcagggttatagtgtttattaagtatgtaacagtaggagttggctcaaaattatctggaaaaataagaagtaaacaagattgccaaaatgttgatgataagtgaagctagataatagacccatggtgattcataacattattctctccttttatgtatattagaatttttcaccataaaattttaaaaattaaacattgatatattctagctataatttaggtctgaaatgggctttgcaattcgaaacacttgtaaatgtatcaggacactaaagattcctatttttttattgctatataattcacctaccacaaaatcatcctttaaaaaagtatgtaatttggtggtttttattatattcacaagattgtgcagccatcagcagtatcaaattccatatcacttcccaaaaaacccacactgattatcagtcattgcccctccttccctattcccagcccctggcaaccattattgtgacatgtgtaactactttatttctcttt

SEQ ID NO: 78728 - DNA, 1201 bp, Homo sapiens
gaggttagggcttcagcatatgaatttgaagaggacataagtcagaccataacattttgtcctttgttcccaaaatcatgcccttctcacttgcaaaatacattcatccttatcctaacagccccaaagacataacccattccagcatcaactcttaagtcccaaatctcatctaaataacgtctttcaatcaagtgtgggtaagtggctcatgcaatagtagaggtacagatccaaaacagggtaggctgtctggagacccaagaaatagttgtagtctgagtccaaaggcaccctgctggcagaatttcttcttgctcagggggagctcagtcttagttctagtaaagccttcaactgattttatgaggtccgcctataccacagaaggtactgtgctttcctcatagtccaccaactgaaatgttgatctcatcccaaaaacatatcatagaaatgtccagaataatatttcaacaaatatctggacactggccccaccaaggtgacacgtaaaattaaccatcatagccctcattgcagtttttatctgtttcttttttaggtccctttgaaatcaatcagacatgtcagctttcaagatgaggatgagattgtcagaataaaccctcgagatatcttaatacgtcgctatgcagactacagacatcctgacatgtggaaaaatgacttggaaagagatgatgctgattccagtattcagttttctaaaccagacagtaaaaaatcagactatctgtactcttgtggggatgagactaagttaagttcacccaaagactctgtggtatttaagacgcagccttcctcattaaaaattaagaagtcaaaacgaagaaaagaggatggtgaacgttctcgctgcgtatactgccaggaaaggtttaatcatgaagaaaatgttaggggaaaatgtcaggatgctccagaccctattaaaagatgcatatatcaagttagttgcatgctctgtgcagagagcatgttgtatcattgtatgtcagactcagagggagatttttctgatccctgttcgtgtgacactagcgacgacaagttctgcttgcgatggttagccctggtagctttgtctttcattgtaccatgtatgtgctgctacgtccctttgagaatgtgccatcgctgtggtgaggcatgtggttgctgtggtgggaaacat

SEQ ID NO: 78729 - DNA, 1165 bp, Homo sapiens
cagaaggaaaccatttctggttatttggctataaaaagtcagcataaaatatgatccaactaaaagggattaatttttggcatttttgtatatttatgcattaggtgatgggacttttaaaggtttgaatttattaggacacgaactaaaaataaaagtgcactaggggacagttgatttcaatctaagaaaagttaacacttgggaattacaagaagtaaaacaagtgcaactaaatcatttattagttgttttttgaaagcagttttatgtataaataacaaatgtttatatttaactaaatgtaaggtacgaattattacatattaaacttttcttccccttcctagttctgaagtagatatatatatatatatatctactgtcacattccatatattttgaatatttaactcatctagttaataatgtttttattccatgcgaatgatttgatattttcatccttatttctctttggctacaatttatattgagttatatctgtacattctggtaatctaaaatccttaaaaatactctaatagccttgagtgaccaactttttttttaaagcacagatgtaattgtctaatgttctgatgggaacgtaacacttatttttatataaaaagagactgagtaaacaaacattatagaaaaaaagtgaagttttttagttgttttttgtggtattcaaccagcaagttgttttctttcagagtttcctccttcaaaaagttatattgcatttacaaatgttttacaaggcagaaagtttgactggatagttagtgtaaaagcttcatgttgagatcttcacgtatcattctgctaaaccagaatatgttcagctgtgttactaatttttcagcttaatcctcagtgcttattatttacataacaataactttttatcagttacattttatttttatttaaactggccaaaagcaaaattattttatgttaaaatgtgtgctaaactatcccaggaaagtatttaatccaacattgtaaatgaagtatcttgtacatataaatttatttcttttgcagagcattatattactggatgtttaatttacaaaatagttgggtaaatgttccaacaaactttaaagtaccttgaagtcaaattgtctgtttttgttttgttgttgtt

SEQ ID NO: 78730 - DNA, 1017 bp, Homo sapiens
gaattctcatttactcaaaagaaaatttccatatagggattcagagaacattatatcatcagttagtcttgtagactgattaagaaactgggtatgttaactataaagatccaaggtaaaataaaaaccatttcatcaccatagtttttaatgaagaaacttgtttaaaattgtaaaggaaaaaatgggaatgggacggcaaaatcttagcagcaaagtggttaaacaaattgaaaatattaatgcacaaacattaaaatattaaagcatatatgttgcatataaaatacagtacagaaccaggagttgcactatactgattagtgcttaacagaagaaatgattaaatttgttcctcccagaagtatatacacagttcatttccacagcattttcctatatagccagcaagttattttcttcagttattcacaccttgatcaaacctgaattataaacttagcacttacaaatatgaaaattcattcacaaggaaaaacagtatttccatttcaccaataaaaattttgaaagttaacagtctattctaggaaaccaagtttagctgaaaacttcagggatgaagatcatctgttgtagcagcattcaaatatataaacagtaaaaataagacttaaaactgctgcctacagtgtcatgttttggatttagttcatccaattgatttttagtacaaaactagaaataccctcttcttcataacatctatagttatcaatatattttcttcttttcaatgtgaaataatacttcaagatgatctatatacacaatgttgtcagttcaagctgtcatataaatataaatgctttcttaaaaaaagtattttacagacagatagtgttatatacattgttcagtttgatctggggcaaaagaaaaaagctaacacaagcttaagtgtgatatataaaaagaatgatacataaatgacgtttaaaaacctgcatagaaaatgagcttcaaatagtagtgtgattttaatttttatcacct

SEQ ID NO: 78731 - DNA, 1033 bp, Homo sapiens
atcaaggtgtgaataactgaagaaaataacttgctggctatataggaaaatgctgtggaaatgaactgtgtatatacttctgggaggaacaaatttaatcatttcttctgttaagcactaatcagtatagtgcaactcctggttctgtactgtattttatatgcaacatatatgctttaatattttaatgtttgtgcattaatattttcaatttgtttaaccactttgctgctaagattttgccgtcccattcccattttttcctttacaattttaaacaagtttcttcattaaaaactatggtgatgaaatggtttttattttaccttggatctttatagttaacatacccagtttcttaatcagtctacaagactaactgatgatataatgttctctgaatccctatatggaaattttcttttgagtaaatgagaattcctttgtgaaagcaaatgggtagtttaaatcactgattcttaaacatgtgtataggcaccttcaggaacattttctcattctctgtacagattcggcactgccaattggcttttcctctaaaacttttctttgtttttatctgatataagcagatggctcaagacaactgcttgagtaatagtattgaaaatggaatcatctagacggcatgacaagcaagactggtctgatgaacttgttcagaattgataattcttaaatatttctcttggcttcaaaagggacatcatttgatttctgaagaagtatgtcgtgtggagcttcagcaccacctactggatgatttccaggccagagacatgagatggcaatagggatctgacagggttcatcactactaccattaaagggctatttatgtggtgaccacctctaccagggaaaccaggaataagaactgtctcaaaggaattgtaaaatggttatttacctaatgtgtcttgttggcttgctgaaagattttaagcacttttttcttacatatcctgttttaaaatatttgttgatatttgggactggcaatcaaacttaa

SEQ ID NO: 78732 - DNA, 2055 bp, Homo sapiens
cttccgccagtcagggagaatttttaaaaataataatcaaaacatgaaaaaacataatcacacctgtattttatcatgacagcttcagagagtgtgtgtgtacgtttttctctcttttatttgagacggagtttcactcttgttgcccaggctggagtgcaatggtgcgatctcagctcactgcaacctccgcctcctgggttcaagcgattctcctgcctcagcctcccaagtagctgggattacaggcacccaccaccatgcccagctaagttttggtattttagtagagatggggtttcaccatgttggccaggctggtcttgaactcctgaccttaggtgatccacccacctcggcctcccaaagtgctgggattacaggcatgagctactgcgcccagccgtgtgtatgtttctgaaatgatgatggggtggggttaaaatctaaagggaaaaacttgaaactacctattttcattggttattcagcagtgcctaaaatgagcttttgaagtaatgtaaatgcactttcaattcatgtgtatagtgccatctgatatcttgggtaagtcttgctttttcttttctttttcctctcccctgcccccttaattaaatggcacggaaatgtttcttaatatgcacgtgagtctccagagtacaggaaatgtgctttcctctaaatggtcaatgtaaagaatcttaaggatatttcttgtgttgaaatttacattcgattttgtgattacacttggaagtatgtgttaaattgggtttttaattgtagcccaaaggtgcattaagcaagtgtaacattttttccacataaaacttagaaaactttagttacctgaaaagcaaggattctttactaattattatgctcattcttgatttgacttccatgttcacacttcaaagtgtaagaggaagcactagaaactggcattattgttgcactaaaaaagtctataaatcataatagcaccatgaggtgttttgcaatgagacaaacatgaagaatgaatttctttaagagagaaacacaaccggaggtgatttatataaaccaaaagaaaaaaaaaggctttaaggtattaggtactgtttgcctagcagccaggtggttataaaagattcatatgctttggtacactgataaatgttagccattattcctgaaagcttcttaaattgcatcagttgttttgaaattttttcaagaataaactagttgaaaagtctttgtattaaaaatacacatagatttttgtgaacatttccagtgtgtagtgtcgtttgctttctatttctgacctcaaaagtgcctcacttgtatattatttccattaaaagcttgactgcattctttctaatgaacaatgaaaaactgtttaactcatgtcataatgtgtctcctcagatatagttaactagcttgatagttttgagtatataatgtaaataatacattataagtttgtaaccatttctgttacttcatacccgtgtaattggacatagcagatgattatcataagaatttgttttaatggtttttttccctcctggaattacctgattaaacctgtcatgaattataaaaggactttttcttattctcctagagcttatcaaattatcacataagagataattactggaggagaaagtaaaaatggaagcttttgataattagctctgttctttaaaagtatacttttaaactgaaagttcacatatagttcatcttaataacatatttattcatccttaattgtattcagatttttttttaagtctctaagctaataatgttatatttattggtttggtaacatgttgcagctaagctaatgaccttaagtggcaattgtttaacccaggactactgatttttttatattcaagtcagtttcatcgttttacttaactcgccatataaccaaaaataacgaataatctaaaggaaaggttattaggacagtaataaaaaattatagtgtatctcaacactagaataagttggattactatattatagtttatttga

SEQ ID NO: 78733 - DNA, 1068 bp, Homo sapiens
cactttatgcaaagttctgctcattattgaagagtaaaacaccacattcggtaacttcctatcatcttaacaaaattgatgattattttgtacccatcgtagccaaagggagaaatagctaaaaacaggttctattgagagatactacaaaaatgtaatgttcctcacattattcatagtctcccactccttcattgctccataaatcagtgattaacctcaccctctgaccagtctacaagctgcaaacccagagtcctcccggacacaccctctcctgcactcccattcctggaccactgctcagcacctcccccttagtccaagctgctgtcagctcttgcctggacttctgcttaatgccccagcccacttccctcagtcctttctccatacttcaaatctattttgatctctttcgaggctctacattggccttagggcaaaagcacaaccacttagcactactgggtggactccacagtctcatcggccttcagagctctggccacactggccttctttcagtctttccgttcatgctttctcctgctgcagggccttccttcatgcaatttccaagcctgacagctcccttagcatctcccctcctaactaaatcctactcatctttcaagcagtcccagcatcatttcctcaggaaagctttttcctggacttcctgtcaggttatgacctctcacaactctatgtatgtacctaacatttatttgtgtgataaataaattaaaaactataattttcatgagaccaggcaccatgtttatttttctttatcatttcaatctctgacacctaacagagtaggatatatatatatatacacacaaacacacacgtatatatacacatatattttttaaaagaatgaataccgttaagcattgttcttttctctagtcctcccttgattcacaagtgccttaggaccagaataccccaagttctcagatctattttcctcagtggaaataacctacagagacagtgaaatcatttgatagctagaattataggaaagtcagagtgcagagtgaatactgagag

SEQ ID NO: 78734 - DNA, 1051 bp, Homo sapiens
tatacctattttaatatatattaggaatttgtaaatgttattaaaacaagaattgtcattgtaagagaagataaataaaaatgtaaaacaaaataagtaaaacccctacaattctaaattccagttggaaatagcaatatgaaactgatatagtttctctgaaaaaggcatagaaacagtgaccaacctttggtagcagattatgtactctaaataccattaaaagaatcggggctccttggagaaatgcctgattccaagtctaaggcaggaagatgttgttgtagaaagcaaggaaagtattcagagagtacggaggacaagacaaagggctcgactggcctacctgaatgggctactataaaccagagacagaagaatttgagtatcaaaagaataactgtgatggattaaaacacatcaagtatattatctgtgactttataatgttaacaaaagttcagttgcaaaaagaaccataaaagtagaaaactgatcatctaattcagttaagatagtatataaagtgttttgaaaatttaagattcttgtgaaatacaatttgcagaaatgtttagaagtgtaaaattataaataaatgaggccaggcacggtggctcacacctgtaatcccagtactttgggaggccgaggtgggtggattgcttgagctcaggagaccagcctggccaacatggctaaaccccctttctactaaaaatacaaacattagctgggtgtggtggcaggcacctgtaatcctagctactctggtggctgaggcatgagaatcccttgaacccaggaggtggaggttgcagtgagccaagattgtgtcactatactcctgccagggtgacagagtgagaccctgcctcaaaaataaaataaaataaaataaaataaaataaaataaaataaaatagtaaagtaaaataaataaaataggtttagattaaaatgatctaatagattcttttcaactttagcttttttaaatttgtaatttgtgtctgtgcttttttcaccatatttttattgtaattaatat

SEQ ID NO: 78735 - DNA, 1656 bp, Homo sapiens
attatgttgtatttacttttctgtttaatagtaaactgataacttacggtttatagttttatcaataatgtgcccactgtacaaagaaaaatcacatattccaaagaatttcagtatgtggtagtaaacatttttggattaaattttatattaatccagaattgatatttaaatttgctataaaactataagcaattactatttatctgctatttttttctcttcctgacggctctgatatctgctgtctaaaccttagtattgttttttagaaaaagtagggtctgaatttgattatttaaaagtttaatttttgaatggtgctcatgttgaattaaggcttaaaatattatatatatataattcctaatttgtgttctgaagcttgtagctcaggatatggattcacataggaatacttctattaaaaacttctgtactagctcataaagcttctttagttcattaccatcttagtaactggagtcctgtgggtctttggtagaatttcggatattaatagtataataaaaagaaaaattaaaaattgtgcattcacaaaagtagctttttctttgaaaagtatcctttttttcttaagagatggggtcttgttatgttgcacagactggacttgaactcctgggctcaagcaaccctctcaccccaccctcccaagtagttgaaactgcaggtgtgggctaccgcacccagccagatctaacagttcacttgacgcaaagtaaactaatttgaattctaaacatataacacgactgcctacataattacattatgaaataaagataagcagtgagggttaattagatggttgcatttattttctgaatatatagaaatatagtagaaatggatcatttgctctgaagtgaattaataattatagccataataatgcttttactatttcagttgttaacgtaagcttcgtgatcacacatttaaggatttaatgtgaaaatttagaattgaatgtaaaatggaaataaacgagtagattttatagtattggattatatggtaaatgctcagtaaatgttttatgatttttcttttttaaaggaagagatgatctagagagcttccagcttgagataagtggctttttaaaagaaatggcatgtccatattctgtactcatatcaggagatattaaagatcgtttaaaaaagaaggaggactgtttgaaacttctatgtaagttatcttgaacatttaaatgcatgtgtttgacatggtttttattattttcaagtcaagatttattaatgaagcattagacattttgtatattaaaagggttttaatattttacttaaaatacaaagctatctcagaaatgtttatataatatagtataaattttaccagtatgccttctaacacttgtgatttatttggccaatatagaatgtcctgtgtttgtgatttatatagtactttagtaatttttcctttatctcattctatctgttattgttcgtgactatatggctaacattgatgatctccaaagtcctatttaatctaaaaactctctgaaactaggcactggatgataatttgttgatcacttactctaacaccaagaactgctctggatactagggatatatgagggttgcttgttttgtt

SEQ ID NO: 78736 - DNA, 1694 bp, Homo sapiens
cttactctataacaagtgattttcagatttattaaaactattacgtaatgttggaatcctaggaatggagctgaatgtgattacacgtaacaaactacaagtatacattgagaattcctctggagtgaggagttacaactcatactttttataatgtatgaaaaaacctaaaattggatatatttacaacagttggagaatctacagaaatggtccattttaagaaaataaattaataatttctttaaaatatgtacaaattgtatcagtagagaaattgtatcattgtagatgtagatttgctgtgaagctactaaagctgaagttttggggtctcttatttgcacaggttctttctaagctaatttttttaaaacaccatttatgaaatgtaatcatgccataaagtttgcccattttaagtatatatatatagttcagtgaattttagtatatttacagagttaaacaaccatcaccaaactcttgaatttagagcttttccatcaccctcagaagaaacctcaactgtgcccatttacagttactccacattacaaccccagcttccaagctaattttgaattctttccttaaagagtgcccccaacattaaataagcttcatgctccttaaaatctgaactgcccttggttgtttcctttggttaccttgtaaaaaaaactgtatttcatttggttttgtaaatattttatttagctaatgatggattctccagtcaggaaggtaaattaatcctttagttaggaggataaattattgaatgaccctgatattgctaaaggaaaagtaaatgcctaatatcttgtttatcaaaataaaaatgtttcaagtaatttaaattaggggctttgcaaaagtaatgaaaatatgtatgtgatgactgtaattgagagagatggcttgctcccttatgttgtcttgctgaacaatgaaacaagagtacttacaactggaatgtgtacatagcatttatttgagaaaaatcaatgtgctggttaaaggttttagtatcccttttgaaaatttactagaaagtaagaaagtgctatcttaagtaggaactccaaagttatttcactaagacacagattctcatagtagaacctaggtacttctttagctgtctgtgtatgttcgttcttacgctgggaaagaatgtgctctatagcttgaatgaatataatgtgcttttttgaaaaagatactctgtattgtagtggtattctggtatatgatggtatattttaattatgtcactttaatattttattctgtagtgttcagagcgatactttaaacaagcataagattgttttaaattaggaatatacatttttcacaatcttttatatttacttttaggtgaaagatattctctcaaaggtccagaaaaatcatgtgggaaaaccactgctgaaaatggatttaaattcagaacaggcggtaaatccccctttttgttattagttttatgtaattacattagtgaatatgacttaattttataaatgaacatctattttgcaatatgtagcatgcatatattattttgtagaattaaaattgattgatattctggagtaatatgtcctaacatttctttagttaaattattaatttttaaaaatacctggctgaggatattgatagtgctcaatgtgctagcacag

SEQ ID NO: 78737 - DNA, 1050 bp, Homo sapiens
tctggatttaactttagatttttttttcattctctcaaaaactatttatataggattataagttaatttgggggaaaactgacaataatacttaatgttcccatacagaaacttggtatttcttaccatttatacaagttttccttttgtttttgcaagatttactgatgtttcccttttaaatgtcctgtatgtggttttggtaaaactattttttaggtattttttgttaatatgtatagaaatttttttgttattattttttagcgagttgttgctggtagttacatatttttaacacctgttggtctattttatttgttctaaattattcataaattctcagatatttgggtgtttttgctcttttctaactccttgcttatgcattatctccttttctttatttctaaagattatgattgtttttgctctttcattaaaatgtacttttgttccttttttccttaactcttgtcatttaggtaaaaacagatgatatagcaagaatttatcagcctaagcgttatgctttgtcacccaagacaacgattacaatggcacatctacttgctgctcgtgaagatctatccaagatcattaggacaagtagtggcaccagccgggagaagaccgcatgtgccattaataaggttggtgtttctttcagtacagtggaaaatgaattgatgatatcttacttaatgtttttacagattttagtctatttttctttcatgtcctggtaaatgtttagaaaaaagagtggcaggggggttcagtctaggcttagttatgttatttttgtgtatgtgtgtatgttcacttgaatttgtgtattcataaatcaaagtattttctgaattagaggaattatgaattgtttttgtcaaagctttagcaagaattatgttccatctttctaaaaagtaatcattttttgtcagtaagaatctttcggaattgtttcaagtactgacagattcgttatatccttggtgtaaagggaagaagagtttgtgctttagagtcagaccaatctgggttccc

SEQ ID NO: 78738 - DNA, 1445 bp, Homo sapiens
atattggcttctgtttattagaaacaacatcacttgaaacttttatgtaaacttttttgaaatattaggaactaaaagaaaatgtttcttcacacaggtgctgatgggaagggtgcctgacaggggaggccggccgaatgaaattgaaccaccacctccagaaatgcccccttggcaaaagagacaagaaggcggcggtggaaggggtggttggggtggtggtggtggaggtggtggtagaggaggtggtgggggtgggggtgggagaggtggctgggggggtggaggaggaggttggggaggtggtgggggagggggaggagggtgggggggaggaggaggaggtggtagaggaggtttccaaggcaggggagattatggtggaagagggggttatggtggaagagggggctatggtggaagaggctatggagatccatatggaggaggtggtggtggtggtggtggtggtggtggaggaggtggatatagaagatactaaaaactataaaaattagatagcagtgcttgcttctttatagatacattagaaatagtgttccaaataacatacttgaatatcatctttgaagtaaacaccatgttagactccctggtgataccactcttgaattggttaatatgtaagaacattgttttttattaccagttgatctctcaaatgaagtgatgactttttccatattctgtgtacccttgagcatgttgtgtctttttaaaaaacaaaaaaaagaacaaaaattattttttaaaatgtaaatatttattaccatcagacttggaaaatggaaagtattttattgtcatgattgaatttagattgttacctgtattttgttcaggtttgagacatataaaagaccccacctgtaatagaaaggaatatagacccttgcctcacctgtattgctgtggatgtgttttgtgggtttttcattcgattttacaaaatagggaaaggcacttccagttgtatttagtaggcagttgttgtgaatcatttttttctcttataggaggagattcctctctagccatgtttctgttaaagtttcattaattgaagcccaagtttactttttactgtacatacttattttctaattggatttgaaatcagcatgattttgtttgacaaagcaaagtttaagattgaggtcagaaatactttaatggagcaaagacacataccaactttacatgacggtgtgagaaatagtcctataaactggtctcttcatcatttatgctctcactttagatatccaaatattaaaaggcaggctgacctgtatcacacagaattaaggcagtaattttctgcttcagtagatcaagggtagggctaaggcatcctgtggtaattctgattcacagctagatttgggaaacacaaagttagggaatggctatatgtgatttgc

SEQ ID NO: 78739 - DNA, 1028 bp, Homo sapiens
taggccaagtaatgtatttttctcttagtgtagaaagttaagagaaaaagagctggtaccataaattttttcaatcttagtgtaaaatctgtatctcattgtaggcttctggtcaatacctatacataacaacttaatgtgatctaaccaactcaactgatagaaagctgaattgttcccagtggacaagtggtatttgatgtttagcaggtttttttgttgttatttttttggtaaactctgtggtaaaatctaaaataatgttaaaaccctaaaagtaactattgaatattctgtaatcttagacatgtatttttcaagctaaccctttgaagaaatgtgttcaaggtaggaaaatataaaattttttggttatttgtaaatttattttttgtgtgtttatatttaatgaaaagatgtaatttcatttgtgatagctgaaaaaaaggctttccataattaagaaaatacctttatcagtagctatgaactctgaaaaataatttttaaaaacttttaagaaaaaaactacttgagtaaaatatttcaagagttgtttaaaaatcttctttaaaacctttacatttctgcctcacttcttttttggtagcattagttgctgatgaaggagatttacaactactttcaacttttttaccactaaaggtttatggtaaatatggcagaaacaatagtttatcagtttcattagattttccataagatttctttgtacctttataggagtgctgcttgggttattcactacaatcacttatttcctatcaaagtttagcacttgctcctggaatcgtgttggagctgaaaccactcctatgtacacattcctataaaccttaattgaatgaaaagctgaatcaggtagactcttaatattttactctttcctgtaaggtgggattttcctgataatctttgttcagtaaaaatttcttttgtagaacagtttgctgagcagtatctggaatagcaggaaggaaatttggggccttaatgggaaaggccat

SEQ ID NO: 78740 - DNA, 1034 bp, Homo sapiens
accttgcattacagaattctcagtcatgctttcatggctcagacctgaccagagactgtttctgccaagttgagatctcccgcgagaaaacatccaaaagttttgtcattatctacctattgctcggaaatggtttattctgcctgctaaccactcacaaactttgatatgataacaaagactaactgctgcttacaaatgctcgtttgatatttaacttgctattttctattcagggcaaaataactatcttgaaaatggttgttaattctcagccacagtgaataggaaatgccaatcaaaagtagctctcaatttgtaattcatttgctattcattgctgctttattaacatacctcattctcctttccctttaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatcccagcatactttgtgaacctggctccttcttcactacctcagatctaatcaattagtccatg

SEQ ID NO: 78741 - DNA, 1040 bp, Homo sapiens
agttaggtactgtctaaagtcagaaactgtagcataagacatttccctccctatacacatgtacatgttacattgtttctttttcaagtcttatagatagtggtcaagttagttagggaaacctagtttggccaaagaacacctctgtggaaatgagtaatgctgccttacctacttaccacatgtcatcttgtatccttgttaagagtagggcccatggaagtaatcatgaggtagcacataccatattaccactgaggataaaaagaaaggtgagtttctaaggctagaagcccccccttgctacctgcctccatgccccttatactcacatccttgccttggtcatctgccggcagggaaggcctcatcagcagggatgagatcacagcctacttcatgagagccagctcaatctattccaagctgggcctgggctttcctcacaacttccaagagaccacctacctgaagcccactttttgtgacaactgtgctggatttgtaagttgttcttagggtgctccagggctgaatttggggaagagtgtgggatactttaagacaggcacagacctcacaatccttatgaacccatcccagcttggagcccagacagacacctagaataacctagagctcaagcgtgtggtttttacctgcactcatcatctctcgcttcttcctgttttttcttttctattgcaatgaggccttagataaatggtaccagaaatgctgaattaggatatacttttaaagtataatattcatgtgctgtttcaagtgttataacaaagacatatgagataccttctgtctttaggagataaccttggctatgcccctcttccgttccactcctgaccaatcgtttccccctaaactcgggtcctgatgcaaggctctatatccttctcagtttggagtcctgaggaacctgtttgcccgatgattcatccatttctcgagaatgtctgggtcataaggctgctagtgagagccaggtgtggtggctcatgcctgtaatcccagcactt

SEQ ID NO: 78742 - DNA, 1018 bp, Homo sapiens
atcttggctcactgcagtctctgccttcccagctcaagtgatcctttcacctcagccttctgagtagctgggactataagcatgtgccaccatgtctggctaatttgtgtgtgtatgcgtatttttttgtagagacagggtctcactgtgttgctcaggctggccccaaactcctgggctcaagtgatctgctcacctcagccttccaaagtattgggattacaggcatgagccactgcacccgacctctaacaatatattaaaattaaaagtgtcctcaaacctaggacaaatagatgatttaggattacaaaaattcaaacggattttaggaaatttctctaaattttcttaggtggcaaaatagagtggctgtgtctgttttaaagaagggagaggaaaataaagaatgaaaatggttactttggttacacatcatgaaaataattcacccgtgtcatgtacttgacatctcgtgtcacagcgcattccccaatcagcactgagatgctcaattcctgggtatccaaaaagaccaaaaaaaaaaaaaaaacctggaaacttgtaatctttaatgctactgtcagaggcgggagttggagttgagtaagtaagagaatgtaatactctcctccacaccccatctcacacacacacacacgcgcgcgcgcacacacacacagttttgagcagggaaatgtcatgactgtgccacagctgatttcagcaagcggtgaaaagattatggaggccacgtcacatggcagtctttggaatctgaagctgagtcactgagtctgccatttaccacatgtggggcttgtttgcccgtttttaaaatggagaataatggtaaaaaattttaaaggtggttttactttgggtggaaatttaacaagattgtcttagtttgagttttcccaggagcagatcctgagacaaggatttttaagtacaaatagtttactttggaaggtggtcctaggaaaaactggtaggggagtagggaaggcagctc

SEQ ID NO: 78743 - DNA, 1045 bp, Homo sapiens
ttttgagcatttactatgaataacacagtgtttatgttaatattttacatatgtagtctcatttagttcccactattttataagttcttgtatttgcaaagatctaactgtccctcagcatttatacttactttataaatgttaataacttttaaaattattcatgttcaccatagagaacgtagaaaatacagactggcaaaaagaaaaaaattaccgtcactcattttaccatcaagagcaagataagcactatcaactttcatgggtgtgcctttcttgattctcttctatggatatttacatgtattataatcacagtaactttttggtgataaactcactataactttttgcttcccataatttatatcttaaacaattttgatcttgaaatcaatattattatttataaagaggtatgctagcacacaaggttgctcttctattttaaaattgattttttaaaaataattctgcttagtcccttcaaatataggacataaaagtgaaggttgcttggcaactgaaatgatggtaatgaggaattaaagacattacaagaaaagaagagtactcagttcttttcaatgctacatgctaattgcagtaactatggctgattacagttgtaataaatgaaggaaacacaaaacttccattaaaaattcttgatgtgaacttttttttattttgtattacagtgaaagtgagatggggtttgctgaagagaaactttactttcagaaacaagaaaagatcttttgtctgtattaacttttttttcttttcttttctttttttttttttttttggcgacagagtctcacccaggctggagtatggtggcatgatctgggctcactgcaacctccacctcctgggttcaagtgattctcgtgcctcagccacccgagtagctgggtgtgcaccaccagagccagctaatttttctatttttagtagagatggggtttcaccatgttgcccaggctggccttgaactcctgagctcaagagatccacctgcctcgtcctctcaaag

SEQ ID NO: 78744 - DNA, 1231 bp, Homo sapiens
attccaggtgagtttgtgtggcacctttaggggaaggagggacaaggaagaggtgctggctatcccaggtgtgccccctcacgtgctgtcctctccctcttgagcctgactggacatcaggacgcagcttcactctgatcctggtatttattcacctctttcagtggttgccaggagttttcaccccaaccctttgtctccacccctaaggactcagccccctactgctggtcccagcctagaaagctcactttgtgttctctcctgtctaacagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccaggtgaggcttcttctctgagccctgctccgtgggatcatctgctagacaggtgacctgccaggagggctacaggaaatcctgtctgtaaactaacgcagcagttctcagattttaggcagcatgagcatcacctggagggcttgtgaaagctcaccctgctgcaccccagccccagagtctgggattctgtaaaactgcaactctaacaagtaccaggtgatgctgatgccggtggtctgggaagcacactttgaaaactactcaaggaaacaagaaatggttttcctttagcagtcagcctgttcaagccttagatactccttaggctcttaagaaaagagcttatttcaaatgcattcccccaattttaatcttgtttgaaatggatactttcta

SEQ ID NO: 78745 - DNA, 1356 bp, Homo sapiens
tccccaccccgctctgcattctacaagtaatgtgtgtcctctgcccacagggggtgctgcagaatgtgaggtttgtctttggaaccacaccagaagacatcctcaggaacaaaggctgctccagctgtgagtacccctctatttttagggcacatagggaatcagggggaattccaccaaaaacaaactgaggaatttagcaatagtggttatacataaattacccccagtgagatcatcaagaggcatacagaagtgactccaaggggtattatacacacacacgtatacacacgtgcgcatacacgcaacccctctacctgcatccttcacaccaaatgaaacgtcttctaccactaagaactcaagaggctggttggtaagagtatctatttgaagttttcattttgtttcttgccagctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtggtcagtggcctctgcacccagcccgttagcatgaaccctggaaggtttatcgcagatggtcccaaatgactgaaaatgcggggggacactaatgatattctctcccatttagactgaagagaacaaagagttggccaatgagctgaggcggcctcccctatgctatcacaacggagttcagtacagaaataacgaggaatggactgttgatagctgcactgagtgtcactgtcaggtaagggaccttcaccagccagaataagaatcgacggcttttgtttgaacctacatctttggggaaataccctaatcgccacagagattctttttatgttccatggcctgataacaaagtgttttttttttctttaagatgcaattatggcatctataagttcttctttaaactctcagatggtttatcaaagtattaattataccccaggctaagtatctaagagaatgaatctactaagacatctgaataatttacctaccttagttcaaagactaagtgttgaatgtcaggtaaataaaacctggttggaacattcatttttttttcccaaccctgatttatattcagctttggcataggttcttttagtacagtagcaattgtttttcaaatcacttagtctgacactgttaggatgttactgtctgctttgctcagatggcactgccaggtgtgtgattcactctagcatccccgcatgccagtggccagtgagt

SEQ ID NO: 78746 - DNA, 1057 bp, Homo sapiens
gcttaaatacaaatcacagatgactggctgtgggaaccaacttcattaaattccctttcttttccaatataaagacagatcacagatctatagatgaggaaaaagtgcttatagatcttccttcctccccccaaacacataatataaaaatgtaaaagtcctggctgaattttctgagtttgatttcagacatagatttgacccatgatgtttgttggttcctctgctataaattctttgtactgtaacttccacccttgactaagtagcaattaaaaagaactttccaaggaatggagtgacacgtaaactagcactagaactgtctctacgatagtggtggctgcaaatatgacagagacagatctatgaaaatcattccactagagcattgacagccctgaccatgttttggcttgtaaaggaaatgttacaggatgtagacttctgtatgcaacatgctcagcagcctgttcccctctcactctcttgccctgcagaactcagttaccatctgcaaaaaggtgtcctgccccatcatgccctgctccaatgccacagttcctgatggagaatgctgtcctcgctgttggcgtaagtttctcaaatggcatagctattcttcagtgactaggtcagttctacatacatcctagacagccgagcacaacactggaaccccacccccatctccatcatgcttccattcagtttcttgctgcagcagctggttaactgacagcttatctgctgtacagagccaaaactccattatgagtacatcgtaattacccatctggattgcagtaatggcagtgaagatcttggtatagctcattaattctgattttttgctttgaggaaaagagatgaagacgtggcagcaacagctctaagttgactgcttttagaatttgaccttagtggcacagagttaagaaaaatctgctcaccagagatattgacaggcttactgtgtaagcattggcctgatcgggcctggaagttttgcccctttcatctgtagggataagagggcctaagagaatagcagcaa

SEQ ID NO: 78747 - DNA, 1735 bp, Homo sapiens
gacctgggataaacccctgggccgttggcctaagaaatatgttgcttttcatcctgtataactgcaactttgtgccggctcatattatgttctagagagctcatgtacaccatggtgaccatagttaataatactggattgtatgcttaaaatttgctaagagagtagatcttaagtcatcaccaaaaaaagtaactgtaagatgatggagatgtgttaattagcttgacggtggtaatcacaatatatgtgtatatcaaaacatcacattatacaccttaaatgtatataatatttgtcaattatacctcagtaaagccaaaaagaaataaatatattgcttttcaccctctggcaagtggagggccctgaacagagccctctaaagaacagcttgtcctaatcatcacgtacctgatgaacctctgtttcccctgcagccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatgtaagcatcttagcctctcagggacgtggagaactgacctgtccttgttgtcgtcaccaagggcagctccacagcatgtatattaagaacacgggttctaggatctctggatcccaatcccactgcttagctgtgcacccttgaacacaacttaccctctctgaggctctttcctcatttgcaacttggagataataatagttcttgataagtttatcttgagcattttatttagatactgcatgtaaagcagttagcactgagttttggtttatggtaagcaccctgtaaatgttaggatattaacagcaacccataaaaacagcgaacttatccgttctctggtagaaaacattccatgttgacatttgggcatgtggccaggagccaatttctaccgtacactgggtttagttgccattgaccatttcctggaaatacttctgcgtgctcctgatgggagcctctatttggctgtctctaagccaaaaccatttgtgaccatcaactctgtactttagttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccagtaagtgtgaggtccgctgcaagggtgagcatgggcagcagctctgcccagctggttgcctggcatctgcagcctgcagttcagtgggtcatagagcaggaaggttacctactagagaaacaaacagaagcaaagtcctgcaggctcagcaacttcttttaatgaaaaacaaactcaccctcttccccagcattctttccatgtgtcagagaagcagaggtttcttgaacgggcttaggagagtctatgacaagggagggatttgaaagttgatcttaattgttgcctgtggttcatcttcttacagtcaatggaggctggggtccttggtcaccatgggacatctgttctgtcacctgtggaggaggggtacagaaacgtagtcgtctctgcaacaaccccacaccccagtttggaggcaag

SEQ ID NO: 78748 - DNA, 6172 bp, Homo sapiens
caggagctttgctcttttactgaatgctgcagtcagcattcgaggagattccagcttggttagtcctgagcgatttgattgctctaagatgcaggtggacaacataatcccaacaagttatcggttccctataccctataatatcttacactgtgttaagtgcccagcatggcagtatggcagcttagaccaaccatttactgtgactgtctctctctccttgtctcagatggatgcctgtccaatccctgctttgccggcgtgaagtgtactagctaccctgatggcagctggaaatgtggtgcttgtccccctggttacagtggaaatggcatccagtgcacagatgttgatgaggtgaggaactgatggggctccgagtttctggatctaggaaagcagctaacctgtgcagtcgcttccttatggcagtgacttctaaacatgatgcacgctcttatttcctccatagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtacagtcaactagacgagtaaaccagaggacaggagagctgtccttgaccaaaataactgggagcgggaggaatgtaatttcatacccttcaccaaaaaaaaaagggcgaggagatgaatgtacggtctagttttagaaacgtgattagaaaatccatggtaaatcctgcaggggaaaaacagtcttccatatttaaaaatgctgctctggaataagttgtgagcagatggacttgtaaacgcctaggtgctgagcaaattcaagaaaaataaacataaagcaaagtttgcttatagcctcagggagaatggggagggacagaggtaacccacactcttccaaatggagcctctgtctactcagagatgacagggatctggattcttgtttccatgatatctgaggattctcaaaagctctgtgtaacagcagcatggtgtaccctcaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggtagagccaggtcctttgtgtgcctccagaaagagggcccatcaccttatcaaaacacaggctaaggaattttaaatacttaaagtttggacatgaaactgaaagattaaatctcccaaagggagaggggcactaattcctattaaaattaaatcacttggtgccaaaaacatgaacagggctagctctttttgggcaactgtgttccatagtcaactcttctgtccaaaaaaaagttcagtactctatccaaataccagcaaagcatgacttgtgttcacaacatctataaagcctagagcatttacacaaattctgtatgtatatcccccaagaaaagttttattttcttgtcttcccataaaaaaaatatgctgttactgagccaaattctgttctttttctatttggaattccaggtacactccctcgtgcatgagctcagcatgaggaaggcaactgaagcagtgatatatatcttctctttcctaggataattgccccaaccttcccaactcagggcaggaagactatgacaaggatggaattggtgatgcctgtgatgatgacgatgacaatgataaaattccagatgacagggtaaaaacagttttctatccctttttcatcttttcagttcagcaacagcctgaaacactttgggattcaaggaaattacatggctatagcaaaaaatataccaaatcaatacacaggataattagaaattattcattgtgttccagtagtttaaggatgtagatgttgccaagagaatttttaaatgagggttttgtttttcatcagaactgtttttctctgtacttgagaaattataatgcataaacaaatgccactttgttccctagattcatttcaaatgtcacatcgaaattacagtaaaattgactttgggcacactatgaactgagatgatgggattatattctacatctcactaacttctaacccacagggatccatttttttaactatgtccttttaacttttgtagtgatcgttttacactgagtgatcaattagcctatccactaggtagaaagtattgctgattttcacagttttagacatattatgcacatggtttgaggcttgagctgttttcaaggacaacattgttaagtgctccatttcttctctttgcaggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtaaggtgctgcctgatcagagggcccgcgggagacagggacatgcacagctttccaaacgtacttctgtctagtcctggctattagtatgcactttggtggaaacatccaaggctggagagcccagctcttatttgtcccttgttctcttcaggtatcctcaatgaacgggacaactgccagtacgtctacaatgtggaccagagagacactgatatggatggggttggagatcagtgtgacaattgccccttggaacacaatccggatcaggtaggtggatggactcctttcagagtctttcagtaaactgttggaatatccctttcatggcctttgaaaaatgagcttaacaaagttcaaacactttcattactgtggctccctggcttctcatagccaactggaatacgttcatgtaaataatttgcctgatgtgagctccttgcacagagtctcacagatctttagcatgaagatctggtaacttcagtcttaccttctgtaagaagggctactggacttgctcagcatcgtctaccattgttaagacaaattatacaaagcagacatctgtgactgacaactgtacaataatattaatcatatgtaatactaagagatggaaaaataaatgtgcataagcaaaataaccattttcatggctaatgatgtaatctagctataagaaaatcatcaaactaaggatacatccaaaaccaaagtaatttatccctgtcataaacattacccagacagtatacaacacagggaccagtggtctgtttccatcttttcaggacttttcagagaagtcgacgtgtcaacagttttacaactgaaaccttctaaggaaattctctgttataaagtatccagaaaatttcatttaacattaagatgtaaacagttaacatttcatttcatctttagtaattaaatatcactctatttgaccttatttagaaagttttatatgtaaaacatttttaaattatcccttctcagatttttatacgaaaacaaagataaaggaaaaaaacttttaaaatgtaattgctactattgctatctttctgcaggagtgtgtaaatagacatgacaccccactggctgtatcaaacaatggagaattttccctgtggtgggggcataagttatctttaacatgaatggtttatactgcaatttaccctccatttacatctctctttcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggtgagtcatgggagccactttctaagacagggactgctggcacagctgtgtagattgaagaaatgaaaccaaggctcaaagcatttgacaggatgaagggaccaaatgccaacttagacaagatagtgacatttctgacaccagtaataataatagcactttagaattttgctgaactcttgcttttttgacctcaggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggtgagtagcgagttcttagatcctaagagactgatgcatacatggggaaaaacaaatataaaacctggcagttgtacctatccctgtgggtgctgaggatgtctaggaacatgatggagaaccttctgaaggctgcaggttttaacctggctctgggctcttcttccaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtaagaagcaaagccctggaacagagagagagcttatgggtgcctgactagcactggggatgctgtgctttgaccaagactctgaccagggagtcttagaaagttcccagcatcaccagctgcagcattgaactctgctttgtaaaaacataatagtgttgaaaagggagcttgaccaagaattgccctgcaaatcctaaggtgccttcagccttttcaaacaaaaaaacctccttccctcctctctgtctgctttatatgtgtgctcagtggcacacaacaaatatgagaggacttggaaaaattccccattgcagccctctaacttagatcagctcagtacctttcaagcattgtttctgatggaatgaaatagaaatctttacctgaaggagctgtgtttcaacctttccttttccttttccttcaggtgcgcaccctgtggcatgaccctcgtcacataggctggaaagatttcaccgcctacagatggcgtctcagccacaggccaaagacgggtttcattaggtacgatcatactgattcactttcacttacagtcacactgagggacaaaaagacaaaaagtattaaatagcattgtcactaaacaagattttttttccctgcagagtggtgatgtatgaagggaagaaaatcatggctgactcaggacccatctatgataaaacctatgctggtggtagactagggttgtttgtcttctctcaagaaatggtgttcttctctgacctgaaatacgaatgtagaggtaagagcaacatcaccatgaatgtacactggacatctctatttcagactaatatcaaggatgacggttatgggggagtccagtgtaaagactgttttggagacagggttatttctattttgcttttgaggacacaaggacaaaaatggaataatgcctaggcactgtggcttatgagttcctgagtccttagctataatattagtttgcttagcaatctctgtgctcctcatacacagtgcaaaggtaagctgcagaaaagctcctatataatttggacttcattaataatactgttctttacaattatatatttatatatcttactgcttattgttttatgcatgccatcacagcacgagttagcattcccaacttttccctgtatacaaagaagggagaggaatgttgctttcatattggcatgttaaattaatgttcactattaaacttagcatttt

SEQ ID NO: 78749 - DNA, 2768 bp, Homo sapiens
taaattattaatgtaatttttgagtccaaatttttaaaataagactccctaaactgttaacattgaaagcctttggaaagcataatatatgttctggaaggttcacgctgtgtcggtctcctagcatcaatgtcagctaataaaattaaatgctaatgtgcttgaacaaccttaaaattaggcttttgtcattagaaaagtagagctattcctatgtggttaacttattaactaagatgtctatgcttttatgaattagttttcatttgtatatttatttatatttgtttatttaacagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttgtttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatatttatacttactgtatccatgcttatttgttctctactggctttatgtcatgaagtatatgcgtaaataccattcataaatcaatatagcatatacaaaaataaattacagtaagtcatagcaacattcacagtttgtatgtgattgagaaagactgagttgctcaggcctaggcttagaatttgctgcgtttgtggaataaaagaacaaaatgatacattagcctgccatatcaaaaacatataaaagagaaattatccctaagtcaagggcccccataagaataaaatttcttattaaggtcattagatgtcattgaatccttttcaaagtgcagtatgaaaacaaagggaaaaacactgaagcaca

SEQ ID NO: 78750 - DNA, 1046 bp, Homo sapiens
ttgctatgacttactgtaatttatttttgtatatgctatattgatttatgaatggtatttacgcatatacttcatgacataaagccagtagagaacaaataagcatggatacagtaagtataaatataaatttccatatgatttattgttgttccttgtacataagaaacagtaatatacaacttacactgctttagaatgtaaaatggataaaaatgtgtacaaaaaaaagcacattcctagaaaaaggtattggcaaatagtaaaaatgggaggtcaaaagcaaaaaaaaaaaaaaaaaaaaacaaaacaaaaaaaagaaaaaaccaacaattcttcaattcagtgtgcaaacattatataaaaatagaaatactaactctacaggcagtatttcctgataaattatttaaatagcatatctacacaatctgagatatctattccaatggcaatgagaaaataatttataaaaataaagcaatggtataccagatgatagaaaaaaaacataactttcagaaattgtatttaacatttcaatgctatttccttattgggaatacttctctgcagagtttttatgctatgtacaacactgactttttaggtactacagtagctttaagtttgttagacacttaaactctttccgcttgatccaaaaattctttactcagtcacacaacaaatgaggtaatatttgtatgtaagtttcaccttttgtcatttttttctcttttggaaaaatgaaagaaaaaagtgtatatgctttccttctccctggaaatatgcacaagggatggggtaaaacagtattgaagacctcatggctttctttgcaatttaaaacatttgcaaatggataaccaactaattccacttgaaaagataaaacagagaaaaaaagaatcccataacatccactctgagcacaaggggcagagcagcttattagactgattttccttgtgctgttcttgcaagagatttgctgataaatgtcaactacttgctctcaaacactttccgtatgaagcctaaat

SEQ ID NO: 78751 - DNA, 1044 bp, Homo sapiens
acaacaaatacatttcagtctagtttttaatgtgttacacaaagctggttctataagtgcttggcatcaataaattaacaaccagcatttttgccagcaaagccagcagcatgcatataaaaccaacaagggatattaggcccactgccaaagctttatacaactagtgtcacttaatttagttctcatatcagagtggaatcatgctcgttctggaaaagtatttcttccaaccctcccggaaactggaaattaatatatttctctgcttgcttatagccaacactacaattttacttttatctaaatctggaggtaatgtttaaagactgtaattttaagctatccaagtgaggataagttttaaaacattacatggatagtggtgataacaagtgaaatggtcattctaaacccctaaataatatgaccactgaatcagatatgcatagagcccaaaaggtcctttcattcaacgtccagaatgtattcattcaaatattatttagtgagcaccaactatgtgccagtcaatgtctgggtaggcagagctattccgatagtggttatcttgcttggtgaacagaaacaggaatgcaggaaacaaattctgccaaaagatccctacacttaagaaatggcaaaaaatatactcctacatattaaaaataaatgaaaagaaccatatattagatgcaaacaaaagattcatgattattttctctcttttgtctttttctttttctttttttagagacagagtctcgctctgtagcccaggctggagtgcagtggtgcgatcatagctcactgcagcctcaatattattttcttaatggtgtccaaaagaatactgaagaaaggtcagcctggaatgttgaaccctacttatttcataggcagaaacagctgccaggttttggtcaactgctgtcttactaagactgccaaatggaaagcccaatagggctgccatgttatactgcatgtcattcaaatgttaccaatcacttaacattcattgtaaatactgagtgtttagga

SEQ ID NO: 78752 - DNA, 1020 bp, Homo sapiens
tgaacccaggaggcagaggttgcactgagccaagatcacgctattgcactcccactccagcctgggcaacaagagcaaaactctgtctcaaaaaaaaaaaaaaaaaaaaaaaaaaaaggaaaagaaaagaaagaaagaaaggtgaaagggcattgggtgtcaaaagcaggagtgttattgagtaagaggctgcaaagcagggaaggacacagattggagagaaaaggagagattgagattgccaaggagaaacctcacatttaaaaggtttacttgggacccagccatttgtagctacctgaaactgggatgatattttgcaaatagatacagacaagtaggcagaactgtctgccccattctcctgccaacaacaaacaaaacataaaacataattccaaataagggaaatgcccattactcagactttccctttgaatctaataatgtcacccaagtcttgaggaatttgctaattgtttgtagatcctacaaggtcataatctagacctgttttaaaaaatcttttaaaacttcaatatatttatttgaaagggatgaagaaatgatatacattctacccagtctgcaggattacttgacacttgccgtcataggctgggactcaagaagtattagaggccaccatttgttttttcagttagtcacagcctttgctcacagggcttttgaaattattttaattcagttacacatatagttgaagctacaaatttatctcagttctacattgtaatactggaacaatgcattgccaaggggcgataaagtcagaataccaatttatattgacagtttggtgagatattcttctgtgattatacaccaaagccttagatgtagaaattaatgggaaaagtttttaattgaaaatgtattttctcattttttaaatttattttttgttaaagtgaggcacctgggtttgaattttatactgctaatactttgggaaggccatagtggaggtggaaatatggttttgagatgaagcagtgt

SEQ ID NO: 78753 - DNA, 1065 bp, Homo sapiens
attcctaaaagtccaataaaaaaacccacagcaagtgttttggcaaagtagttctaaaaatgactgtatgcataaagcattggtttgtctttgagtgacctctttgactgacctagataccatgattagccatgtgccagttccagggaagatgtgcccaagttgctaattcctacttcgtatctcatttgtatgtcttactaaaatcagaagatcccccttctgccctgctttcatttagaagctgcctgatactcacagtcagcatggggaccctgcttgtttttaggctggtttatggactgcctttgttgagaaaaaccactctgctgcctgtattctgatcacatcaccaatcacattgctcctgaccatcagtcacatttgtcaaaaaagtgacaaggactccaagagcctggagaaacccatttgtgggtggctgttcgtgatcccagacttttgttctgctgctagcttcctgctcctgctttctccttgcaccagtgtaaaactcagttcattcattcctggtgccctttgcacttagctatctcttaatgatggtagaaggtccttccagccccccatcccacttatctagtaagatgtcatttattatcttaacaggtggcatcatggcttaggctttggttggatcagcctgagaaaatagctggaatccaggtaataatataaacattgaaagagacttcaaacctcatgtaaaatcttgccctccagccactcaaactgtctcctattccaaaatacttgagcagagttgctgtagttcacatccctcatcatagatggtcctgagcagtctagatggtggtcgggatactctgggccccactctgccttagccttgtgtccactcctcacttcactcttttcctcttttctctcctgtcagtttgacctcataaatatgcctccaggatctgctctttctccgctgtttactcacgtcttggggagaggtgctaactagatttctgtccctcctgtctcttgctcctccagttctaaaatcctccccaccccgcatctgctgatttcact

SEQ ID NO: 78754 - DNA, 1085 bp, Homo sapiens
gtgttgaatacctcatgtagtttattaaatactgtactgaaaatatattgcttttgcaccatggtaaagttgaaaaattgaaagtggaactctcataggttgggaccatctctaattgagagagtgccttgtattaggagtgactttgtattttctgagcaagaatttttgaggacatctctgccttgtatagaatatgtgatatttactccctggttccctgggcatcccttgtgtgctcatttgcacctttaattacaactactttttgttggggcttcctgtgtagtttcttagggcaagaaacactttcagaggctgctaaatgggaaggaaagaataactctctgaagtcaacctgagtgttaattcaatttccaggaacacagagttcaagcgagactccagcagagacaaaataatcaaatctcagttttcagaccctttcattgattgatgagaatagcaccttttgtatttgacctgttgtttctgtggcctgctcccaaggttgcaagtctttagtagcaatgaatctacaaatgaccagaagccttaagatgaagctttctgcgtctgccaggtgaaaggcaggattagggactagagggctaactgcctgtttctctgcaggatgctattattcttaagattggatggaacttttccctgaagagtgtcaaatcatttttcttgttaataacaaatcaatgggctctagcaggtaaggatcacaccaggtgcttgggaagggtaaattctagcctggccttgctgctgaatggtgggttgagtgctggtaaatcaccctgcctcttttgtgattgtacttgcaaggcagagattcttaaacctagtatgcataaaaatcacttgtcaaaatgcaaattattgagtttcaccaacagaaattctgttttagtgggtttgacatggggtcttggagtctattttttcgttttctttgagacagagtctcactttgttgcccaggctggagtgcagtggcacaatctcggctcactgcaacctctgcctcctgggttcaagcgatccctccacctcagcttcccaagtagctggga

SEQ ID NO: 78755 - DNA, 1050 bp, Homo sapiens
agtttcccgcactagccatgccagggtggagaagttccagcaagcacttctgttaaagatacttgtttcgtgaaaactatacaatgtggcgttttcattcctatctgtgattcatttcttaagttcgtggagttcctttgctccccttcccccagcaggatgtgggcaaagctgtccccctgccttcttccttcgcctgggcttctggagcctccggagctagctcccggcgcggagctccgcctacggcccgtccccggcgcggaaccccgcccacgagcccgtttccagcgtggaacaccgcccatagcccgtccccagcgcggagccccgccccgcaggctgccgggggcccaccgccgcccaggcaaggccgccctgccttgggcgcagcgctgccatggctgggggccgtggggcccccgggcgcggccgggacgagcctccggagagctacccgcaacgacaggaccacgagctacaggccctggaggccatttacggcgcggacttccaagacctgcggccggacgcttgcggaccggtaggaacgtggcttgtcaggcccgggctggcgtgccctggcctccccgggccctgggccaaagcccggacacttccagattgggccgccgctttaggatcctgcagtcttttcatcccttaggttccacccatgctcactttagtccttgcacctgcagctggtctgcagaatcccacctaggccgaattcttctacagtcctttccccatgatttccccagaggaatccccctggattcctccctcttacctggcactgcttcttattcctgcctacatcccataacataactgcctccttccaaccttgtcctttttcccctctgaaagcccttgcggatgataccacagcaattcatacgcgccccttgctactttgttctgagaacgctttttgggctctcgcacaggccttacgtcctcaatcagaattctcaagtctcatccatgcattcaaatctgcacgccacataattccctctgtactccccaggcatcctcact

SEQ ID NO: 78756 - DNA, 1099 bp, Homo sapiens
attcctgacctcaagtcctcccgcctcgcctcccaaagtcctgggattacaggtgtgagccaccgtgcccagccttttatccaaaactcttgagacttgatgggtttcagaattcagaagtgcttctgttcacgtttatgtgtgcacattccacacattacctaataccttcctcagtgtctggggcagcatcgaaaatcaaacacaatgaaacatagaaatactcaaatttcacactgaacaaataaacactataactaacctcatgtcagttcaggctaaatttgctgccaataaattcaggttagatttttttttcaacttcttttagtggggatgtgttgtaatataaatttcagtttagtagcatatgtatatcatttataaataacattttgaggtgcatgctaaaaacttttgcatttgtaaaaagtttagacactgctagtttaaagtatctataatttatagatagttacaaattactaacttattttggctagctttccacagcagcaaaaggtctgctcatttataatttgatagcttttggaaacatccctccaaaaaacttgcttcaatccctggatcccccagtagtgtatggtggtgtttgttttcctttatcttcaacaatactatatatgttagactttttcatctttgccacataaatgaaacatatctcattttaatttttatttatttataaattatctagaacacctttgtttacaaaccattgatttttctttttctgtgaactgctcatactctggtttatttttctactctgtggtccattttcttgtttatttgtaagagctaaatatcttaagaaaactagcattttgggtcatataatgcatatatttttctcctaattatatgcatttatttacgtaatttatgtgatttaaaaaatgttgatagagtcaaaatgaccttttttttcttttatggtccctgtgggttttttttccccctctgttccaatgttactaaaaaccaaattcgtcaaagtttacttttaacttgttcatgacttcgtttttaaattttcatcaaataaagatataagtaggtttttttttttaag

SEQ ID NO: 78757 - DNA, 1033 bp, Homo sapiens
tttcagttttctgttttgacaacatagaaacagattgaaattcgtagtattttctccttcctgctcccattccacataaaatttcatttcctctatttcaacaaaactacatcagcaatagatgttttcatgaaacctgtctcattttaagcctgttcatagttatagaattgtcactacagatacttatatttgcctagtgactattttgcttcctctgatgtgttaacttttgtttatttatttcttcataagttaggaagaggaaaatttggaagaaaacaataaaggcatggtgactgttgaaagcccttgcatagttagagtgtggctggtattagaaattcagcaagtctgtgcctcagatgacctttcactgcctagagtgagggagagtatttggatctgtcctgcctctcaatggggcactctggcgagtgtccattgtgcagggctgtgctgtgcactgcagtacgtttagcatccctggcccccacctaccaatgccacgagtgtcctccaggcattgaaacaaccaaataacctacatatttccagactccctctgaaggtgatgtcacctctggttgagaaaaactagttagagccaaagtgttagccatcagcacttaagcatgtctatttggtgtaatctttccccacccatcccacatggaaaggcaggttggcctggatggcgttaagtagtttgaaattattgtatggggaaccagtgaaggtttttgagatggaaagggacaagtaaaaggaaactctgctttacacagtgggtggtaaatttatggaatttattatcctaagaagtgatagggaggatatgaaaagacagataagtcaaaattgagctccttgaagtcagtaaccattcttggcccccaaaactgtcctgagagtattatagtaggtatactatacatactataaaaatattaattaacgaaacgttaattataaaacattaatgaaaaagataattaaaaatttatgaaaggaaattaaaagagtgcctctc

SEQ ID NO: 78758 - DNA, 1130 bp, Homo sapiens
aaggaagagtcaatcgatgcagcaacttcattgttgtcttcttttaagaaattgccgcaaccaccccagccttcaccagccaccaccttgatcagtcagcagccatcatcaagacaaaaccctctgtctgcaaaaagattatgacgtcctgaaggttcagatgatcattagcattttttagcaataaagtattttaaaattaaggtatatacattgatttctacagacataatgctatttcacacttaatagactaccatatagtgtaaacataacttttatatgcactgggaaaccaaaaactttgtgtgactcgctttattgtgacatttgctttactgaagtggtctggaactgaacctgccatgtctcagagggccgcctgtgctagcattcatctgagtcatcgtcatataatgagatttgaatgggtgttaaacatgggaaggcactgtgcaaatcactcttcttgtttatctaaaattcatttccattaagtctggagtactggaaagtctaaaatagacataattctaaagaaatttttttattttcaagtaaaatagagtataattaggtactaaagcatggcatagggattcatcttggtatggcattcactgatacttgccttttaaaactaggagtcatttaattatttgaatggaaataagtactcaaaaacagcttgttcttaagcacttccaattgcttatgaatgatttttaatctatacacagctctttgtcatgtaaaaataaacttaagtatactctattttttcaaatttgtaaagccaaagtttatttttttattaatttactcaacagatatttattgtctgtgtaccatgtgtcaagtgctattccagcactgggaaaaccacagtgagcaaaccacaccatgggctacactgggaagggaacagacagaaagcaatcaaataactgcacaaccaatcaggcagttataagtgccatgaagaaaatcagggtgagcggtctagagagtgtgacagtggagtggctgttctttacaaggcattcaggagaggcctccaagacttaagcagaggtctgagggaggccagtgagccctgtagcaccaggggagtaggaggcaagagtcag

SEQ ID NO: 78759 - DNA, 1091 bp, Homo sapiens
ttctaagtgggcctctgaccgccagtttgctttcctgttctgtagcctctcctgtttgggccttcccattatttgatcatttgtggttgatttttgtttacatgtttaggtgatgatctttgaactggcttaccacgtgcagtcatttctcagcgagcataacaagccccctcccaagtcttttcatgaagaaatgctggaaaggcgggctcaggaggagcagcagaggctgttggaggccaagcggaaagaagagcaggaggtgagatgcccttgtcgatgtctgtgtgcatggccagcctggaggattgcaaactactgtaggttttatctgtctctgcctacaaacttatctttaagttttgctcagcctttgattcaagaaaggtagacacatgtgagagtatgaaaaatatgagtgattccctcctgacacatatcagtactgtcccttagagccctcagtccaggtcttaaagaaatagaagagaaaagaagctgtttaaccaaaccacctgtggtcttttggagcttgttagggtgtacaggagttcactgcattttagaagctattttcttcttccctgtgcaagactagtatctcatgcccaaatgagtagcaaaagccagagaataatttttttattcaaacatttagatgtatatattatctttgatttaaaggattttaaaaataagacagttaatatctacgcaaacagattaaagaaaaaatacaaagattaaataccatttgtatttaaatcaaagataatatatgcatctaaatggttaccatttgtattttataaactcctgtttatatcctatgctgagattctaaagatttgtttaaattcaagtttgtttaaatacaaatagttaccatttgtatttttctttaatctgtttgcataaagatataaactcttgtcttatttttaaaatcttttaaatcaaagataatatatgcaactaaattcccttttttattttaatttatttttctaaagttttaaattttttatttgttttttctatttagcactttaatcaacttatctagaacttactttgattcaggttataaa

SEQ ID NO: 78760 - DNA, 1058 bp, Homo sapiens
ggctggtcctcaacttctggcctcaagtgatccacccaccttggcctcccaaagtgttgggattacaggcgtgagccactgcacctggcctagaattcttaatacttggaaaataaaatgatttgttgatactgaagagggaatagaaaccatatggatctgcctgaaatttcatccagtgatgaaaaagagtaattcaacagagcagatttaaaaggcagtggtgaaaaaggatagagtgctttttcctttatttttcctgagtctagctcaagcaaaaaaccagtcagacgtgtttggagaaattcagagaaaattttactcattctcttttacataaattagagcattaaacttaagggacatgatgtggtagcaggaagaggcactgaagcacaagcaagcttctcctggtttaaagcttcagctttcctgctgcctcactttgtgaccttggcaaggtgacattctctgtgactctctttacttgtcccttaaaatgggactgataatgcctttctttctgtcttgtataattacctccacagataagtgtactgccctatgtgaaactaaacctgcgtaaaaatgtaagatgagatccctgtttccaccagtgctcctgtcttgctcctgacctgccttcctgtcagccactctctgccctctctttgattctcccttcttctgttcatctcctgttactcttctccctaactttttacactattgcaagattctaagcattttcatttataaaatttacattttcttgaaaccataacctggacttcagttcttgagccagtacatatttaggcattaacatttttttaattttattttttaattgaccaataatagttgtatatattcatggagtatatagtgaagttttgatacatataatgtatagtgatcggatcagggtaattagcacatccgtcactgcaaatatttagcatttctttgtgttggaaacattcaatatcctccttctagctattttaaacgattaaaagttaagttcaattttatttcacttgtaaacattcagc

SEQ ID NO: 78761 - DNA, 1033 bp, Homo sapiens
gcgggggcctatagtcccagctactcaggaggctgaggcaggagaatggtgtgaacccgggaggcggagcttgcagtgagccaagatcgcgccactgcactccagcctgggcgacagagcgagactccatctcaaaaaaaaaaaaaaaaaaaagaatatgtggacatatgtgtggtgtaagatatgagtatcataatacataatcttgtcaccagtgtaggaggggtttgaggaaagagaggatgtgtaggattggaagcagaaagaccagataataacagagtattgcatatgtccaggagaaagttggagatgaactaaacagggcaggggagatagagaggagaaggtggtacttgaagaccaattagatgcagatgtaggagcccaaggagactcacaggtttctcacctgtgagacagaatggatgactatgcccctaaccaaaattaaagagtcaaggggaaaaatcaggtttagagcgagtggagggagtggcagttttattgacgttgcaatggtgtgagggataaatagtgcagaagtggagacaggaagtgcagtaatgtgactatgaggaacaggatggggcgggtggtgcagggttgagggaggggaatgtatggatcagagagatttataggctggtgggagggaacccagagagaggggctgactgaacatctgggagaaagggactaactaatagactaagatcccagaggagacctttgtaggggatgggactgaggacaggggtagccatccttcctcaaagtcacccacaaagaaagaatagtgccaatgccaagtaactttataggaggaacaatagaaattgtggactgtattcctcttgcctcgtgttctcagtgaaagtaaaagtcaaaatcatgctgagaatgagagggtgatctctctagagatctgtccatgcacgtcatcgaagtgtttctgataagtgttcaatcctgaccatcaagagctctctcccttgcctcttccctgcaaccctctcccctaatttattgt

SEQ ID NO: 78762 - DNA, 1051 bp, Homo sapiens
actaacagatcattttaattaaaatctctaaattatcagcattcccatgaaataaaaactgcttgtcagataaaaagtcaaagtgagctagttcagccatatttttccaaagtatttttgctgagacatctttatcatgtatatgcaggttacttcacctttgattattcaaatagaaaagataattagcaatgtctctttaaaaatttgttttcattatgaagatagtatagcatcatggaaaactattatttatataagagaaaaaggcagattactatatatcggggttatcagctgggggccattttgtagcctgcaggacatttgatgatgtctgcacacatttttgatggctaacattggggtcggggtgctattggcatctagtgggtagataccaggattgctgctaaaatcctacagtgcacaaaacagctgcctacaacaaagattacctggtccaaaatgtcatagtgtcaaggtgttatatatatgctatgatatggtaaattatggggtaaaggagaatagagggaactaaaagaaaaataaaacaagtggtgatttttttctccttttccaattttttagaattttctattatggttttaatgaaaatagagatttttataagaaaatttttggtgttacagaaatttagctctccctgtgtaagtgagaaccatatgactatcactaaataaatgtgtctcattttctagcttcaaatctaaactgtcatctcttgttctttccttccaaagcattgaccagtttgtatttactgagcatattcaaattttgcacttagaaagtcattgatgtattcagattttcaaattactgttttactgtgcacactaatctataatgatctcgatggcttgttctctattttcatattctttctgtcattttagttggtatttagctgtatgagtgtacaccagtagacacagtcagcaaaggtagactcgttatgaaaataacattgtgcataatggctagtagcataaaacactggcctcttttgttttttgagacagag

SEQ ID NO: 78763 - DNA, 1111 bp, Homo sapiens
caatgatctttattaaatcagaaaagattttttttttctgtcttcaaccttaactcctctttgccatgtgaggttctgaggattaggatgtggccattattctgctgctcaaatcatatactatatttttaaaaacccaaatacaaagctaatcagaaaaggttatttttaaattaaagtttgttttttctagtggctatacctcaaaagaattttattttaaaaactgttcactaattttgtagtatatgcatagtaggttttgagattagagaagttgagaattagctaaattttttccatctttatgaactattagattgaccatatggtttggggaggattcagtttagggcatatttgttctcctctcatttgaaagtatattttctatcaaatacttcacttttggttttggttttgtttttttatgcccccatcttgtatgatcaaatacttcacttttgaaatgaaacccaagttaatgttgactggcccaatattctttttttttttttttaacttatcagattcaaggaacagaaacagaattcaactcactggtaaaattgagccatccaaatgtagtacgctaccttgcaatgaatctcaaagagcaagacgactccatcgtggtggacattttagtggagcacattagtggggtctctcttgctgcacacctgagccactcaggccccatccctgtgcatcagcttcgcaggtacacagctcagctcctgtcaggccttgattatctgcacagcaattctgtggtgcataaggtcctgagtgcatctaatgtcttggtggatgcagaaggcaccgtcaagattacggactatagcatttctaagcgcctcgcagacatttgcaaggaggatgtgtttgagcaaacccgagttcgttttagtgacaatgctctgccttataaaacggggaagaaaggagatgtttggcgtcttggccttctgctgctgtccctcagccaaggacaggaatgtggagagtaccctgtgaccatccctagtgacttaccagctgactttcaagattttctaaagaagtgagtatcactgagattctctctaatagcactttactcctgtac

SEQ ID NO: 78764 - DNA, 1036 bp, Homo sapiens
tccatttgtagttatatttttacatattagtgaacaccctttggagcaagattttgtttcaaatcagcctctgtgatgggtaagactctggagtcaaaacatctgggttcaggtctcacctctatgtcctactggctgagtgaattaaccccctgccctgcgtttcctcctctgtgaaactgggataatagcactgcctacctcatgaggtggttgtgaggattaaattagttaacagccataaagtgcctggcacttggcccagactgagtcagtgctggttttcatcaccatcctcagtagtgagaactatgaagaaatgtgggtgttgccaggcattttatccctttttgttcaaagctgaaccttttctatatacggctaccctgttgccaaaattattgattcagagaagttcatttttaaagtgagatcttggtggctataaatctcttaaaaatactgtgcattctaggtaggctgtaacatttttctgatccagatttactttcaagtcaataacatttatgtcacagttgagttacagttgataacgcaattcagaaacccaacagggcatatatagggatgctcattgcagcattttgtgaaaatgtgaaaaattggaaataatctcaacagtaggagaatgtgtaaataaattctggtaggtccacgcctatacagaagtttaaaaaaaatctttaagtactggcttagaaagagctccaagacacatggtggaatgaaaaaagcaagctgaagaataatgtatataagatgatattgcttaaaaaaatcaaaaaacaatactattttgtttggatggttgtatgtttatgtgtataaatgcatagaaaaatctctacaatgagacaccctaagtggaagaaagaattggaaggggaggttggtcaaaggctttatcattatcagtaatgttttaatatttgcaaggagaaggtatatatgttttaatgatataattaaaaagtaattttaaatttaaaggaaaatacggtatcttatacaaatg

SEQ ID NO: 78765 - DNA, 1038 bp, Homo sapiens
tttactgtgagtacagtgtggacagctgtgttcgtaaagtataggactaagtgaagtgatttctattgcctcgccttgactgcaatgctcttagatgattatgtccttaatgaagtgcctttctttagtctaaaattcatgtttatttaccagaaaggtgagaacttttggggaagtagagattttttttctcttactctatctgtgttggtatatgggtgtggttttttttttttgttttgtttttttttgccttttttcatctgcatgtttaattaaactactttgttgttctctgaagccattaggtttttactttgtacccagatgtgctttctgccccttgaaatttttttctcagtgaaatttccatttatgtttttggggttagtccttgcctctgttactgcctgagctaaaagggaccaatgttatagtatgtgaggtcaaaggtgcagacagcattaggacgaaagtgaagagtgaggtttgggtgaggctgtcatttgggtaaagtttatattaaaataatatgtatgtaattggaagaataagcgtcaggtttcaagaaggtatcacctatcttttcttgctagcaaatttttatttctgtatttgattttcttacttatggtgaataaatgctttcactgtggcagtctgccaaaaccttgctgatttgaatatatttttttagcccacttcgcctaagtttccagaagactttgacgatggagagcatgcaaagcaggtaattttctgatgcgtcaattactatgtcttcagtcttgcattttaattattatttttcttctttttcaattagtaatcttctgccactcattctcttgtgtcctgggaacaacgtggggaaaaaatatgaaaagatgaagcacttaaaatgtcattagacttgaactacaccataaaaatgccaagggctggcacagaaaattaacaaactgcagggttcttttgtgcaattcgttgtgcttttgaagtgctatttggacccttggcttagctgttgaaaaaaaa

SEQ ID NO: 78766 - DNA, 1069 bp, Homo sapiens
gctcactagcccctaccttccaggctcaagcagtcctcctgccttgctgcttgaatagctgggtctacaagcatgtgccactgaccccagctaattttttatttttttgtagagatggggtttccctatgttccccaggctggtcttgaactcttgagctcaagggatcctccaaccttggcctcccaaaatgcttgaattacacaggcatgagccaccaccccagccagtctgagtactttggatatatataatatagtattaaattagagtatactctgactataacagtgcaaaaagaatgtatgaaaaaaaaataaactaggaagccatatgctaaattcaatccttccattgtgttaggatgacaaattggtggtaagtttccagatttggtcatgtaccagtaattgcttttataatgaaaatagtaatttttctccatatcccaggaaagaaattacagtatttatttgaaccataccatgttattgaaagcaatactcttacactgtgggatcccagaagataaactcagtcaagtctacattattctgtatgatgctgtggtaagcatttaattacttatgatgttgaaagataataccttgatgttgaaagataataataatagttcctgatgattttcttacccatgcagccatgaaactgaattgggagccttatctccttccttcattgctctaaattgaaagaaccaattgattttaattatatcaacagttaacaagtattggttgagcttttgttccatcctcagccctgtactactaataacctccggggtgttttttaaaaggctaacttctaattttaaaagatcaaattatttaatttgtcagatagtaaagttattcaccaacctacttattaaggcaaatcactaagtaattggtcctgatacttgccaataataatttcaaagatagttaacattgactgagccccgctctgtgagctaggcattgttctgagctcctctgatggatgaactcacttcattctcacaccagtgctgctattacctttcctttagagaccgagagca

SEQ ID NO: 78767 - DNA, 1915 bp, Homo sapiens
ccctaaagctctgctgctgtttgtcagtgacagatacaatatgatgtcaatcggacactggcagaaaccccagggattgtgcaaggggcttcagctcttactgattcatgtcctgcggctacggcacatctgccagcgtgggatgaaatgcccagagcctggcctttgttaggggagcccagagcaaaatgactccctccctgcccaaacaaatgccctcattaagcctgtccagatttgggtcacctcaccattcagcaagtacaactttccccttttaattcttttgtcagggtttttcagattttaaaataagttaattacggttttgtgtgaattgggagaaaaaattttttaatcacagaattcaatctatcctgtaccattaggagcagtttgttcaaaatgaaggctatacttgttagaattcgcctggaaattgtgtcttgttcagtgccagatttcgcgactctcattgttacctttttcttccacgttagacagagaagctgacgaggagagaagtggaagctaaattttgtaatctgtctttgtcttctaatagtgtaagtaccttctaatggtattattacagctttctctgtaattttgtgataccagaaaatgtcatcaaattctcgttgcagtagggtagcagccagcgcttcctaccacctcgcagatgcagtttttcccttgagtgttaggtaccatggcaacctctgggattaggagaagggagaaactaatgctgtgatcaaagaatgtctctccatgcttcttcttgatacgctgtaatcatcctgctctttcttgatcagcagatacttttctttgtcaccccttatagagctgtgcctggtagagcctcctgctgaacatacctaataccagttgtcctcttttgaattagattatacaggactagaaggaggcacagaattctgcaaattcatctggggagctacccttcccctacctccatgtcttctaactcctcagagttgaattaaagctctagcttttctggtatatctcttaatcttaaaatcttacatttgatcccatcatcaataagggaaatcttatggaataaacagtttggtcatattctctctgtaggcatcagattgatcccagatctttggtacagtaacccacacttaattgagtagctgaacaacagaatacaacagggattttgtacattttcctgaatatttaaataaggaaagtttttttttaatttcccggaacctgtctaggcccttgtctgacactcaattatatgatcttgcattgatcagcaaaattcacatatgggatagattaaaatatgattgtacacagggcaggaagagtcactcaatctttcggacacctacagtgtggcaggcacaatggcagggatataaagaagagtccatagactgcattcagcttcttggttcatattggcctttaaaaagccataaggggatatgcacagcatgtatctgccctcaactctgtaaaacagctttcagagggcacacggaaaccagagttcaaagaaatcacccctttgcgggtagggaaagtaaaccagatgcatagcactaggagttctgaaaattgagccaggttaaatcttaaatatttaatattgggggagatagtaatgatatgcaaagtaacacaacagctaaatatccaaatatgaaggacaatatacagtatttacatataatctaaacatgtacacagcacacacctatgtgcagaaatagtcccatgtgtaaatagcacagagaatctgcacaagactgctcagttcaatgattctatacccaagtttccaacccaaaaggttatttggactaaagtcacatttcagaacatctttttttttttttaagaaagtcttataaatata

SEQ ID NO: 78768 - DNA, 1009 bp, Homo sapiens
ttatttgcacctagccttaataaattcaccattaggtgtttctgagggaacataatgttctggaaatcaccagtattggaattatagatctaaatcaaagacagaggtttagaagagaaaccaagaaatagccaagtagtgagtatgggggaacattaccaagacacttaaaaggctacatgggatttagttttagcagggaaaggttcaaagtttttcctccagcaaatgattatttccctgttttcccaagatagagtgctgttgtctctctcaaaggctataaattaattcacagcatttgaaagaacatccattcacggctttttaaagaatatctttatttaccaaatgttctcctgtgggtggttgccaaggctactgccataatgaaggtggggctgctgttattcatgtttccttgtattatgaggggggcggaaagaacacccattatatttcattgaaatcagcttattgtgtggatccaggatttcacgcccagctgaataaatcagaatgttttccttaggcatttgttaacttaaaaagacatcctttataatttttacttgctcttgaccaaagcataactaaatgcaaattttttgtttttgtttttccaccaataaccaagaagatgtttttatatttaatggaaaagtggctcactatacatgtagttcactgtaagttatgtgttgcttgtgccttattgactgttctttaattgtttttgtttgcttgtttttagagaagcttccgataatcttgcagtgcaaaatctgaaggggtcattttctaatgcttcaggtataattactaattataatctgaacataatgatgcttatatgtttgctctaagcacttattactgtagctaactgcttgtgacactggaaatctatttttaaaataacatatacgcaataaattgtaccacatgggatgcatccctatgctttgaaatccacatcctagaaaaggataaaacaactggaatttag

SEQ ID NO: 78769 - DNA, 1047 bp, Homo sapiens
cctcctgaggctcagatgatccatctcagcctctggagtagctgggactacaggcatgtgccaccatgcccaactaatttttttagtttttatagagatggggtcttgctttgttgctcaggctggtctcaaactcctggtttcaagcagtcttcctgccttggcttcccaaagtgctgggattaaaggtgtgagccactgcacccagcctcttcttagaatttaattttaaattatgatgaatgtacaacattccattattccagtataagcctctgtctgtttgaatgaggttaacgacagttctttagggttaaaataagattctgtagtagtcatctctatagctgtacagaaatagcacagacaccctgcaaaagaaaagaaaagatataaggacagactcagtttaatgagtgaagaacagagctaataaatttttataacacctgtaggagctttatttaagcaaaaacaagatggaaggctagtcattaaaaaattatataggttttatacaaggtgtgactgacaggggtctgcagtataaggtcctagtaaggagataaccattcacctcataggcttccttgttgccttttaagtgtatgataacatgaatgattgattgattgattggcattatgacataaggacatacagcaaagtagtcatggttattttctttgatttaaacatacttagaaagtgaattacctgggtgaacaaaattgtaattgggacagctactcctaggacccctgtgttttgttattgatgagatcatgactgtgattcacagtccaagcaagatttattggttgtcagctgcaattctaagaacagcttaccaggcgtcaaacctcaacaagacaacaaaataatgtcactctgaaaccccccgccctgaattttaaccatgtgaaccctgctatgcccaagtgataacttactttttttctactttgatgttataaatttcatcacagactaatttgaggtatctttgctttggcaggcgtgacagcagctgcttcacagttgtgt

SEQ ID NO: 78770 - DNA, 1338 bp, Homo sapiens
aagtttcagatggtgagttttgggtgttccttatgtttcccttctcagggcaagagtcagtatgatagtgaacactgggtaagattgatacttgggttcactgctctccggagataagttttaccagtatgtttcaagtaaaagctgccagggtgtgaatttcaatgctaataccgtcttcctttctagtttttttaagttagattttgtcttaggctgtagatatatgctacctatactatagttgaacaagaagttgcctgcaattttcccttggaaaaaaacgtaaaaaatgtgtgcaactgtctgtgggtgttgcagaagctgctataatgtgaaagagtgttttatgcttataccattttccggtacaagtgtccaatggtgctatattctttcctgatttttggctaccctaaatccattatgcagatagggctggtgttctgccagtttgcacatcttcccactaaggtatgctctgttgtatctttcaggcttattcaaacctccttagagctaacatggatgggctgaagaagagagacaaaaagaacaaaactaagaagaccaaagcagcagcagcagcagcagcagcagcacctgccgcagcagcaacagcaccaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatcagcactgtctctttattcctttcccaacccattttaatagttctggcaataactactaaatctagaatgatgtgattaatgaataggctttagctctataatatcttctaggttattagaattgaaacctgacagttttataaaaagtcatgttatctcatgagctgcttcccacctggctgtataattttatcatcatggttccccagtttcgatgagttctcacagtcaaatgagagtttgtttaaccaccttaggagaaacatactacaaagtcatcaagaataaaggttccaaagtaattatgatttttggtttctttatgccctttggtttggatattttcatgtgcttagtcattacagccaagggaagaaaaggc

SEQ ID NO: 78771 - DNA, 1012 bp, Homo sapiens
caagaagaaggggtgcctttcctaatttgcaaaggtgccatatgggctcacagcaccctggaggagaagggcctcaaactgtgcatgtaagcctttgttttgttctgctcagatattctggatattacctcttcttggtcagaattctattctcagggtgtgtaccatgatttgtctgctaagaagacgggttcctgctttgcagagaaggagccggggaccagcttgaagactggctctgggacacactgaccattgtgaaattcagccttccctgtgggtctccataccattttatgatgtgtatgggacatacgttgttctcccctctctggatcaaggtggtgacaggcagcctgctgccgtatgcttcagtggcacacaccaaaaaaccgggattatttacagcagccactattcaccccttttggcagactctccacctgagttcagtgagagagaaaatgatttagatcttggtgctggggcaaggccatcagcttcagagaccttgccaggcccaggctgggtgccctgtggcctgagaactgagcccagactttgacaaacccacctcaacatcaagcctggggcaggtggaaggtggtctgactgcactgtctccatcttatgcaaagccaggaactcactcactgtcttaagtgagccagggcaaaatttacacccctcacgtttccctctcccttcttccccaccaacaaaacccaggaggtagctggcagagtagctgtcaggaaggagaaaggttctttctggctggttgtttttaattggcttagtgatctaaactggccccttcctcctctgcctggtgagttggcctaaacattcctcaagtctagcctcaggagacctgcccctcccccccgacctccaccccctcagactccatcccccacccccaggagcctggctgtctctagcgaggggtggagaatcagatttagagggagggagagtctgacctggatcctgacctgtaaccagctga

SEQ ID NO: 78772 - DNA, 1030 bp, Homo sapiens
agtacctgccccatgggctcaaggattcctggccagctcctgccacctccagcagacctcagggagggttgagtttctctaaggacccctcaaacatgtcgcaaaatgaaccaaacttctggctaggcctcaaaactgacttggtcccacttggaggccccaggattggtcctgaggtacagagccactgccaccactggcggcctgggaccagctgggtgtcagccacggatgagccgaatagccagtcagcatgttgctgctggcagcctgtgcctttgtcagctcttctttcaaaagaccccaccgacagaccgcattccacccccaacatcggcactgagggacatcgggggcaagtttgcagtggggccggaaaatatggtggccaccctaccatgagagtcagccgtaggggaccccagaccccttggtttccttggaaacaacatacctcttcccccttatccccagtcctttttcatacctagtgggatacagaagaagccaggacagtggctttgccagctaagtgacttttagagtaacagataacgattagagtggggaaccgtcaaagctgggtacacatttcctatcttcctccagcttccagctaggccagaagggcatgctctggaacccagcaggatcacagctgcctgtgcacgtcttcccttctctccctgctgcggcacttatggagaggatctaaagcagccggtgtggcagctccgatagcaggcacagggaatctgttaaccagacgctagaaactaaattataacttttgcatatgtgagaaaagacaacattggtgctaacagtgaagtaaggcccaaaggaaagacggcttccctggacaaagaagacctcagggctacccaaggaaataggaggagtctagagtagactcacaaatctgaacaagcccaagtcttccagttctgaggagaggaggtcttcagtactattgaaggagacattgatcttctggatgtacagttgtgcaggttgttcactgcacaag

SEQ ID NO: 78773 - DNA, 1642 bp, Homo sapiens
gggccactgaagtaatccaagtccagcccgtgctggctcctttctgcacactaggtttttattcccctgtccagtgagaaccctgtggagaggcccccgcccagtcctcctgccctggcagacaaagagagaacaaagaccgcctcttccagcaccccccagtttccacccccccaggcctctcctgggaaatggtacctgtgtgggcagggcaccagccccaatctggtgagccactgacccctgaactttgcccctagcttcccagcctgacagtaggacctgggataacctccagagcatagtatatattctttgtttttgttttgttttcaagtatgttcttgcttaatgtttaattggctccagtcagtaggagagcgctccaagagggattatttatggcttactgtcaagagcatctataaaaagggcagcaccgagctggagatgctggggagggagagcgggcgggcgcacaagggtgtgtgtgtgtgtgtgtgtgtgagtctgtgtgtgtgcgtgtttgcactggatgaaatcagatttttgctgcctcagcagtgtggtttaaattgaagattaaccctttgaccttcacagtgtcaaatcacttgcagatggaggccccccctttccccttgttctctgtgttactttggagtcgggggagagaggggggcacttcttctctttctgaagccagtttgttgttcatgcagctgaggtttgaggggctcgggagccaatctgattaaaagcagcacttggctaaactctggaaaatcctgcaagcaggggaaaaagcttaatcctcttgtgcatagtgcatatagagcctagtcttttctttttaatgttaaaactgcaattgtttttggagaactcaactctctcctccacatggcagtgtctctttcacctccccctcctccccgctgtgagctgtactgataggattaaagtgccagccgtgagacttggagatctgaacttttactggaaatgagagggagtcgtctaagattgcgtttgggagttatgttggtcttttttttttttctcccttcagcaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttgtgttttaattttttttaatttctctctgagtgtacatacaacatactcaagcgggaccttctttctctgtcaggcccttgacctggaatgggggcctttgtcaaacactgttgaaggagaggctgatgtgtctgtgatggtgagaattcccaagggctctgacaagtagattcttcgactgaggaatctaccagttgtcgaagatgatccgttagtgatgttctctgggaagtggactgtggtttttccagaggaactcagttaagaaatcgagagtggattagactcccagttccaccaaacctatgagccttccactgtggatgggggccgtgatcctgatggtcacattgcttt

SEQ ID NO: 78774 - DNA, 1034 bp, Homo sapiens
ttcctgtctgaaagcactctctggcccacagctgcttctgagtcccccaacgctcccagatgatgggagtctgtgcctcatcttcagagatctcaagttgcccagggagtaggtggcctccattagtggaatttgggagaaaactgaggcatacagagatgagaattgcctcagccccaaatcatagaattctcatctgctttccttggccattgagctgttttgagatgatttagtaaaggggaggctagagggtctgctttggtataaagaaaggtagtggcactctgagcacagagataatgggaagggacatagctctagggccagatggtctaggttcagtccagtccctgccacttaaactagctatgtggtcgctaagtaatgggcatgataatgtgcctcaaaatcacctggggaatcttctgatgctgggtctgcatttccaggcagctctctgatgatgctgaggctgctagtccatggaccaccctttgagaagcaaggatgcagaacacacagaacagagcctggcacctccccacccccgactgccaccctaaccccacgttactattatgaggtgatgattgttcttgccaccggtcttctcagacaagcacctcaggagaactggaattccagcagactggcctctccagggatgagtctgctcctggattctcctcttgttcggccacatgacctctgcacctgtctcggtcagcagctggggaggggaggagagggggtctttggcccagctgctgcaggccggaggcttcgggtttgcagctgagtccattttcacgctgttttactctaaccagattttgttaagccgggtgtgtttcctctttttactcatctttgtttacaaaacacgaggaagccatccatctccccaccctctgtctgccaggcctcttctgtggcacgcccgatttcccttcccctccgggcaggagctgcgcctccagcttgccgggttgttttccaggctcttccacgggggaaggaggaatgctgtt

SEQ ID NO: 78775 - DNA, 1048 bp, Homo sapiens
atctttgtatccacataactcttagctcagttgggtgcttagtagctcagttgggtgcttggtagctcagttaggtgcttggtagctcagttgggtgcttggtagctcaggtgtttggtagctcagttaggtgcttggtagctcagttgggtgcttggtagctcagttgggtgcttggtagctcagttgggtgcttgatagctcagttgggtgcttcattaaaatgtccttatttcaacagaaaacatcttcctagcttccttcaagcaggaattttcctgctctcaatgttcctgttcttaattgcaaggctctttctttcagccttggcctgagtaggtttagagaatgacagggaaaagggaagagggaggaaaacttcacatcgtggactgtgcaccttcccctagagtatagacaattctgcattttgaagagattgagtgtggtttcagatcacagtctgaagttataatttcagaccagttttagctttatttctgtttgatcttcagttagctctgcctctgaaagggttatttttttctggtccacagcgtccttactaaatagttaatgatctggaaacaatgtctttaagcatactaggggagcagatcagtggtgatttgctttgaaaaaggtaatgctattttcataatgtcaataaacacactgtaaaattttagtgaaggaacatagctttggagtcagaagtcagggcctcaaattacacccctcccaactaacttgggatgacttttctgagccattgtttccgtcgctctaaaatgggttgattaatacctgctcttcctatcgtgaggatcacatgagaagaaaggaaagtgctctgttctgtatctgagatattataagttgctctctgtttggtaaatttgcattttgtgagttaggttcttttagagctgcacacggcttcgctttgcttcttcctctgatactttggggtgaattagctctagctggagcatctggaacactggtgacacacagagcccccagagggtatgaattggatctgaaa

SEQ ID NO: 78776 - DNA, 1214 bp, Homo sapiens
ccctttgttgtcaatgaggaagatgtggcatttgagaggctgactactgccagctgtgggatgtgtgcctggaacagactcccaacaatgaatatgagttacctatggcagctgacatgaggaagaccccactacacagacgagcatgagagaggcccatccgtctacccacaggctgcgccttcctcctcagtggtaaacaaagatattggaccagttgacctctttctagcagtcaaaggctccagttagccttgttttcttcactggtgtagaaaagctatgagaatatgggttctaactcttcatccctaggacctggcccgaggcaggtactcaatcaatactggttaactgactgattgacagtaatgaacaaaagagaatagctagcacatgaccttgttggaccaagcactctaggatgtccaccattcatttgacaaacatttcttgaatattttgtgtcgggtgctgtgccaggcaccagagatataaatatgaaaaaagcaccagtcttatgctcaagaaaaacaaaacaatctatgatataacagcttatgagctatagccccagcaggagcctggagttaggggaacttgaaagaggatgggggccctcccacacccaagcatgggggctgagagaacaagagaaagggaggttgggattgctgccaagaggggtctttaaaaatgagtaggagttactaaaaagagagaaggggctttccaggtggagagaatagcacaggaaggactaggaggcaggagagtgagagtgcattcggcatctggggaagtgcaggtggttgcaatggcaggagcctaggagagttgtgaggacctgaaatgagaccctgactcactgtgcctgacaagcagcaggtggggagcaaacccagccccttcagttttgagcccagggcgggcatccagctgcattgtcaaagcaggggcttatcccactgagctctcaagtttcccagctgtggaaccacctattcctcccacttctgggaagggcctgcaggtgagaagggggtggggcacagaatgggcacctcacccacctgtatgcatttccttcctctccccagacaggctctgggatgccaaactgttttcaatcattggctttattctaatgagcccgttaaggctgccaggactcagggggaaccggcccagctggtctgactggttgggcagca

SEQ ID NO: 78777 - DNA, 1020 bp, Homo sapiens
catttggtatgattttacagaactagaatccagctttttgaattcaagggtggggcaggaaacagctaggtcagtggcctaagaactccggacgggtgagatttggggcagacagcaggggtagtcaccctacaagagtcacgccaagtgcaagcactcagagacatctcccaacactcaaaacagcaaagaagttctggtgctttaagtgttcctcgctcggctcagagactcggcttcgagccgcgactcaagacagcacctgggggtatttgttttgcctaagcctgctgcacttccacggccattgaatcccaaaaactacaattcccattatgcaccgcgagttcgcggactaaacaggcataaactacaagccccagaatgccttgggcgagacgcgagagcacggaggagcggaggggcgtggccacgtcgaccgcgcgggaccgttaaatttgaaacttggcggctaggggtgtgggcttgaggtggccggtttgttagggagtcgtgtacgtgccttggtcgcttctgtagctccgagggcaggttgcggaagaaagcccaggcggtctgtggcccagaggaaaggcctgcagcaggacgaggacctgagccaggaatgcaggatggcggcggtgaagaaggaagggggtgctctgaggtaggtacgggagaaagctgctgggggctgggcctgagaggacacggcctggtaggtaatagaaggctccgctcggagcagtcgagggggagatcggcaccgtcagaacagaccccaccggagcctccttccttttggagtagaatgccggaggtggaggtgaaaacgcagtggactgagggcacgtgcgaatcctgccgcatccagcttcaaagcgaagaaggctgcgggaccccagcggaacaaagagtttggaagttgcaatgttgtctgtttgtaactcagctcagccacctgctagttgtttgaccttgggcaaatcgtttgtatggaaaatgctgatgttaatgctg

SEQ ID NO: 78778 - DNA, 1574 bp, Homo sapiens
tctcttcttatgttaagtagaatcttaattatttctattcttttttttttttttttttttttgagacagagtcttgctttgttgcccaggctggagtgcagtgctgcaatctctgctcactgcagcctctacttccaggttcaagtgctcttcccacctcagcctcccgagtagctgggattacaggtgcttggcaccacacccagctaatttttgtgtttttagtagagatgaggtttcaccatgttgcccaggctggtctcaaacttctaacctcaagtgatccaccccacttggcctcccaaagtgtcgggattacaggcatcagccaccatgcctggcctttttctattctataacaaacccataaactctagtgcaataatttagatcaatattacctacttattacatgaataaaaatggaagtgatacttgttcattggctgttgtcactattgcatatgctaactttttctgtttacatttcagggcatttgaatatgaaattcgattttacactggaaatgaccctctggatgtttgggataggtgggtctttttatttcacaaggacaatagaaacattaacagataagtccttatggccatgtttctcaaattggggtatatggagtgtgtgtcagagtagacagtggtgtcctgggggcacagagatccagaataatcataatatatcttcctgaggtgtttaagattcaagaaatttcaagtttatgatgtacaactttgaactacacccttctatccctatcctcagttttccccagaagcatgtactagagatactttggagaagtttgagggatacaggcttagggtatgtcattgaggacctcaaaagaaacatactttacttctgctaaaatccagaatgggtcttggagcaagaacaaaagtacatgttcaatttaaaatgtgttcttatctttttcctcccatttaggtatatcagctggacagagcagaactatcctcaaggtgggaaggagagtaatatgtcaacgttattagaaagagctgtagaagcactacaaggagaaaaacgatattatagtgatcctcgatttctcaatctctggcttaaattagtaagtctttctcaagtgccatctgagttttaaatattaaactaagagattttctctagaggtatctggtataccaaaaaaaaagtaaaacagccattttgaaccatttagtagattggaaacatttaataaatatgcaatacttcttaaattggttctacttaaaggtggacttaaatatagtataataaggtattttcgcccttttaagattgatcgcaaagtctgtagatctctcagtgagtatggattaataatttattttatattttgaaacaaggtctcactctgtcacccaggctggagtgcagtggctccatcatggctcactgcagtctaaacctcctgggctcaagcaatcctctcgcctcagcctcgtgagtagctgggactacaggtgctgtgccattacgtccagctaattttttaatttttaatagagatgacttctctctctgttac

SEQ ID NO: 78779 - DNA, 1765 bp, Homo sapiens
gagcaagaccttgtctgtagaaataaaaaaaaattaaaaataatggttaagtgtaagcagcagcgtggaaaagtgaatgatgcagtattatagtggaataaaagcaaattttattatgatcaaaactttataagataatacatatcctttcatccttaagggaaaaaagactgaaaaaatttatcaaaatgtttgtgatgtgaggtttttagtgatattttcctccctcttgctaatagaattatctacattgtatatggtctcataatgtcccttctaaaacacagatttgactatgtcattcctttgcttatcgctcacccaccctaacacatacaacaattactattaggcagattcaaaattgattagcttgatattcaagacctatcacagcctttttctccagacaactatctagcctggacccctacataacttttaattttctgtatctttgcttatgctattttctctggctgaaatacccttcccttcccattttccacctgataaaagtccatttctccttcagggctaagctcaaatgttaaccccttcctcccccctttttttaattttctttagagacagggtctcactctgtcacccaggctagaatgcagtggcaccatcatagttcactgcagcctcaaactcttgggctcaagtgattctcctgccccagcctcctgggtagctaggactacaggcgccttccaccatgcccagctaaagttttaaattttgttgtagagacagggtcttgttatgttgcccaggcttgtctcaaactcctaacctcaagcgatcctcctactcctacctcggcctcacaaagtgctgtaattacaggcagaagcgactgcacctggcttattactccttcttgaagcctttactctccaactcttcttacaaatcgctcagttttgcctcttttttaggtcctcccagtatggtccttatcacattgtaataatagatttttttttcaatacaggaattgcatgtagtatctccagtgattgtttggcaactaataggcattcaatacgtgagtagaaattggttaactgttaacacttctgttacaggggcgtttatgcaatgagcctttggatatgtacagttacttgcacaaccaagggattggtgtttcacttgctcagttctatatctcatgggcagaagaatatgaagctagagaaaactttaggaaagcagatgcgatatttcaggaagggattcaacagaaggctgaaccactagaaagactacagtcccagcaccggtaaactttctttggagcttgtcttaactctaaaaataatagaaataaattatctcttttttgcatctgaataaagtgctttctggtggattggcatgttaagtttacttagttactattcaatttttttaaagatatattttaaaaattttatttatcatagagtaaaatccactctttggtatatggtactaggagtaaaaagacttgtgatcatcatcattaacaagatacagaataatttcacaccccccaaaagaattccctttgtaattagtacctatgctgaacccaaacccctggcaaacactgatttattctccagcctgtggttttgccttttccagactgccatataaatggaatcgtataatatatagccttttgagtttggcctgtttgatttagcataatgcatttgagttgtaaaagttctttatagattgtaagtataagcctttgtcagatatg

SEQ ID NO: 78780 - DNA, 1020 bp, Homo sapiens
ttatattaggtactttaaaatctccaggctgggcacagtggctcacgcctgtaatcccaacacgctgggaggccaaggcgggggaatcacttgaggtcagcagtttgagaccagcctggccaatatggtgaaactctgtctctactaaaaatgcaaaaattagctgtgcatggttgtgggtgcctgcaatctcagctactcgggaggctgaagcaggagaatcgcttgaacccaggaggcagaggttgtagtgagccgagattgtgccactgtactccagcttgggtgacagaatgagactccatctcaaaaaacaaaataaaatctccatctgaaaactataccatctgggtcattttatgtttgcatttgcttattgttttttcctttgaaagttggtcacatttttctagttctttgtgtgtcaagtaattcttgtaccctggacatttatcctgaccatatgttataagactctgatcctgttggccaatattccctggagaatatctatgtttttgtcttagtagacaaccacacttcagatattacaagttctttgtcatcttgtgtggctgttggttccactgtcagttcagttttcaagacctttgctgtgttgctttgggtctgtcccatgcatgtcctgcttaagggttaatctggggcttgggcagtggtttatatcattgttcagttctcaaagccttttctgtgctgctttgaatctaccctgtgcatgcatagctcaagagggaacctaagatgtatgccaattcacatacagaattaggagatcctcttgttcagctcattcctttgcagttctcctcccatattctttggccttcagagtcctcttttcccagtcctcaggccagaaagatggggtttctctgagttttacattcacataccaccactgcaacagttcaaaaccacaagagaaaatagaagaataaaaaaacaggaaacaatcctgcgtgggttgtttcttcaagttttgacccctctccacag

SEQ ID NO: 78781 - DNA, 1037 bp, Homo sapiens
agaaaccgtatatgtgtgtgcgtgcacgtgcgcgcatgcatgtgtatagaaaaagagacacagtgataaaatagatgtggcacagtgttaacaattggtgggtcaagttttctaataaaaagttagtgggaaaactctaatcttaataaactctgtgatcttagtcttaataaccctaacctgatcctcagatcaacttaatggtgattttcagaataatttaaattggtcaaacttgggcatttaaagggagagttaaataattctagccaaaacttttcatgatcttaaggtgactctctttacttctgagagaataaacatgttctttgggatatttctgcattcttcccccagcctgctcttctaatttgtttactttaacaaattggaaattttgagtctggtaaaatagtggtcacctcactaaaagttgtgcattctgctactttagacaattccaagctcgagtgtctcggcaaactctgttggcacttgagaaagaagaagaggaggaagtttttgagtcttctgtaccacaacgaagcacactagctgaactaaagagcaaagggaaaaagacagcaagagctccaatcatccgtgtaggaggtgctctcaagggtaagtttgttaaacgttatttcggaaaactgttagtttctagtggtaaaatcatgtaagaagataatacataaatatacctgtggacacttctagtttgctgaatactgagtagcaaaaagaaggaagtcaaaggagagctaatattacagtgtgcagtaaaatcaaaatgcatcagtaattttgtgtcttaattaagaaagacctaacatttaggaagcatcaagattttctgagtttgaattgttagttgaaagaagatatgtagtaacatagcaggtgttgttaaagtgaagcttacatataccaaagcctcagagaatgatactaatatggttaagaaccctgccttcagagccctttgggaccagaaattagactctctatatacccaaagatcagcaataattttt

SEQ ID NO: 78782 - DNA, 1021 bp, Homo sapiens
taattttgtattctctagttccagtatatctctgctgatttccattgagagaaaatttaaaactgaagaataaaacttaggttagtttctgataaaactagataatgttataatgatgactgaaggaagatgcagaatgtcttttttggaaatttgtgaataaaagatgtggggtgactggaggagggaaaagaaggcagaatataagtaacaaagaatggataaaacgattctatttttgatttattaatttttttaaagattatttttaaaatttctttttttttttctgttgtagtggaaatactgtccttgagttgaggaagaataggtatactttatctggcatctaagttaataatgaaacattttacatgaggttttaatatttttgctcctagctccaagccagaacagaggactccaaaatccatttcctcaacagatgcaaaataatagtagaattactgtttttgatgaaaatgctgatgaggcttctacagcagagttgtctaagcctacagtccagccatggatagcaccccccatgcccagggccaaagagaatgagctgcaagcaggcccttggaacacaggcaggtccttggaacacagggtaaggactcttagatccagtgctttgctgacacaacaaagacttcacatttagggtagagaagtatttttaccatctcttttaattcctcttgaatatttagccatggtctatatatgctgtctgagaacataaaactatggtaattttagttttcttcttcatctccagcctcgtggcaatacagcttcactgatagctgtacccgctgtgcttcccagtttcactccatatgtggaagagactgcacgacagccagttatgtgagtgtggtttttggatattttgaagtgggaattattaagggtgggcagaggcacctattctacttcccaaaggcagtttcttctttatgaagatgaaagtaaccaggccaggcgcagtagctcacacctgtaatcccag

SEQ ID NO: 78783 - DNA, 1046 bp, Homo sapiens
gagttgattttttgtataaggtgagagaggaggatctagtttcattctcctacttgtgacttgccaattatcccagcaccatttgttgaatagagtatctttccccactttacgcttttgtttgctttgtcaaagatcagttgactgtgagtatttggctttatttctgggctctctattctgttccattgatctatatgcctgtttttataccagtattatgctgttttggtgactatggccttacagcatagtttgaagtcaggtaatgtaaggcctccagatttgcagaacataattattgatggcccttgtaaattatttttagcttcttttatcaatcttattgattttttttattttgacccatatgaataatagtaattttgcttctttaggacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgggctgaagttttccggaagaaattaaaagagcaaagggaaggtgtgtgtaattcaagtttgtgaagaggacttaacttagttgtgtgaaggttgagctgacctattaagtctgaagaaaactaaccttatagtttgtacctttgtatgatgtttctatggtagtactgtttctttctgtgtatcagccaaaatcccactgctgccttctatggttgtactgtttctgtgtatcagccaaactcccattgctgccttccatgaaaactccttggggtgtgggggcactgagtatgtttagaagtaaaggaagaagttctgaactgtatgaacaatttatattccccaatacaataagcaagcagctatgatccctgacatgcatatatgtacattccatgcatccctattaagtacttttcctaatgttattgcttgaaatatttcactttacctttgat

SEQ ID NO: 78784 - DNA, 2683 bp, Homo sapiens
cagaatgatcttccctgatcactggtcttaagtagccctcccttggcctccatctccctacccagtcaaacattctcacgtcacctattttattctttttcctaaactgattttcttgtgtgtgtgttgcccccaaatttgaatgttagtatcacataaccaaggactttgtattatgtaccactgaaacctaagtactcagagctgtgcttggcacatagtaggtattcaatgtttttttccttttagtagaaacctgtgttgttcaaaggtattctatttttttattgaatggataaagaatagaggcctagaccacaagttgaggaccttattccacttaaatcattttcatctgtattagtaacatatatgttgaggagatgagctccaaaggcagtttttgacagaatgagttactatgaggaataatacctcaagcaactttactgtttctagccgagctattgaccagtgcagagaagagagcagaaatgcagaaacagattgaagagatggagaagaagctaaaagaaatccaaactactcagcaagaaagaacaggtgatcaggtaatttttcttttttcatacacaaaactagaatttattgaaacaaatttaaacattataaaaatatagaaggttaaagtcctcccaacccccatttagagtttctggtagtttcttagctgttagtagccggaaagttgagcgggaaagtaatttaacaggtgacttcaaatggaatttgtggcatgtgaaataagtggtgcagtttattgacttcttagttatactccaaatcattatgttattaattctggcttaagctttttattctagctatgttccattaaaatgggattgcctaaagaaatttagtatatgcctggcactgctcagttgagtacaacagtactggtttagagtaggaataaaaattattggaaatgacttttgtggtacactcattttgtactgttagtggatgtctagggaaagagtacagtaaagctaatgttagaactagaaaatagcattttctggatgggagggacattgattttgtttatttaatgcaaacagcaagaagagacgatgcctacaaaggagacaactaaactgcaaattgcttccgagtctcagaaaataccaggaatgactctatccagttctgtttgtcaagtaaactgttgtgccaggtaagactacataggtggaagggacaatgcatataggagggcatttagaaccaacctttgactctctagtgccttgaagtctccttgacgtttacagtatcgagacatggtttttgtaagtctctgtcacaacataagctttgatgctgatgagggaggacagagcattgactattttccactgaagaaacatgtttcttatagaaacaaatacatatactgtttttaaaaaacaaaatcacccatttctaccactaagagatgattaccattaacactgttctgtctcttcttttgtgttgtatttttgttttgttttataaaaatggcagcttaccattttgtaatctgcttatactattaatgcaacttgacatctattatcaaatatatttctgcaacatttttgataaccaaagcttccatcttctttaagagaatttgaattgacagtaataatttatcttagagtaaatattatatttaatggaaaagcctcttggacttttaaaaattaaacagttctttctgtgggtattgagcacatgatttaaaacaagtttctttacagagaaacttcacttgcggagaacatttggcaggaacaacctcattctaaaggtgagttgtatttgacagccttgagaagaacttgctgataacaaatgtattatgtaataaatggtaaatatttttaattatgataaagggattgaaagacagggggactaggatactaggaatttagtataagcatatgctttatgataggaaagacatttgaaagagtatttttttaaagattcctcagtgcttcaaaatatttggtttaattgtaattttaaatttacactaaccaccaaatcttatactttagttactgtacactaaacagcaaagacactaagggaagtgtttcttttcagggaaaaaaaaatttaaagctattttatactcaaattggttttcttttcttcaaaatgtgttaaaagtggtgaaacatgaatatctacttgtaaatggtttggcaaaaataaaaataaaaaacattaaaatctaattaaacctctgtttctaaccgtcaatttattggaaatataaagcatggaggaacgttgttaaacaacacagcgggatggaattggcaaaatccagcattatggggctagcaacccagtttgttcaacaaaaattccccccaaaactctatagaataaaagagatttaagaggcatttgaacagtcacagtatacggatcttaactctgcattcccaattcaaacaaactttaaaaaaatttttttttatttattaatatttttttgagactgagtctcgctctgtcgcccaggctggagtgcggtggcgcgatctcagctcactacaagctctgcctcctgggttcatgccattctcttgcctcagcctcccgactagctgggactacaggcgcccaccaccacgcccggctaattttt

SEQ ID NO: 78785 - DNA, 1100 bp, Homo sapiens
tttgtacttttaattttttaaccaacatagcaaaagacatttgttcttttttatataaaataccttttttggcaatgcaaaagttatgtgggccaatcatttttcttcagtaatgttctatattaaccgctatagactaatgacataatacttaaggtaaaaagaccctgtgtagacatttaagtcaaaataaataacctgtatcattggcattttattaaagttttaaggaggaaaaatcattctcttcaaaccagcctctggaagcttgtcatgagactgaaaagaattgagtatgtttaatctgaagacttttaaggggtgatgtgagcagtagctttagtaacttaaagcagtgttttccacatcctagggaatcatttggaggaagttttttaaaagcactttttcattttagtttcttctctgttgatgtatattttatatccagtaaactgcacaaatattgtacagctagatgaatttttccatgcaattttttcccatatcaagatacagaatatttccatcaactcagaagagactagcgagtcttttgtgactaacagtgcttaagccccattccatctaggtgccattggaatttccagggaagaagtccaagcatgtatttttgtctttttaaaaatactttctcagataattctgctacagttagtctactgactgctatgaaaagacagtgatgtaagagtaattaattacatattgtgttctggagtaaaccaccagagaacatgatgaacaggctagatttggatacagtggttctagattcagctgttcaaggatatgcttaattgttaaaggagtccaacttcatttacctttttttttttttaaccagtcttttacttgaattttgttaataagtacctaccagaattttcatcccctaaaaaaatcatatttaaaatgtctaagctaatatggccataagtagtatttgcataaaatgtatagattataaacatctattttactttaatcacatatataaatacatatatatgtatatatatatttttttctttttcttttttagacagggcctcgctctgtcacccaggctggagtac

SEQ ID NO: 78786 - DNA, 1092 bp, Homo sapiens
aatagcataggaaggaagaaatacaaaaagtatgagaaagagcaatacagagtatcatgaatgctacagtttcactggttgtaaaactgcttttcaaatgcatagaatatgctatgcatatatcctaccagacatacatgaattgtctttaagaaataaataaaaattaggtatgtagcatagaggaagaagacctaaaaactaggaggatagcaaatcattagaatatttactaagtgaaagcagaagaaaaatagtatttgtgctttagttcataggtgaaatttgttgaggaacaaaaccattgcccaatatttttctttgtatggagaatcttcctggtacattttttggatgaagtatagtttactgtgttcatgatataaaaacctttttatatttgcctagatattctgatatgctatttctgtaccctgtgtcactgagctaatatgtctctctcagtaaaaaagttcttcatgtattgaaatattttagctaaactttatatggtctttatttcaggatgaatttacaggaattgaacccttgagcgaggatgccattatcacaggcttcagaaatgtaacaatttgtcctaacccagaagacacttgtgactttgccagagcagctcgttttgtatccactccttttcatgagataatgtccttgaaggatctcccttctgatcctgagagactgttaccggaagaagatctagatgtaaagacctctgaggaccagcagacagcttgtggcactatctacagtcagactctcagcatcaagaagctgaggtgattggggatttacaggttttacaaaccagattgtttactctcttattctgcatgtgcttgtcagttacagtaatcagttatcaagttcttactaactgccaggtactgtgctaagtgctttacatgagagtagggctgccccagatgaagtgtcaatgggatttagtgattgatttggatgtgagggttaaaagtaaattttgatggtagagaaactaagtggtccgagaggagtatagtaccattgaggaaactttgcaaagtgtacatgactgacgaaaaggaggca

SEQ ID NO: 78787 - DNA, 1050 bp, Homo sapiens
cgagggtcaggagatcgagaccatcctggctaacatggggaaaccccaactctactaaaaatacaaaaaaattagccgggcatggtggcgggtgtctgtagtcccagctactctggaggctgaggcaggagaatggcgtgaacccgggaggcggagcttgcagcagtgagccgagatggcgccactgcactccagcctgggcaacagagcgagactccgtctcaaagaagttgccataaattgtgaaatttctagagtagattagtacgaagtgaacacagtttcataaacacctgagacaggtgagtgtagttaaattaacagtgctgactgtgtaatcttgattttttttttcttctactctgttataatatccattttaagcattagggtttttttggtgatatattttcacctttccctcccactggcagaaaaccctactcagtcaccatggtgttcacagtatcgcagacagctactgaagtccctaccagagttaagtgcctctgcagagttgtgtatagaagacagaccaatgcctaagttggaaattgagaaggaaattgaattaggtaagtaccattgaactcatgtcctctggttcatgacagtatacaaataagtgattatttgtacttaagcttgatgcttgagcactgtaaatattcctagattgtattttttaaaaaagcaatatagaggatgacacatcagtaacttcatgtcctaataataggaattatgtcttctcctcttgcaatctttaacaaattatttttaaaagtattctagatactactaactggcaaatacaccagtgcctctatcccttaaaccaggaggtaaaagctacagggctgtatatgttcacagtgatttttaaatggaatcaaactttctcaacaggtaatgaggattactgcattaaacgagaatacctaatatgtgaagattacaagttattctgggtggcgccaagaaactctgcagaattaacagtaataaaggtgggactgattctttataatttcagttactttgtaaata

SEQ ID NO: 78788 - DNA, 1050 bp, Homo sapiens
tcataatcattggtcaggctggtcttgaacccctgatgtcaggtaatccacacgcctcagcctcccagagtgctgggattacaggcatgagccactgcactaggcctaccttcctcttaaatgggattcaatcactcctgtcttagctccaccctcagcctcacttccatgggtaattggtgctgccagttatatagtataggaaaatagccttgtagtgtaaatgtagctcagctttctcctctgccaaaatcagtttttattctaattggattgttacctcctgttctctttccagcttatcctctttccagaatttgttgttattgtgtcttttatagtagatttatgcctttaaaaatatctctttattatttctctatcagaagggctggaaggaatgtgtttcaacctgccagccataaccatagacttaactgaacttatttttaaaatacaatgtcttacaggtatcttctcaacctgtcccatgggacttttatatcaacctcaagttaaaggaacgtttaaatgaagattttgatcatttttgcagctgttatcaatatcaagatggctgtattgtttggcaccaatatataaactgcttcacccttcaggtctgtaatactaaaaacataatttaaagtcctgaagtagagagatttgtgctccatttagcaaaggaatttagtacaaaattcctgtcaatcttctagaaatagaccaattcaagtataagttagaagcattgataattttctcgttattttgaccaaagatctctttggtatttttttaactttttttggtccgttgtcaagcataaataaaagtagaattgtacaatgaactcccatgaactagtcatctatgataatcttagctcatggtcactcttgttttagctatactacccccactggatagtttttaaaacccagacacaatatgtcattttactcttcggtttgttcttaagaaggtttgctatggattttgatgataatatgaattctcaaaaatggttggaatgagggtattttaaat

SEQ ID NO: 78789 - DNA, 1118 bp, Homo sapiens
cattgttttccattaaactctggaaggaagaatctaaacaatacttggaaagcctatctggaatagtaaacaagaaaggctatgacacctataaaattttaatttcctccatcataattcctgtcagtgtataaatcattgcaattgtatgtgttaatgtgtacagtacagggaagaagcctgtgctctgcttccatacttactttatataatatggaagcttgataaatgtttaatggtggccatgcaccgtgattgaaatatactttgtgtcaccaaagtggtgacattccttccgcattgggtggacactgccactgctctgtcttacaggtgcattttcaaaattaaccactggagggagttgttggcatagctaagatgtacccaaggtaccttttttttttaaagaccagctatgcagcttctttcatggcctatttttattatctccttctcttaaatctgggctcagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccaggtaagtgtaaaacaagcctgagcaaatatggagagggtttcttaatctctttattatctagataagctataaaagctactgtttactgataccgactcctagaatagatgacctagttttcaaatatcaccaagtcaagtaaaatgtaacatttttgtgttacagcattgaagaatatacacatacatgtgcaaacacatgactaactctgtaaccgagtgccagggccactcctactgcctaccacccatgtaatcttttataagtcattttctgtgatcttctctgtaaaatagggataacagtctctgctatgtgtttatcagaattgttatgaggagtaaatgaagtaatgtatataaaaagaacattagcacaaatgtaaagtcttttgtatggtggcattatatgcagaaattccttctaactcagctttagacataagacatttgctgattgaatatgtagcac

SEQ ID NO: 78790 - DNA, 1234 bp, Homo sapiens
ttaattcagaacttggccagtgttgtctcttacatgaacttttaaaaataggcttgaaatacaatgtaagacatataggatggatataggcatgtccacttggctatggtccaggcaggtctggctaacacaagcagaaacaagtggggtcagttggggtttcctaacagccctgccttatctaataagggaagtttctctgatcaaaagaaaataataagaagcaaaggtacaaacatattaagcagtagttagtttagtcaagcttacgattatcagagaattgtaaagaagatccactactggggtaggagaaaggagctgtagcctttttaatgacctagactctaggaaagttagaggaaataaaattcctttttcttctatttgtagaagaaaagtgctatgtcttagtacacagaggaaatttatagatttagatgagagatcttctttccctttatgtgcattgtatcttggcttttcccactatggtagcccttttttgtagttcttccctgggctttcaaaggactatttgaatgatctctaaccctagagttctaggtattaccttacaccattttggtgcataaatgtaccactgagttaaactaaaaggaattataattttcatatgcctaatcttgatggaaatggttttatatatttttaggctaaaagatggtgaattgtggaataaattctttgtgcggattctgaatgccaatgatgaggccacagtgtctgttcttggggagcttgcagcagaaatgaatggggtttttgacactacattccaaagtcacctgaacaaagccttatggaaggtagggaagttaactagtcctggggctttgctctttcagtgagctaggcaatcaagtctcacagattgctgcctcagagcaatggttgtattgtggaacactgaaactgtatgtgctgtaatttaatttaggacacatttagatgcactaccattgctgttctactttttggtacaggtatattttgacgtcactgatattttttatacagtgatatacttactcatggccttgtctaacttttgtgaagaactattttattctaaacagactcattacaaatggttaccttgttatttaacccatttgtctctacttttccctgtacttttcccatttgtaatttgtaaaatgttctcttatgatcaccatgtattttgtaaataataaaatagtatctgtta

SEQ ID NO: 78791 - DNA, 1044 bp, Homo sapiens
tcaatgtggttatccttggaaataggagtggtggtgagaggggtctttcactttggactttttacactcttgcattgtttcagtgaacatgtactgttgtatttaaacaatacaaaagtaaaaataaaggaatgtatgtttttaaaactaataataggccagacgcagtggcacacgcctgtaatcccagcactttgggaggccgaggtgggtggatcacctgacgtcaggagttcgagaccagcctggccaacatggcgaaaccccgtctctactaagaatacaaaaattagctgggtgtggtggtgggcacctgtaatctcagctactcaggaggctgaggcggagaattgctcgaacccgggaggtggagattgcagtgagcagactgtgccattgcattccagcctgggcaacagagcgagactcagtctcaaaacaaacaaacaaacaaacaaacaaaccctaataatagaaaaccaagagctatgaagagtacctaaaacttgtatatttgaacattttcctctgcaaagtccactttaaggcaatgtggggatatggaaaacactttttcttccttcatgtctttcaaattttcagaaatgttgttagagggaggggcaacatgaagatgtgaaggcactaaggcaggagatagagtttattacgttaaattcaaaacactatcatcttattcagataataattacaatgactctctttaagaaatgtaacatttctaagtttctgccagtttatgagaagcaggcggaaattcctgaagaaacatcaacaatttcataaatcaagaaaaatcatgttttccagatttctgctatagtagctagcagagataatagccatttcatgaaaggaactgagaactaaacaaaccagctctcctgaatctgcatcagtcaggttctctgttagcctggagaatcaagtccaggacagaagctatggcagtcctggggtctctaagcaacaggactgactgcagtcccacagatcacccctgcctggatgagagatgctccc

SEQ ID NO: 78792 - DNA, 1053 bp, Homo sapiens
cagcccttcccagggtagcccaggatgcacctgggacgggcgccgcagcctgcaatggtccctgcatctgaggagctcctcccaggtcaccaggctccttgggactgtcaggcaggtttagcccccagtgtcagcttgtgtttggggaggatggttttatatattctcgttggcacaggaagcctagtacagatgcagaacctgagggaaaggcaggcagagagagagaggctcgaggttctgctgaggcccagggtatcagcagggcacatctgtacagcagccgggcggggacccatggacttttccaaaacacctaaccaggccctagacagtgctaccccctggcgctgggctctctttccggaacccggggtgaacagacctgttgggttgatttagtagcaagtggtagccttgttttctggacgaatcctgggattctactccatggcacatcaaaccaagctccagtgtgcatgcccagggtcggggaggggagctttctccttggtcccttctgcagctgtgagggctgagggttaagaacctttcaccccgtttgggggtgctgctcctccatagccctgtaccccaatgctctagacttcattattccaccaccttccccagggcgggaggtactctttccattacatgcatcaggaaactgaggccagagacatgctgtaagtcttgcgaggcaagagggctcccgtccgcaggactccatggctctgcagctagactccgtcaacttccctcctgcctggggaccccaagggcctggcagtgtcagctccctcggctcacacttccagatgctcggaggttcagaggtttgcacctccctcttggtcccatcagcagagagagatgggtggtcccatcagggtgaggagcaggaagaagcaggtgctggacagcctggaggagagggggaggaagggattttctcccaagagtgcctctctcccaggcttcgggctccagggtgagtgggcagcgacccctctaggagccccagctccacagggctcctcctgccaagca

SEQ ID NO: 78793 - DNA, 1036 bp, Homo sapiens
attgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgagtctcgagagggccacggggtggtttttatgaccggaatcccgcttcctccctcacgtctgatgtcctgaaggtgcagtcccacctgtacagcccctccccgcccagaactgtgaatggcctgctccaggccatggctgggggcagggagtgaggggacaatttctgagtgaaagagaaagaatggggtcggtggtgaaggtgctctcactttacagaatggagagaacatcgtgtgtgtgtgtgtgtgtgtgtgtgtgtgtgtgtgtgtgtaaggggaggaaagccaccttgacagcccaggtccctccaggtcacccacagccagtttcaggaaggctgcccctctctcccactaagttctggcctgaagggacctgctttcttggcctggcttccacctctccactcctgtgtctacctggccagtggagtggtccatgctaagtctaacactcctgggagctcaggaggcttctgagcttctcctgtactgtgcatcgtgagggccagagacaggaatgtaaggattggcaactgtgttacctttcaagtttatctcaataaccaggtcatcagggacccattgttctcttcagaaccctatctgggagagaaggcgaaccacctccgggtttccatcatgtcaaggtcacaggcatccatgtgtgcaaaccatctgccccagctgcctccacagactgctgtctccttgtcctcc

SEQ ID NO: 78794 - DNA, 1026 bp, Homo sapiens
ttattctcagggccagcagcatgtgggcaacccctgtggaggatgcagggaacccctgtgaaagcagaggttggcaccaatgttatcagggcccacctgtcaggtaggtgttgtgggacgagttgatgaagtaatgattgagtggctgcgtcatgtcgtggtggagcagcagcttgtcctgggccagcacgctgttctctggcccacagagaaaccagaccatgccttcaggtgacagctggcctgggggacaggagatagctgtcaggctacaaccccgctgccaaggcaggacaggaccacaggggacaaggggttcccttagtcctcacccctctgtgcattgatgccactgggctcatacttgtcgatgaggccctgcacctggtcaggccgtgctggcgggaacagcagggagttaagccgggagtcccgctgtttctggttgatgaatttggtcaggtgctccttcgtcatgtagggtttggccttagcatggcttcaagccagagagaagagcacaggtccatatcccttgggcctggaggcttagacaacccccttgtccagtgaagcctcctgactcccggcatggcaggtgggaggaggggattgttagccaccacccttttcccatgaccagcacaacccaagaaactcactaagaagtgaagatctcatctatttctggccgaggacagaggctcatgaggaaactcttgtagacaggttctgggaagtcctcaggattgatggcgtcattctaggggcatagtaaccttattgcccctgccctcaccttctcagagctaagaaccacaaactcggcccagccctggtcaaggggacctggtcagaaggcgggctcaaggcagacagaagaacttcaaggacacccaagcatccacttctcaaggccctggttgctgagcagagagcatgcttagctggtttgctctgaccctgattttgtacagtggctattccattggctggggcaggatcggaactaagaataaccagaat

SEQ ID NO: 78795 - DNA, 1034 bp, Homo sapiens
ccccctgctactctcttgcccccaccttgtctgggaatgggggagggggtacacagccttgccttatccctgtagcttccttaccccatctacacatctcctccccagacctggtccgggcctgagttctgaagaggctggagagcattaggtctccctccccagcaagtgctctgcgggcctcccagctccaacacagtgcggggcaggcgaagggaagtttgaggcttctggaggcttctgaagcctcctgaggctggcgtggaactcagtccactgtatggggcaggatgcagagcgtctgggagaaggagagagagtgtgtgcgtgtatgtgtgtgagagaggcccagggcacaaagcctgggtgcgtcatggttgctgggagagtttgacgagtctgactcagtggggacatccggcaggaaaggaagggagagcgcagtggcatttgcaagcaagatgggaactctggggtggtggagatggggtgtggggccaggggtgctgtgcaaaggcctggacaggaagagggctaagcctggcggagctgggggagggagtggggaggaaagggcagttctggaggggtggaggttggacctctggctgcctgggtgggtctgggaggagaaagaaggcagcgggggtttctgctctggagacagaggggacgagttgtggcatttgggaaactggcctggtcaatcagggatgtggggaatgcaggggcttctgattctcacctgagggcctggagctcagggccttgtagctgaggaaacagactccacgaattcctagtccagaaagaccaccctcctctcagcacccccaagccttgagtcccagaggctctaggagcctgggcagggagaccagtctcagctgtatgaggaagatatgggggaggagctttcctgagaagggctgattcctttgccaggttcagagaggctgaaaaagccagtcttggagagcaaggccaggaagggcccaaacttagggcccgagggaggaaggctgttgaccagc

SEQ ID NO: 78796 - DNA, 1711 bp, Homo sapiens
tgtgggtattgtcctgatttcaaaaatgaggaaacaaggcctcagggaggttatgcaactcactgaaggtcatataccactgtgtaatagccaggatagaatgggacgtgtttgtgtaactctgtaggccgtatttttctttcttttttttttagacggagttttgctcttgttgccacccaggctggagtgcaatggcgcaatctcagctcaccacaacctccgcctcctgggttcaagcgattatcctgcctcagcctcccaaatacctgggattacaggcatgcgccaccacgcctgactaatcttttgtaattttagtagagacagggtttctcttatcttggtcaggctggtcttgatttcccgacctcaggtgatctgcctgcctcagcctcccaaagtgctgggattacaggcatgagctaccgcacctggtgtgggccatactgttaacccttttatcttttcatgtaagtacaactattattacagctacaaaccactgagtaagcaaaaatcagaggaagagctcaaggacaagaaccagctgttagaagccgtcaacaagcagttgcaccagaagttgactgaaactcaggtaagagacccaccagagctctgttaccagctgccactgggcgatccacatggaatcctgatgggtggccccttggatgagcaagcttgttaatgcacagatgcccaagggcagaaaaaaaaagccaggcttttgctatggctgtccaagagcaagggcaagaaagggcaaccacccctagggagttggacaattcctgatctgtctgtgctgtgctccaatagggagagctgaaggacctgacccagaaggtagagctgctggagaagtttcgggacaactgtttggcaattttggagagcaagggccttgatccaggtaagagacagcacacagctagcctcctttgaaggaattggtgcatgtgccccttccggggttgatcttggcagcatggcatcagctggcccagtatgtgcaggggttactttcataaagccctaaagattttggaaagcttctgtttgttttcatgtgatgttgatttttgcctggccaataggatttcagatgattatagagagagggttatctctttcttacctgaacactttatgccattcatttagtgccaacaggtatgaccttgcaaatagatgagaaacactttgttcctttcaagggagaacattttctgtctcttcctatttgggaaagttactagtgtgcttgaaaggaacattttgtttgaacatgctcttcctttcaagcatactagtaatcccaaatgggaagagaaagaaaatactatttcaagcattcttaaacctggttaatcatcagaattacagtgactaaaatatgactactattctgaccctgtcccccagaaagcagtatctgtagcaaagagagcagaagaaggaattgcccaaagactgtaagagggcctcagactgagtcaaagagccagagaatgcccaggaaaggggcccaggcctttttgtattaaggaatactgactttgaatgttactggttaatctttaggttacagttgaggatattctttttttttttttgagatgaagtctcattccattgcccaagctgaagtgcagaggtgtgatttcggctcactgaaacctcctcctcctgggttcaagtgatt

SEQ ID NO: 78797 - DNA, 1050 bp, Homo sapiens
ctaagtgagattgactttgttgtatccatcagctttaggcagtgagaccctggcatcacgacaagaatccactactgatcacatggactctatggtgagggcatgggtgtgaaagggcgcaagggctgagtgactgtggggctctgtaaatctaagaaggtctctgctatatattccataaactccaagaaacagcctttgattatctgtgatgctagaaaagagaaatgggatgtgtactcaaaatagcatattttacttgaaaggtagctttgtgcttacaaatataagtgagtctgaattgaaaatttaaaacacataataggtaaacctgtagagagagctttctcgttcttctgttctatactttatcaaatttctctcctgactcctttgttgagaactgtgtggaaaggatgttagccatcatctaatgcaagtctggttttatatgaagatttgtttactacattgtgctttcctcttagttgctgttagaaactttgcaagaggagctgaagctttttaacgaaacagccaaaaagcagatggaggagttacaggtgagaggcagacatcaccctgaccatttcctaccatgataggtagatttatagtggggtcttttctgtttttctatttatttttaataaactttctaaataattttagatttataggaaagttacaaagataatacagaaaatttaccctgatagtaacgtgtttttttttttccaacttttaagttcaggggtacacgtacagggtgtgtaggcttgttacacaggtaaacgtgtgccatggtggttagctgcacagatcatcccatcacctaggtattgagcccagcatccattagctattcttcttgatgcacttcctcctccacccccaatagtaacatcttacattatcctggtacatttgtcaaaactaagaaatcagccaggcatggtggctcacgcctataatcccagcactttgggaggctgaggtggaaggattacttgaagccaggagtttgagaccagcctgggaaacataaca

SEQ ID NO: 78798 - DNA, 2106 bp, Homo sapiens
gcctcccgggttcaagcgattttcttgcctcagtctcccaagtagctgggattacaggcatttgcgaccatgaccggctaatttttatatttttagtagagacagggtttcactgtgttggccaggctggtttcgaactcctgacctcaggtgatctgcccgcctaggcttcccaaagtgctgagattgcaggtgtgagccactgcacccggcaggaaaaaaattttttaaaaaacagaccaacatcagtacattactattaactatattccaagtcttcatttggattttagcagttttttccactaatttttttttttctgttaccgaggcttcttgcaaatgttcacatcaccaaggcatgaggcaatgtgtaacacagtaggttgctcagagttgggaattgagaactatatgtaatccattctatggaaacttgataactcaaggagaagacctgtagtaagcacagattctttggtctggactgtttcagattgcttggatgaatcatgggatattgcaccaaatgtagaggatttcatcgttccagtttagatacaggagtctagtccctctctactactagagggacaattcctaaaaccagtgcatagaaataaaatctaaaatagaagatacagtctgttgatactccagtggtcttccttagtggaataggagcataatgttctgatgtgggaattgtgtttcctgttagtcaagagttttgtgtatgtgttgttttcttttggaatgtctttccatgcaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacctacatgaaacaatacaccttggatcttttaatctaaattacttttcttttttaagtctacttttaaaataaatacttctgtaaatattctgactgtaacattgaggaatgaaaatagccttttaacctagatatgtcagttgatcattattgaactaatttagttaacaagtccaagatattctgacttaatctagaatatttttctgctactctttaagagtcctgtggctagtccctctgtctcccaagagcattggctagtctcctgagggtgttgcccatttgtagcagtggtttcaccaggtctgtggccacttgctgcccatgttttccctgcactctttttttttttttttttctgagacacagtctcactctgttgcctaggctggagtgcagtggcgtgatctcggctcactgcaacctccacctcccaggtttaagcagttctcctgcctcagcctcccaagtagctgggactacaggggcatgtcaccacgccttgctaatttttagtatttttagtagagacagggtttcaccatgttagccaggatggtctcgatctactgacctcatgatccgcccgcctcgacctcccaaagtgctggggttacaggtgtgagccactgcacccggcc

SEQ ID NO: 78799 - DNA, 1046 bp, Homo sapiens
ggaagcagagcaggagttccaatgaaaagttaggagtttgggtttgtttttagaaatgagagaactgagcagattttttggtcagaaggaaaaaaaagggaagaaaaaagaaaatagagggagaaattgaaaagtgtgggaatgagtgggcagaacacaatggtgagctggggcagaagagagaaggatgggttacaggtgatggtgcaggaaccacttgcctaacgatcatgaggaggaagccaggggccctgtgaaggctggggccacgagtgggggagttggcaagagtttcatgagcgagtattgtaaaggtttgcggtaccctccatagagagggggaaagtagctgtctagggttggagcagtagggacctggctgagattggaaatctcaaggttgcgtgatgccaccctcattacaggctgaaggcagcatgtgccagcactttgctggtcacttgccaaaacatgctgcaacccagtagtccaggtcaaagtacagagggctcagttcagccctagtgggatccctttgggtacagacaggagaacaacagaggataagggaattgaccgggctggtgacagtgtcttggaagtaatgtcccctgggggagggaaataaggccaggggggtcgggagggctcagggaactgagcatatcattgagaaagaagtgtccccatgagaactggggagaacacaagctagtggcagaggaggctgggatcaatctggggcgttagcaccggaaggtcccggggggagcatgggactaggatgctgccatgctgtgcaggtacagggactcaataggaaggtgagtgccttcttcccagaggcctttcctttaccaggcccccttggggctaatctgtaaccaggaccaccttttgtttcctgtaaagggtatgcctggctttagcacctctaagaagctggacaagctggggatgaggggctctaacacctgtgagctaatctttgaagactgcaagattcctggtaagtagcaccgggaatcggggagcccctctcctga

SEQ ID NO: 78800 - DNA, 1026 bp, Homo sapiens
gggccatgagaataagggtgtctacgtgctgatgagtgggctggacctggagcggctggtgctggccggggggcctcttgggtaagtgtgagaggcttgagggaagctgggctctgtcggcctcctcggcaggtgacccaccatgagcagcagcagccttccccttgcggggccaaagggagctgcctcttggccctgctctctcctgggagatgaaaggaacctcctcttcccatgttgaatttcttcccacagtggggaaatatcattaagtaacagacaaaaggcctgaggagcagggtggcttactcggctgtgaaacgacacctgggctgtcacgcccctgcacctctggccagtcagtgccgtaactgtggcaagactttctgaagttgcttttctcctccctgggattctggccttcccacgctagcattttgccaccacacccggtggtgggatgaggaggtgcccacggggcctttctcctttctgacaggctcatgcaagcggtcctggaccacaccattccctacctgcacgtgagggaagcctttggccagaagatcggccacttccaggtgagccgagtgcttttgctgacatgtactcttcaactgggctaaagttttctttgaaaagagaggaagtgaggtgggcaccgtggatggttactgtctcctctagcaaattgagcttgactgcttggaatgcagtcttcctcagcatgcagcctgactctggaagtcatcaggaagttcaccacattgccacctcgattcctgtgtgaggtggatgaactagacattgtaaggttggagagcaaagcgtgcaagttgtgggggcagaagggaaagaggttgctatttgtagttagaccttctggtccgaagaagctgctggaaggtaataagcattggagtaaatggtgccttgggagccatgcctttcggaggcagtgatggccacttcggggtgtcatgcgggctgtggaacagccactctgtggccctaactcccacacct

SEQ ID NO: 78801 - DNA, 1050 bp, Homo sapiens
tccaatcagctgtcctgatatcagagtgcctgtgttcaagtaactcttattttgctcagtggccccagattgcaagagtagtgatgctggcatgtcataatagttctattttagtatttgttattattgttgatctgttactatgcctagctcataaattaaactttctcataagtatgtatgtatagggaaaaaaacaacatatatatggggttcggtactatctacggtttcaggcatccactggggtcttggaatgtatcctccaaggataaggaaggactagtgtattccccacacccctccctcttgctaccttttgctgcttttctttaatcaccctctcctcctgtggcctgtttctatatacttggcattctgtttgctttctttgttttgtcaatcacttcctttcttctctgcccaaaccctggttgcaggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttcccaccctgcccacagcaggccctcctgcccagctgctcttgtcagccctctggcctctggatgaggttgagttctccacaacagctcccaagcatcatgggcctcgcagccgggcctgtgccacggctagtgttgtgtgatttaaaatggactcagcaggaagcatattgtctggggattgttgggacaggttttggtgactctgtgcccttgctctctaacttctgagcccacctcccagggtaggcacctgggggcatgcaggtgcccacctcccagggtaggcacctgggggcatgcaggtacccacctctttctcttgggtgaggctctggcaaggagatctctctgctcaagcacagcagaatcatggcccctctccatgaattggaacttggtacaggt

SEQ ID NO: 78802 - DNA, 1211 bp, Homo sapiens
gttgcccaaatagcatttccctctttggtagggctcttacctggcaggagactcatgccagtcggatctggtgttaaggagggtttgctccggagagtttagccagtgattaggttctttttgatatctccctctctttcttcctttctgttgtcctgctgtccccgtgtcaggcctgtgttgttgttatagcctccctttccctcctgcttcctttggcccttctgatccagtctgtatgcagctaccaggtcattcttcctaaaacaccccttcccggtgtcactccctttctcacagacttgcaatggctccccgttccctgcagtctgaccctagacagtgtcccctccagctcttccctagccataccatgcacattttttcttcctgcatcttcactgctgccgctccccttcctttactcccacttgaatcccacttgtccttagtctggttgttgctcagaccactccaggccaacatagtcatccccgcctgagctcatgactctggattttctaacgtggtatcctcttgagtggttttgtaggttggaaatttcttaaggacaggaacaatatgagtgttaaacctctgtgtgtgtgtgtgtgtgtgtgaatattctggtatttcttgtacagtgctgtgcacatcatttttgttgagtgaataaatgtggttggttgctgagttaggcaggaacaagggggagaccttcctttcagcttctccagaaatgctcatattggagtccttggagatttccagccctttctgtcaaaggcatatggatagggcatgtttggggtgctgtaaatgggaaatttaactgctgtttctaatatttctgctggtgaagagtcctatggattgcttatgtgataccatatagacattggaaaagggctgtaatcctgttttcctcctacctcaccggaccaccattctttctacccagctttgctgctcttatgcagttttccttgttgttcatgctaaatgaatccatgttttatctcttctcaaaccgggtgcaaatgagggagaaaacacaattctgagcacagaaaagaaaaatactcctgggtctggcccatagatgggacttttggggctggtttggaagaggtgtttatgggggcatcaccaacataagaggcacaatcagccccacattggacccctcataaaggaaagctacaatccct

SEQ ID NO: 78803 - DNA, 1052 bp, Homo sapiens
cgagcttcttgtttcttcatctgacttcaaagcatgactcacacatgctctccccagaatggagtgcagcgagaggcaggcagcagagaccccagcctctccttaagatgccgagtggctggactttgcaccacaggaaagctaggagctattttgcgacgtgcttttgatggccttgggtgtttttagcgagtgacaggggatttggcagattttagggagtctagcaggaggctgttctgctggatttggaaatgtgactcgcaccctgtgattcagacgcttcctgggatcgtcagcaccctaccccccaggggagtagtgggtgtccctgagggactggaaagctgaatgagaggttaaagagcaagattagtccacagggaacagattctcaaaggttctgggctcagactcctgaaagtggaagctgtgtagtcaaggcactgactcccttcccacctctctctgcttgggacttctgtgtgttgagaggggaagactgagtggggacaactatccaaagatctgaggaccatctgcccatgcagccagtctcccagccagctggaggtcaggggtggccaatcatccccctgctaagaacgcttccagtagccaggcctgacagcacctccctgtgctgtctttcccagccgccttctccttactctgtactgtgtccttatcctcaaagacgacaagcccaggtgatctccaccttggctcccagccgttcccaggcctagcccctctggtaacttggggcctgttgaggggctttggcccgtgctcaaatgcatggtctgttcacttatccatcatctccaggccatttgggagttggggagggctggacctgggctccctaggagatactgatgtgcttctgctgcttctcgttgcatgctcctccacctccagcacaggggtgcctggatatgagagaagggcctgtgggttataagaaatgggatgatgttgttgttgttgttgttgttttgagatggagtctcactctgttgcccaggctggagtgcagtggcacgatc

SEQ ID NO: 78804 - DNA, 1046 bp, Homo sapiens
gctgcaggcccacctggctggcaaggctgccctgatgaaccatggccatctgcaactccttgtgggccatccgtccagccatctcatcagcccctgagcaaggctctggagagccctttggggctgcgccctcacctgcccctgctgatgggtggacaggcggctctgaagccggagcctgggcgcccaggcgaggagtcacctgcccctaagcaggaactgcatcagccctctttccccacacctcagctgtcgccgctgccgatgcctggcaaccccgccgactacaatggcctgtgtgttgggcctgagctcactgcactaggcagcttctacctgtactgtggccaagaggggctgcagtgtgggggctactcgccctgccccatgcttcctgagggcaagctgtccccagtggctgcacctcacgaggaggggctcctcttagctccgagctcagtgccctcaggcacccctttccagcaccctccctggggctcctctcgctactgctctagcgaggacactggagtgaatggctacagcatctgcggagtgttgcccctgtctgttacccacgctggcactacctgtggcggctgcccatacaaaatgccttttgcagcaggtgaggcttcctgggcccaagatgtactggggagtctcggagacatggcatcccaggaggttgggctgttgatctgagcaggggtctcccttggggtctggctgctaactggaaggtagggggctttcagaagtgagaactcccgtagtctgtgccccaagccgaggagcattcccaagaacagggcccgtatagctctggacagccttgctctgcccaggctacctttggagattcttggcctggcagttaggtagcattgcagtggtacaggccacaggaaggcctctcttctctcctcattgggatacccgttcttagactctgaagagcaggttagatattggaattaggacttttaccaaattgttctcacggcccttctaccctccttgaggaaagctagaattccctagtt

SEQ ID NO: 78805 - DNA, 1030 bp, Homo sapiens
tgaggcttagcaatactttaaataatttgtcaaaggctgtgccccttataacagtggtttaagggttcagaccgagacttgttccattaggaagcatgagcacttacccagcactgggggtcttggagtgagagtcagctgtcgggtatggtggtcagagctcagccccagaagcttcaggccacttttccacccctattcccttttctcatcctttctccaaccatgagaattccccagccccatccaaaaaaggatagtggtttgacaaaaccaaggtagtggtttgactatcttgaggaaatcgtggaaaggatgtcattccctctctctgtccttactctgagtgtggctctgcaagcctatttgtgtcattggtttgttgcctaggatgagccggagccagccatccgaaagagctaccaggcggtagagcggcatggggagacaatccgagtccgggacaccgtccttctcaaatcaggcccacgaaagacctccacaccttatgtggccaagatctctgccctctgggagaaccccgagtcaggtacctctccctctggctggggacccaaggggcagctgccttcagcagaactgtagtccccagattggcccctgcctggagtttgacctggcgtgagtctccccgtgttcctggcacagagtctgccttccactcggctggggtctctctgctgccgagggctgtgggtgaccttgtggcttgggttggatcagctcattaacctttccagccagcagagcctgggcacctgtccccccacctcacctgtcagtgccttctcccccttctccctccatgcctaacagcattccaggcctctgaatgcttggcctggggcaggggacatgggttgccggagcctgcaggattgaggttggatgaacctccagggcagccagccagcctctctgcctgtctaagtaactcaggttgccagttcaagccataaccactgtgttgtccttccaggagagctgatgatgagcctcctgtggtatt

SEQ ID NO: 78806 - DNA, 1043 bp, Homo sapiens
atgtttgcggtgatcgtggcctccagcgggctgctgctcatgatcgagcggggcatcctggccgagatgaagcccctgcccctgcacccgcccggccgcgagggcacagcctggcgcgggaaagcccccaagcctgggggcctgtccctcagggctggggacgcggacttgcaagtgcggcaggacgtccggaacaggaccctgcgggcggtgtgcggacagccaggcatgccccgggacccctgggacttgccggtggggcagcggcgcaccctgctgcgccacatcctcgtaagtgaccgttaccgcttcctctactgctacgtccccaaggtggcctgctctaactggaagcgggtgatgaaggtgctggcaggcgtcctggacagcgtggacgtccgcctcaagatggaccaccgcagtgacctggtgttcctggccgacctgcggcctgaggagattcgctaccgcctgcagcactactttaagttcctgtttgtgcgggagcccttggaacgcctcctctctgcctaccgcaacaagtttggcgagatccgagagtaccagcaacgctatggggctgagatagtgaggcggtacagggctggagcggggcccagccctgcaggcgacgatgtcacattccccgagttcctgagatacctggtggatgaggaccctgagcgcatgaatgagcattggatgcccgtgtaccacctgtgccagccttgtgccgtgcactatgactttgtgggctcctatgagaggctggaggctgatgcaaatcaggtgctggagtgggtacgggcaccacctcacgtccgatttccagctcgccaggcctggtaccggccagccagccccgaaagcctgcattaccacttgtgcagtgccccccgggccctgctgcaggatgtgctgcctaagtatatcctggacttctccctctttgcctacccactgcctaatgtcaccaaggaggcgtgtcagcagtgaccatgggtgtggggccagcagctggtggggactggtttcaacgccag

SEQ ID NO: 78807 - DNA, 1329 bp, Homo sapiens
taacaaaaagaattacaaaaaccagaggagcatttttaggtaaattaatcttcattcccacaagactagcgcaagattgggtttaaattttgcatagattttgatttttgttgttgttgttgtttgagacagggtcttgctctgtcaccaaggctggaatgcagaggcatgatcaccactctctgcagcctcaacctcctgagctcaagcaatcctcctacctcagccttccaagtagctggcaccacagacacacatcaccacacttggctaattttttttagagatggggtctatgttgctcaggctgctctcaaactcctgactcaagcgatccacccacctcggcttcctaaagattttgtgttttttttttaaatatgaaaagacatgttattattattattagtgcatacaccagattgcactgtctccaatggcaaatgaggcagagggtaatatttctctttaattccccaagaacctcaatatcatctgtcttctggaggttccggtttcttctgacatctgtgctaatgtccacgaagatgccaaccgtacttagcataaagaacattttgctaagttgttctattatgggttctcgctcaaggtgttcacttttttcttctctagttttcagcacttgaccatgtgtttcttcattattatacacaggatctggtcaagggataggttttgtgcgttcatatggaatgtctatagaaggatggtaacatactattgtcctggcatcaggtgtcaaagcaaattctactttgcaattgtagtcacctggaaaagaagagtacgtagatttatgacaaacataaggctccattttggattgaagataaatgtttccagatagttctctttgatatcacccgtcttactgctgctactgccatgtagcaagacacttatcaggtagtatgaaaaaagatgcttcaaagagaatctgcttctgggcacattaattttcatccctgcttcacagctgttcaccatgagcccatcatcttgtctccttatttttgcatagatcttaaattatttttacccagttgtaatcatggacaaatttgtagtctgctttttttcacttaacattagttataaactgttccatactgctgcatattctttgtaattataattttaatgatttataatttaattgttttacttgaatttgttttctttctttttttttttttttttttttttttgagagagaatctcactctgtcacccaggctggaatgcagtggcatgatcacagatcactgcagcctcgacttcccgggttcagttgatcctcccact

SEQ ID NO: 78808 - DNA, 1009 bp, Homo sapiens
cccgggaagtcgaggctgcagtgatctgtgatcatgccactgcattccagcctgggtgacagagtgagattctctctcaaaaaaaaaaaaaaaaaaaaaaaaagaaagaaaacaaattcaagtaaaacaattaaattataaatcattaaaattataattacaaagaatatgcagcagtatggaacagtttataactaatgttaagtgaaaaaaagcagactacaaatttgtccatgattacaactgggtaaaaataatttaagatctatgcaaaaataaggagacaagatgatgggctcatggtgaacagctgtgaagcagggatgaaaattaatgtgcccagaagcagattctctttgaagcatcttttttcatactacctgataagtgtcttgctacatggcagtagcagcagtaagacgggtgatatcaaagagaactatctggaaacatttatcttcaatccaaaatggagccttatgtttgtcataaatctacgtactcttcttttccaggtgactacaattgcaaagtagaatttgctttgacacctgatgccaggacaatagtatgttaccatccttctatagacattccatatgaacgcacaaaacctatcccttgaccagatcctgtgtataataatgaagaaacacatggtcaagtgctgaaaactagagaagaaaaaagtgaacaccttgagcgagaacccataatagaacaacttagcaaaatgttctttatgctaagtacggttggcatcttcgtggacattagcacagatgtcagaagaaaccggaacctccagaagacagatgatattgaggttcttggggaattaaagagaaatattaccctctgcctcatttgccattggagacagtgcaatctggtgtatgcactaataataataataacatgtcttttcatatttaaaaaaaaaacacaaaatctttaggaagccgaggtgggtggatcgcttgagtcaggagtttgagagcagcctgag

SEQ ID NO: 78809 - DNA, 1452 bp, Homo sapiens
ttgtatttttagtagagatgggattttgccatgtttcccaggctggtctcgaactgctggcctcaaatgatctgactgcctcggcttcccaaagtgttgggattacagtcgtgagccactgtgctcaaccttatgctgtattcttaaagccagttcttactcacttgagcttctgttttatagctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctaggtaagtttgacggctctagggaagcatattgaagttctgttacatcaaacttggtttcctattcttttgtgttgttgttattcctgtcacacgtatctgtcagatataattccaagggatgtttcaagccggctgttgggaagcagcccccttttccttgaacagatctttttttatttttatttttaattttttgagactttcactcttgttgcccaggctggagtgcagtggcgtgatcttagctcatggcaacctccacctcccgggttcaagcgattttcctgcctcagcctaccgagtagctgggattacaggcgcctggcacaatgcccggctaattttttgtatttttagtagagatggggtttcatttcaccatgttggctaggctggtctcgaatgcctgacctcaggtgatccacctgcctcggcatcccaaagtgctgggattacaggcatgagccgccgtgactacccgaacagctcttaaaacagtttttgtcacttcctgcctctgcccagttcatctaaattctgtgtttgatttcttggcattctgtagaaccctcttgcctactgttggttgcccgtatattcaaataactcaaaagtgttaaaccttatgccatcctgcaagaaaatgtgatggccccagggctacatgtggatttctgatgctggagtttgaaaaacttacataaatagattgattgttgagaatgggagcatattgacataagattcattctgcctcttgttagccattttattttaaaaatatttcctgaacacattttcagtaccctgtcctgcggccatagtataagtatctagagagattccaaacacaggaaagagattcaaattgtcccatgctaggggaaaaagaaatatcagtctagggcggtgaggggcagtctttagaattgtaatatccttttattgtggaacaaccatgagattcatccatgtttcacaaagccaaacctgggaataaggcttaccttggc

SEQ ID NO: 78810 - DNA, 1050 bp, Homo sapiens
acagtgggttttagtatattcgcagagtttagcaatctttattctggttgttagtttttgttttgtcttaaataaagctcctttcaagcgtttcttcagacccaagggactactcggaatttacacgacctactcctgtcatggcctttacacggagcaattccaagggtttcctttataaataacgtcgtatctccctaataggaagacgtctgagtaaggtcacttttggtgagacatttacagtctctcatctctaagctcactcaattcacctaatttaattcgagcagctcactcattcgctcacttatcgcagaccccgcctcgggactgggcctccctgattcgctggggccgagtgacgtcctcagatcgcgaccctgggagtggagtgggggcagcgtggttatgtggctggaccgccgcggatggctcagggttcttggacattggcgctacgaccttaggcgccctagctttaccaggacttggagtggcgataagggcccaatggcagaaacagtgtctacccaggttgggacagagggcgggctgagggcttcgcatcagcaaaacggtgacgctggtggcgacgcgaaggttgagctgtcccccgggcccccgaagccggctggccgggaagtggagccggccccagtaggcggggagcatccctcggctgcagccccaggcccgggcaagcataagaagcggcggggcgcaaccagggagcgtgtcgtgccgcccccgaagaagcggcggaccggggtgagcttcggagatgagcactttgcagaaaccagttattacttcgagggcggcctgcgtaaggtgcggccctattactttgacttccggacctactgcaaaggtcgctgggtgggccacagcttgctgcacgtcttcagtaccgagttccgagctcagcccctggcctactatgaggccgcggtccgggcgggccgcctgcaactcaacgagaagccggtgcaggacctcaacatcgtgctcaaggtggagtcctgatggggctggccagaagcgggc

SEQ ID NO: 78811 - DNA, 1029 bp, Homo sapiens
ggcatgtgccaccacgcctgctaatttttgtatttttagtagagacagagtttgaccatgttagccaggatggtcttgatctcgtgatccacccacctcagcctcccaaagtgctgggattagaggcgtgagccactgcgcccggctaaaaaattttaccttttaaatacctttattgtagagaaaatacaattagcaaagccaaaaaacattcataatctaaccacccagagataacacagttaacatttttgcatatgtccttccagtactttttcagtgccagctatctgcctgtgtctgtctgtatttttacaaaatgagatcacactctgcacactgctttttcagcccaagatgtgctttcaccatttttccatgtcagtgaggaacaggggaagctggatatgaagttgactgattacaggctgcggtccctaggctgacttattacctatgtctttgacaggacaatgatttcttgcggaacacagtgcacaggcatgagccaccagtcacagcagagcccattcgcctgctagctgagaacgaagatgtggtggttgtagacaagccttcctccattcccgttcacccctgtggccgcttccgacacaacacagttatcttcatcctaggcaaggagcaccaactcaaggagctacaccccttgcatcggcttgaccgccttacctcaggggtgcttatgtttgccaagacagctgcagtctctgagagaattcacgagcaggttcgggaccggcaggtgagtcaggcttttgtctcctacaggccacttcttgggctcacgaatgctctgtgtcaaaagggcatcatggagttccgaagtggtccttcatatttatctggccatccttcctaccttcctaccttaaggcaggtcaacacctaaagtgccaaatgcaggatatctcatatgtttccaaaaaaatctttagagatggcatacactgcctctcttagtagtttgctattttgaagctttaaaatgctgacaaggccaggctc

SEQ ID NO: 78812 - DNA, 1041 bp, Homo sapiens
aaatgttatttagttttcagttcactagacattcctagaagttgttgtagtattttcacacgatagagtacatctcagggaatgattttagaaaagaaaaacgttttgggtcggtgttgtagactcagagcagaatgcatggattcactatggaacctctccagaccctgtcatcactgtgttcccagagatggttctccagtgggagaacctaatggtaaggaacaaattgacttcacttctgtcattgcctgcctctcaaaaccagtctttgcaagtcttggagcctgaggtctgggtttttcttgcaagagttaagaaataaactttagatgtgtcaaaaaaaaaaaaaaaagccaaaccgaacaaacaaaaacaaagcattgatttcaattcttccttcagagctatgtcatataagggctgctgctgacacacacagcctgtctgggctgtggaccagtttattatttcataataaacattggccattgattcccagagaacctcattttcaaaagagggaattggtcctcttaaagctggccccagataatgaagacgcattgcctaacactccaatagtaaaagagctggaatatcttggtaagatatttatgcaacagtcctttgctgtggtcttccagaggttgaggtgtcctgcaatagttgaggatagtacttgcaaggaagaacgttggtgttggtagagaacggtttctttgagctgtggtttgttgaagaatttggggagttaatggagatctctgtagacgagagcatccatctcggtagacgagagcatccatccctgtagataagagcatcttgtccgagtcttgcagttgcagctgctccagtagatggcgcctctaactcttttcctgtcagcttcttacaagcttctctttccgtttctaattgaagtatttctttttctttcccttgacttttttttttttttttttttttttgagacggagtctcgctgtgtcgcccaggctggagtgcagtggaccgatcacgcctcaccgcagcctc

SEQ ID NO: 78813 - DNA, 1078 bp, Homo sapiens
tttgcgcgtgcgcatcacctaggcggttagatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcaggtaaagagaatgactctttcgttctgggcttcagggaaggcttcgggttttgtctgggcgccctgaagttcctgcggtgggaggtagggtacgctccctcagcctggcggcctccgttagcgccgggccgagtagacgcccctgccccgggccgggcacactgtgccctttttcccctcctcggcctgtacgttgtgccgcctcccgcttccctaacacttctccgcctgcacctcggcccctccggccacccggctcgggttgcttgtccgtcgctctcttggcgtcctcttccgccccgccctgccgtcctctgtcagggctcgcggactcttcttgcacccctgccgctcttccctagggacctctcggctgtttgtatttctcacttaagctttttttggctctaaatgaagtgacagcaatgagtgattttaaaattctcagctcttcgtggtttaaggtgtctgctcggagtgctggccgcacgtaacagatttttcgttttctgcaagtataataaccttaacaaatgaagtcaatattagtactgcgcaaattagtttttaaaaatcctcttctgttcattattcctcaggatttaagcccttattcttcacgtttatttaaatactcaagtttgagggaggaaaaagtattgccgattggaattttacagataggtttaataggcattaacagataaaggatgtggatgaagaccaaagcagaagcttattccagtctagatattaaaattgatgttttcacttccgtcgaatcctgtagatatttattgggttccttatcctgtgatagggccggggacagatgattcccaaacctagaggggtttacaaagggaaataactaatatacacaaataactagaatacaagacagaat

SEQ ID NO: 78814 - DNA, 1037 bp, Homo sapiens
tttttattttttagaagagatgaggttttgccatgttgcccaggctggtctcaaactcctggcctcaagtgatcctcctgcctcagcctcccaaagcgctgagattacaggcgtgagccactgtgcccagcccaaactgctttaagcacaaaatgtgttgggttatgatactaaaaaatccaacgaagggatggctttaggcacacttactgaccagagattctaaccatgacaccagtactaggatttccttttgctttttctactcttagtgcttcctctgggtaatctccagcagatagattctttccctataattactgtgatacatctagctcttttacttccaggcccaagtcctacgtgaagaatagtgtctttttcctgaaaacagaaaagactcagaattgaatcatgttagcttgattatcctgatatgggtcaagtcctcattcctgaacaaatcatcattgacaagagaatatcagattgttctagacagagctatgtgttttaccctagagttggtgtggcattcactcagaccatgtgggatgagagcgggtagaataattggagaggatgggcaggtagaagggaatagatgtcagatatttaaatctgccacacggtatagcattgagcagaatgaatttgaggagtttcagagtttttaatgaaaattttagctttctacctatgatataacttgaaataaactgattcttaatagatatgccagattttttttgaataattctaattgttaccctagatattgaaacccccaaggagtcctcttcaggacctcagaggtgggaatgaaagagttcaggtaagtcttttgtgcaaatactttatagatgactattttcagttatatttttaagtcaagaagtttattagctatttgaagaggaaatgtgtaagcatcccatgagtttccaaacacttgaatatactggcattcttgatttttcatttttcttcttttttctaggaatggcatctccctctcttacccaggttggagtgta

SEQ ID NO: 78815 - DNA, 1540 bp, Homo sapiens
tccccctgcctcagccttccaaagtgcttggattacaggcgtgagccactgtgcctagcctagaataatttttttttttttttgagacagagtcttgctctgttgcccaggcagtggtgcaatctcagctcgctgcaagctccgcctcccaggttcacaccattctcctgcctcagcctcccgagtagctgggactacaggtgcccgccaccatgcctggcttattttcttttttgtattttttagtagagacggggtttcaccatgttagccaggatggtctcgatctcctgccctcgtgatccacccacctcggcttcccaagaataatttttaatgacaaattatatgcaacatgctacaccattgattcaagcaaaccaacgtgttatgaaaccatcactgaggattttttatataatacatgttgtaaaatgcctttttaaaagtttgcttttgttctgatctcttatattttgctttcattatagttttcaattatagaacatacccgtgaaaggaaacatgcaaatgaccagacagtcattttttcagatgaaaaccagatggacctgacatcaagtcacactgtaatgattaccaaaggccttttagataatcccataagtgaaaagtccaccaagatagataccacatcatttctagctaatttaaagcttcacaccgaggactcaagaatgaaaaaagaagtaaatttttccgtggatcaaaacacttcttcagaaaataaaatagatttcaatgacttcataaaaagattgaaaacaggaaaatgtagtgcttttcctgatgtgcctgataaagaaaattttgagatacctatttattccaaggaaccgaacagtgcctcttctacacatcaaatgcatgtatctcttaaggaagatgaaaataacagtaatattactaggctctttagagaaaaagatgatgggatgaatttcacccagtgtcatacagccaatattcagacattgattcccacatccagtgagaccaactcacgggaatctaaaggtaatgatattacaatttatggcaatgactttatggacttgacatttaaccacactttgcagatcttacctgcaacaggtaatttttctgaaatagaaaatcaaactcagaatgccatggatgtaacaacaggttatggaactaaagcttcaggaaataaaacagtttttaagagtaaacaaaatactgcttttcaagacctttccataaactctgcagacaaaatacatattaccagaagtcatattatgggggcagaaactcacatagtctcacagacttgtaatcaggatgccagaatattagccatgaccccagaatctatatattctaatccatctattcaaggttgtaagactgttttctattctagttgtaatgatgccatggaaatgaccaaatgtctctcaaatatgagagaggagaaaaatttgctaaagcatgacagtaattatgctaaaatgtattgcaatccagatgctatgtcttctctcacagagaa

SEQ ID NO: 78816 - DNA, 4184 bp, Homo sapiens
tgaactcttatcaggtgaaaatatggatttgactgaaagtcacacaagtaacttaggaagtcaggttcctcttgcagcttataatctagcaccggagagtaccagtgaatctcactctcagagcaaaagctcttcagatgaatgtgaagaaattaccaaaagtcgtaatgaaccatttcagcgatcagacataatagccaaaaacagcttaaccgacacctggaacaaagacaaagattgggttttgaagattttgccctaccttgataaagattctcctcagtcagctgattgtaatcaggagatagcaacaagccataatatagtctactgtggtggagttcttgataaacaaataactaatagaaatacagtatcatgggaacaatctttgttttctaccacaaagccattattttcatcaggacagttctctatgaaaaatcatgatactgctataagtagtcatacagtgaaatctgtactaggccagaattctaaactggctgagccactgaggaaaagtttaagcaatcccacacctgactattgccatgacaagatgattatatgttcagaggaagagcaaaatatggatctaacaaagagccacactgtcgtcattggatttggtccttctgaactacaagaacttggtaaaactaatttagaacacactactggccagctaacaacaatgaacagacagatagctgtaaaagttgaaaaatgtggtaaaagtcccatagaaaaaagtggagtgcttaaatctaactgtattatggatgtgttagaggacgaaagtgtacagaaacctaaatttccaaaggaaaagcaaaatgtcaaaatttggggaaggaaaagtgttggtggaccaaaaattgataagactattgtattttcagaagacgataagaatgatatggatatcactaagagttatacaatagaaataaaccatagacctttattagagaaacgtgattgtcatttggtgccattggcaggaacttctgaaactattttatatacatgtaggcaggatgacatggagatcactagaagtcacacaactgccttagaatgtaaaactgtctcaccagatgaaataactactaggcctatggacaaaactgtagtgtttgtagataatcatgttgaactagaaatgacagagtcccatactgttttcattgactaccaagaaaaggaaagaacagacagacctaactttgaactatcccaaaggaaaagcctaggaacaccaacagtgatatgtactcctactgaggagagtgttttctttccaggaaatggtgaaagtgaccgtctagtagcaaatgacagccagctaacccctctggaggaatggtctaataataggggccctgtagaggtagctgataacatggaattgtctaaatcagccacttgcaaaaacatcaaagatgtacaaagtcctggatttctgaatgaacctctatcaagcaaaagtcagagaagaaaaagccttaagctaaaaaatgacaagaccattgtattttcagagaatcataaaaatgatatggatattacccagagttgtatggtggaaatagataacgaaagtgccctggaggataaagaggacttccatttggcaggggcttctaaaactattttgtattcatgtgggcaggatgacatggagatcactaggagtcacacaactgccttagaatgtaaaactctcctgccaaatgaaatagctattaggcccatggacaaaaccgtattgttcacagataattacagtgatctggaagtcaccgattcccatactgttttcattgactgtcaagccacagagaaaatacttgaagaaaaccctaaatttggaataggaaaaggaaaaaacttgggtgtttcctttcctaaggataatagctgtgttcaagaaatcgctgaaaaacaagcactggctgtaggaaacaaaatagttcttcacaccgagcaaaagcaacaactctttgctgctactaatagaactactaatgaaatcatcaaatttcatagtgctgctatggatgaaaaggtcatagggaaagttgtagaccaggcctgtacattggaaaaagcgcaagttgaaagctgtcagttaaataatagagatagaagaaatgtggactttacaagtagtcatgcaactgctgtttgtggatccagtgataattattcctgtttaccaaatgttatttcctgtactgataatttggagggtagtgccatgctcttatgtgataaagatgaggaaaaagccaattattgcccagtgcaaaatgatcttgcttatgcaaatgattttgccagtgaatattacttggaatctgagggacagcctctctctgctccttgtcctttgttagagaaggaagaagttattcaaaccagtaccaaaggacagttagactgtgttataacactgcacaaagatcaagatctgattaaggatccacgaaatctattggctaatcaaactttagtatatagtcaagatctgggggagatgactaaacttaattcaaagcgagtatcttttaagcttccaaaggatcaaatgaaagtctatgttgatgacatttatgttattcctcagcctcatttctcaaccgaccaacctccattacctaaaaaaggacagagtagtatcaataaagaagaagtaatactgtctaaagctggaaataagagtttaaatattatagaaaattcctctgcacccatatgtgaaaacaagcccaaaatactcaatagtgaggaatggtttgctgcagcctgtaaaaaagaactgaaggaaaatattcaaacaactaactataatacagctctagatttccacagtaactcagacgtaactaagcaagtcattcaaactcatgtcaatgctggagaagcaccagatcctgtaattacatctaatgttccatgttttcatagtatcaaaccaaatctgaataatttgaatggaaaaactggagagtttttagcctttcaaactgttcatctaccaccccttccagagcaattacttgaattaggaaataaggcacacaatgatatgcatatagtgcaagctacagaaatacataatattaacataatctccagcaatgctaaagatagtagagatgaggaaaataaaaagtctcataatggagctgaaaccacctctctaccgccaaagacagtttttaaagataaagtaaggagatgttctttgggaatctttttgcctagattgcccaacaagagaaattgtagtgtcactggtattgatgacctggaacagattccagcagacacaactgatataaatcacttagaaactcagccggtctctagcaaagattcaggcattggatctgttgcaggtaaactgaacctaagtccttctcaatatataaatgaggaaaatcttcctgtatatcctgatgagatcaattcttcagactctattaacatagaaactgaggaaaaggccttgattgagacataccaaaaagagatttcaccatatgaaaataaaatgggaaaaacttgcaatagccaaaaaagaacgtgggtacaagaagaagaagatattcataaggagaaaaaaatcagaaaaaatgagattaagtttagtgatacgacacaagatcgggaggtgagctctgtcttgaaccaaagaatgttcttgaattttgggttttgttttgttttcttaaattgtgggtattctcaaattttaatcttagtctcgggtaggcagaaaataattatttccacttagagggctggagaaatattcttatgtagaaccttcagaaattaattgactaacagctagacttcaaagcaatttaaagtgacaaatagtcacaaaaaaattaaatggaaaattgtacaaaaagtagccaaagttaaaattgtataatttcaaaaatttcaaaaggtatgtatactgtcacctctagtgatttgtcaatttggctttatataagaatctctagggaggttatatatagcttgaaaagtcatcttcagtgttgttatatttggggagtaaaaagctttttattttgccaactgcatgaagtaaagcttgactgaatttccttggctgacaaggatatgtagaagttgagagtccattttctttatta

SEQ ID NO: 78817 - DNA, 1050 bp, Homo sapiens
tattcagctaaagaagtcttggtcagctggggaggaaagtagtaaagcctggaaataagtttattgtctggactctagccagggccaccacatacagccaatattctagtctggttttctgcagtgtggttgccctgctgttggtggctagtagttgaataattggataggtgaacatttgatagcttacaggatctgattataacttagatatataatgagaaataatttgcatacacagtataatccatagagtaattttcaataaaattacttttaactctaattaaaggcttaagatgtttgttacttattctaattcttcactaagatatttcatatgaattatagattaattgtatgttagaagtagtatttctgttagtgtttgtcgtaagtatacagtgtatattttattctgatgatattccttaattgacaatttcagatttttgatcaccatactgaagaggatatagataaaagtgctaacagtgtattgataaaaaacctgagcaggaccccatctagttgcagcagctctctggattcaatcaaggctgatgggacctctctggacttcagcagtaagagcttcatgaaggctaaataatagcagccatctgcttacttaactaataataagtagttttcagttcaggaaatatttgaatgttgtatatgcctttttggggttataaaaagttgatcagtaaaataatatttagtttatttttaattcttagtttgtaatgcactgagaagtgacatactacagagaaatagagtgatttccttcatgggcttataattagtggagaaacactggagccttaaaactataatatactttgccctgctacatgactgtcttcccagaaagatcccaatgggtagcttcaggatcagaaacaatctgaatgataaccacaattaagttcacagtttagttttgacttgttcgtcaccagaatttgctttacttctagcttaccgcagtagtcaaatggaatcacagtttctcagagatactatttgtgaagagagctt

SEQ ID NO: 78818 - DNA, 1623 bp, Homo sapiens
gatagaaattgggaagatgggcacacaactcttttgggcctcagcctcattaccatgatagctgccagtagaatcctcttgcctcagctatagatagggaggagaaaggagcttaggtgtgcatccaggggctgatactctttctacttttcttataaagggaaagtagaaagagtattaggagaccaagaccaaacagaggagagcagaggggaaggataggaacagggaggatattggcagggtgaaggagggagaggatgctttaggaattgatccttgacaaattgatgttatgaatcttcccctttcctcccaggtcttgctgaagtcaggaggggtagtgataggaaaatatatctgggaacaaacctatcaaaatggaaagagttcagggtacttcgggaaagaagttgaaaatcccaaaataggaaaaggccaaagagatggattatatgtggaccatggaaaatgaggttcgtggctgtgggcatctgtttcaggattttttttttttttttgagatggagtttcgctttgtcatccaggctggagtgcagtggcacgatctcggctcactgcaacctccacctcctgggttcatgccattctcctgcctcagcctcccgagtagctgggactacaggcacctgccaccatgcccgactaattttttgtatttttttttagtagagacagggtttcactgtgttagccaggatggtctcgatctcctgacctcgtgatctgcccacctcagcctcccaaagtgctgggattacaggcttgagccaccatgcccggcctgtttcaggatttgttttttgagatggaatttcactcttcttgcccaggctggagtgcggtggcatgatctcagcttaccgcaacctccgcctcccaggttcaagcgattctcctgcctcagcctcccaagtagctaggattacaggcatacaccaccacgcctggctaattttgtatttttagtagaggcagggtttccccgtgttggtcaggctggtctcaaactcctgacctcagatgatccgcccgcctcagcttcccaaagtgctgggattataggtgtaagccaccacacccacctggggaatgtattcttgaggcagggggagagatgtgtgccagccctcatagacatgtacacacctcccatatatacgtacagttgcaggaactcagttggcggcactagcagaaggtgctattgtagaggcccatgaccccctgcatgctcatgtagtgactcaggccaaagcactagaactcacatctcctagtaagggtgaggatctgtttttgttttttgtatttttttgagacggagtctcgctctgtcacccaggctggagtgcacttcccgggttcaagtgattctccctgcttcagcctccccagtagctggggattgcaggcacctaccaccatgcctggctaatttttgtatttttagtagacatgggatttcgccatgttgaccaggctggtctcgaactcctgacctctggtgatctgcctgcctcggcctcccaaagtgctgggattacaggcgtgagccaccgcacccagctggttgagaaattattgcaagtgctcctgcta

SEQ ID NO: 78819 - DNA, 1130 bp, Homo sapiens
tttttaaataaccaaattttcactgccttattttataattggaggatgtgccagaaaagtttgagttcagcctgggatagagtaaggattatggctagaaaatgggaatagttactaggaaactggcttaaaaaaaaaaattaaaaaggggttcctggtaagttgaatttttaggtaatatttattttcttaacgcatagccattttcaaactactgtcattcccatgtgagtaagaacaaccacagttccagtaaaatctatggggaaagggacttagaagtcagagacttgaattcagattccaattttttgtttactggcattatgaacttgagtattcaaatttttctttgtagaacattttaaaataggcactctgaaatttgagttaattcttatatatggttttgtctgcaagataccagttctcagggactgaatttttttttccagtttactgtaaacacaccacctactccagaagacctgatgttaagtcaatatgtttaccgacccaagatacagatttatagagaagattgtgaggctcgtcgccaaaagattgaagagtatgaaagctttaatttttatgtgtgtttttttgaggggagggatcagttaatagtttgtgtggtaaggttttgattagaataatgctggcatggggtaaaattgatggcattaattggcagtgtgatgtgggagaaagagctttggcctcgtagtcagattgaagctcagtcttggcttcaacactagctgtgtaaccttgggtaagtcatttaaccttcatttccaaatccttaaagtgaggataataaaacctactcagccaatagatatgaacaatagaaatggcgtatataaattgttttcataccattcttaggaaaaggtaggtccttaataagaataaacagtaatttttagattatgatatcataagttgattgctagagaacaccttcaaaagaaaatatcctttagagatttacgcaagttgagtaaccttaatctggaaatcggaaatctgaaatgctccaaaatccaaaatgttttagccaccaacatgatgcaagtggaaaattccacacataaatacgtaagtactttacacaaactttgttt

SEQ ID NO: 78820 - DNA, 1762 bp, Homo sapiens
aatccacctcagcacagaccatttacgggtgtcgggctgggggacagtcaggtctttctcatcccacgaggccatatttcagactatcacatggggagaaaccttggacaataccccgctttcaagggcagaggtccctgcggctttccgcagtgcattgtgcccctggtttattgagactagagaatagcgatgacttttaccaagtatactgcttgtaaacattttgtcaacaaggcacgtcctgcacagccctagatcccttaaactttgatttcatacaacacatgtttttgtgagcttcaggttgggtcaaagtggctggggcaaagtggttggggcaaagctacaaattaacaacatctcagcaaaacagttgttcaaagtacaggtctttttccaaatggagtctcttacgtctttcctttctacatagacacagtaacagtctgatctctttcttttccctacagtgctaattaacttttccgtattttagattaaagctttctgcatcgaaccaagataagctgttggttgatataaataagaacctgtgggaaaaaatgagacactgctctgacaaagaggtacttttgtctcattttctgaatgagaatcagtgaagacattctgaacgatgtttattgtgaaatgagtaactgttacttggtcatagtgatgagttatttaacttattttttaagtgtaatgtggtaccaaggtcttatttaattacacacaattgttaatatataatcttttcaaacctgagatgatcaatttaatatatgaaatatagttgaagtttatttagagttccctccttgctatttgcctttcacttagatttagacgaagaaaagatttactttaattgattaaatagcaagcaacccattttatatgtgccctaatatattaaaaagtttcattaactaagagcctgtcattttctaatttataatatgaataagtgaattaaaggcaggaatcaaaactgaaatcttttttctggtcttagacaattacatggaattaaatttgcaaatgacaaatatcctgccttaggataggcaaagcctagccttcctagaccatttacctcttctgactcgtttgttttagtacagtgttctctataactttcccttccagctgaaggcctttggaatttatcttaacaaaataaagtcatgttttaccaagatgactaaagtcttcactcaccaaggaaaagtggctctgtatggcaagctggtgcagtcagctcaggtaatttgagacagttaatatcatagaaagagagagatattaaaattactttctaatggttatagaatatgaagaatcttccttagaagacatgtgaataagacttgggcaaaaacttaacaattaagaggtaaggttcaatttgtcaaaagtggcaaatcctgacatcttgagtaatactggaatataattactaatgtgggcctatgtctcatctcaaatactattatccatcatacatactgaaataaaatacataggattctggtctcccattgctaaggactataccatagtattatcttcttcatagtccatactaagctgtatatgtatgcacatgtgtttaaagtagcatttcccaaaatgattagcttttttaaaaggctctgcataaaaaaactttccattggcaagtaagtatgggaaatgttgcaagcaatatgccctttcagagaaacataattttttaaagtctaagcataaa

SEQ ID NO: 78821 - DNA, 2786 bp, Homo sapiens
ccaaagaaagtagtctcttttccttgagctctcatggctcttttgttagtacttcttatattacccatcacatctacttgtattatagttattttgtatagtttatcttcctgattaaattataagctctgtggaggcaggaatcagctcttctttttctccatctccttcagagtccctaggactatatttcatacagagtaagtgcctagtacatgttttttgcactgaattgaccatgagtacatgaattccatagtctaaagttcacccctttgttgactaccttactttctctttcacagaaaaaaaaaaaaaaatagaaaccatcagactagaacttctgaacttcctactaccaaagaaacaatctgtcgtttaataaattgtttttgattgaattattctttttttccttactttgttttctttttttactatttttcactgaattattctaacaaatactgtctactttagaaactaagaatttggaggatgaagagaaaaacaatcctgtggaagaatgggattctgaaatgagagctgcagaaaaaggtaattgaattagttaaggagataaatgggtgtgggggaagcccttctgttctgagtttgtttatatactttggtgagattaagtcagaattttcaataaaacagatttttgtggcaacattctaatatgtttgttctgttttttttttttttctgtttccaaagaattggaacagctgaaaactgaagaagaggagcttcaaaggtcagccttcaatccaagtgttagaaaatataatgctaaatcacagaaggctagatgacttcctgcctccagagactgacaggatttggggacatgagtcttgattgaggctgactcagggcttctccactttgaatggaaacctagagtccatcttagtcaacagtagttttgaagcacttattgtttacagggcatttatccacaacagtgtttctcaagcttgaatactaccagtatcctttttgtttaataaatgtaaatataaacaagtataaaatgaagtatatatttcttaggcctatgaatcttattcaactgtaagtgtaaaagaaagtaaatagaaataatgacaaagccactaaaattctagttgacaacattaatttgacaggtgatagtgtttggctgaaattaaattgatgctagcaaaatgattaacaaagatatgttctgtttagctctaacaactaaacgaaaccaaatacaggcaaaaaaaaaaaaactgtgacatgtctcagttttaaagtatatcttatgatctacattatgcttatatttttatatttttgctttttatcaaaaataaaaatgtagtatttaaaagttatcttaacatgtgaatcccaaggatatcttcatggatcctaatttgaaaaacaatgatttatgcctttcccaggtagacccacttctagattaatgcttatataaaaaaaaaaaaaaaaactaaactaagaatgcagaaatggatgccatacacctaacattattacctcaatggggagtcatgtagcatgtgacttcttatcataaaccttttatattgatagagtgaattctctaacaaaaaccttatctctctgaatacctgcttttatttgcagaaatctcttagaactggaggtacaaaaagagcagacccttgctcaaatagactttatgcaaaaacaaagaaatagaactgaagagctactggatcagttgaggtaaggaaatgcaggcatcatttgtttgtgttttattctgtaccttgtggttgtttaaaccgattggagcaattgatgtatttttaatgtgttgctgtttttaacctatacagtgctgtttcaaaaagagtcagtgtactcaacagtaagctggaaatagagtagaagaactatggaattataatttttccatattttatacttttcattgcgtagacttggtgtttctctgatatacaactcaagattgggttcttagttatttcaaaagcttaagtttgtacatccacaatatatgaattgaaatattttctcccagtccagtggaaaaacattagcagctgctgttggtactgtttgggtggtatcagaagttctcttttatgttaattttaaaaacgctttttaaaaatcttgtttatctctctacagcttgtctgagtgggatgtcgttgagtggagtgatgatcaagctgtattcacctttgtttatgacacgatacaactcaccatcacctttgaagagtcagttggtaaggagccaaagtgagataattcttttacagaaaaatgaatggctacactcactaaagattcaaatctttattttactatactgataactattggcatgatgagagcactgctgaaagtcttagaacagtcactttattgatagcagaattttattttattttgtaaagaataaaataaaaatggaattagtgaacgttgccctttgttgaattacattaaataaaaattttgctctgcaaataatggataaacatgctactcatgtctatttactatgagtttctttcttttcatctccatctttcgtgatagagaatagagaatttaccctaatggctggagattctttttttttttttttttctttttttacttaagagtgaggccctgcagctcacgcctgtactcccaacactttgggaggctgaggtgggcggatcatctgaggtcaggagttcgaaaccggcctggcccacatggtgagaccccatctctac

SEQ ID NO: 78822 - DNA, 1049 bp, Homo sapiens
tagatacagagaataatgattcaaggataacccttcaacttcctgtggaaaaaactctgctacacagaaggagtaggattctaaagtactgagttttatgtgacttcaaatcaggtagtttaaaaaaaaaaaaaaggccaggcacggtggctcatgcctgtaatcccagcactttgggaagctgaggtaggcggatcacgaggtcaggagatcgagaccatcctggctaacatggtgaaaccccgtgtctactaaaagtacaaaaaattagccaggtgtggtggcgggcgcctgtagtcccagctactcaggaggctgaggcaggagaatcgcttgaacctgggaggctgagcttgcagtgggccaagactgcgccattgcactccagcctgggagacaaagtgagactctctgtctaaaaaaatttttaaaaatcattattctggttctttctagttggtttccctttcctggacaagcgttataggaagattgttgatgtcaattttcaatctctgttagatggtaagtagaaaacatttaagcctctaaaaatttgttggggctgggcactatggctcatgcctttaatcccagcactttgggaggctgaggcgggtggatcaccaggggtcaggagtttgagaccagcctgactaacatggtgaaaccccgtctctgctaaaaatacaaaaactagccgggtgtgatggtgccctcctgtagccctagctactcaggaggctgagacaggagaatcacttgaacctgggaggtggaggttgtggtgagccaagattatgccactgcagtccagcctggcaacagagtgagaccttgtctcaaaaataaaaaataaggctgggcacggtggctcatgcttgtaatcccagcactttgggaggccgaggaaggcagatcacaaggtcagaggctcgagaccagcctggccaacatgatgaaacccatctctactaaaaatacagaaattagttgggcgcggtgatgggtgcctgtaatcccagctactcaggagtctgaggcaggag

SEQ ID NO: 78823 - DNA, 1002 bp, Homo sapiens
gcctgtaatcccagcactttgggaggccaaggcgggtggattacctgacatcaggagttcaagagcagtctgtccaaaatggtgaagccccctctctactaaaaatacaaaaagtagccgggtatggtggcagacgcctgtaatcccagctactcaggaggctgaggcaggagaattgcttgaactgggaaggcagaggttgcagtgagccaagatcacgccatggtactccagcctgggtgacagagggagacaggagactccagaaaaaaaaagaaaaagaaaaaatggagagaatacttatgtacctggtagtttgagaatatttctagcttatataatatagtatttttcacttatataaaatatatgaatcataagtaataacctgcttttgcttttttttttccttccccagaggatcaagctcctccttcctcccttttagttcataagcttattttccagtacgttgaagaaaaggaatcctggaagaagacatgtacaacccagcatcagttacccaaggtaaagcccgattgaagtatttaaaggaaaatttgtgatatctttccaaaaaaagcagaactgaaactttacataaataatagtggatcctgaaatgataaatgtattcaattgtttaacttttttgagttctttgtaagtgagccactaagcattgaaatgttttcataatttcactggattttttttcccactttttctagatgcttgaagaattctcactggtagtgcaccattgcagactccttggagaggagattgagtatttaaagagatggggaccaaattataacctaatgaacatagatattaataataatgagtaagtgtattagttcccaaggactgccatgacagagtactacaaattgggtaccttaacaggttctggaggctggaggtctgagattaaggtgtaagcgggtgttattctttctgagggctgttagaatctgtccatgccttctcccagtg

SEQ ID NO: 78824 - DNA, 1043 bp, Homo sapiens
aaagaaaagaaataatgtatgcctaacttggacatgccagcgtaaaaataaaatgaaattgtgctgggacagtggctcactcctgtaatcccaacactttgggtggtgaggcaggcggatcacctgaggtcaggagtttgaggccacattggcgaaaccctgtctctactaaaaatacaaaatttagctggatgtggtggcaggcacctgtaatcccagctacttgggagaatcgatagaacttgggaggtggaggttgcagtgagccgaaattgtgcactgcactccagcctgggcgatagagcaagactccgtctcaaaaaaaaaaaaaaagaaattgtgtttcatgctattatttgttgcatttttaattgtggatcttgtcttttacagattgagacttttattctctagctccgcagcatttgcaaagtttgaaataactttgtttctctcagcctattatccatctgtaccattaccttccaccattcagaatcacgttgggaacactaggtgagtaaagggccaacagggtaagactctgggctacttctttttttttgagatggagtctggctctgttgcccaggctggagtgtagtggcgcaatctcggctcactgcaacctctgcctcccgggttcacgccattctcctgcctcagcctcctgagtagctgggactacaggcgcctgccaccgcacccggctaattttttgtatttttagtagagacggggtttcaccatggtctcgatctcctgacctcgtggtccgcccacctcggcctcccaaagtgctggaattacaggcttgagccaccgcgcccagcaaggactactttttaatgttcattttatttgaaagattcctcaaagtggtcagcaaattagtggaccatagtgagagctaaacttcagttctcttgagttcattttgaagaatttatgtgtgtgtgtgtgtgtgtgtgtgtgtgtgtgtttgagatggagtctcactctgtcaccaggctggagtgcagtggcacgatctcggctcactg

SEQ ID NO: 78825 - DNA, 1049 bp, Homo sapiens
agaattggttcttaggccctgttttggaatcccatttcaaactggatatctggttatttccagaaatgctcatttgtgcttcctaggaaactgagagaccaagaacataaattccactgaattagagacaagtgtaagattttttaaaaaattgattaacctggctgggcgcggtggctcacgcctgtaatcccagcactttgggaggccgaggtgggtggatcacaaggccaggagatcgagaccatcctgagtaacacagtgaaaccccatctctactaaaaatacaaaaattagccgggcgtggtggcaggcgcctgtagtcccagctactcgggaggctgaggcaggagaatggcatgaacccgggaggtggagcttgcagtgagcggattgcgccactgcactccagcctgggcgacagagcgagactccgtcgcaaaaaagaaaattgattaacctttgttctttccagccaagatgatattgctaccattctatctaaagtgccactggagaacaactacctgaagaatgtagtcaagcaaatttaccaagatctgtttcaggactgccatttctaccactagacccttggaccaccattggaacaaccaagcagaatgtacttgatattatttcagggtcccattgctgttcagcctttgtttttacgtcattacaagctgagtaaaattccttctgatgatgttatagttaatctgtatgttttttatatctctgcagaatgatggtgatgaagtctggatggtaggcctcatagcctactatcaacttactcatctttgtaccaaaggtttaagtaataggacacttaggaaaaatgtctcctaactaaactagtgctttctgctttagtacaagccctaaggattaacttaagtataagaagtgttatcactgacaagaacattagccattttcccataactagatagagctatgattttttaggttgcctggcttctgcctagcagatatttctggagtagaaatgtatctgtctacaaactattatcctttttctc

SEQ ID NO: 78826 - DNA, 2126 bp, Homo sapiens
agccaccgcacctggccctcaaagaataggtttgatttaggtcaggcgtggtggctcacgcctgtagtcccagtattttgggaggccaaggtgggcggattatgagatcaggaggtcaagaccagcctgatcaatatggtgaaaccctgtctctactaaaaataaaaatattagctatgcatggtgctgcatagctccatgctactttggaggctgaggcaggagaatcgcgtgaacccaggaggtggaggttgcaatgagatcacgccgctgcactccagcctgggtgacagagcaagactccgtctcaaagaaaaaaaaaaaagaatggatttgatttatcccaaagacttgccaggtagagctccagagtagttgggtgctatcatctctctgcttatagtttgcctgaacttcttaatagaaagggaaatacattctttggtcctgaaactactgtcagtaccacttcttccctacctattcaggtaatttaagtgtcagaaacaaattgctcatctgcctgagttctgtgtgcagcctaaaaatgttctctcctctctcataggtatggtctctctggcagtgatgtcctggataatgtagcatatgctcgagcgttcaacacagaccaccagacccagctcctttatcaagcatcagccatgatggtagaatctaggtatgtgttcagtataagacaccaaatatgttcttaagagtccttccctgaatcttgtaatggctatttggccagattgatagtagtttgaattagaaatgaggaggtttaagtataattcctgtgttgacactcttgctttgtagtttaggtcaagtcactattaaaaatgaaaccataatctacttgaacttgctggaaatcttgttaaacggtgcctcagatgttagtactgtgcaaatattttaataaaacatctatatacaggccgggcgcggtggctcaagcctgtaatcccagcactttgggaggccaaggcgggtggatcacaaggtcaggagatcgagaacatcctggctaacacggtgaatccgtctctactaaaaaaatacaaaaaaattagctgggtgtggtggcgggcgcctgtagtcccagctactccggaggctgaagcaggagaatggagtgaacccgggaggcagagcttgcagtgagccaagaatgccccactgcactccagcctgggcgacagagctagactccatctcaaaaaaaaaaaaaaaaaaaaaaaaatctgtatacaggaaaaactatgaatatgagattttagggtggtaaggaagggaccagaatctgacacaggctagaaataggcttcagagaatccttgtttcctgtaggtatgcactgcttattgtagacagtgccaccgccctttacagaacagactactcgggtcgaggtgagctttcagccaggcagatgcacttggccaggtttctgcggatgcttctgcgactcgctgatgaggtaagttgtgggatagggacagagaatgcctactttcagtggctgtgaattccaggagccttgctaggaggctaagacatcagtgcctgagatcatcaagctcttaggaagaagagagacattagttattcgttattttgtgggggaaagtggtggcagcattaaggcttttggagtgtctatggccacaaaattgacatttatcctttccccatcagtttggtgtagcagtggtaatcactaatcaggtggtagctcaagtggatggagcagcgatgtttgctgctgatcccaaaaaacctattggaggaaatatcatcgcccatgcatcaacaaccaggtaaggtgttgatgggatcagttcttcttttcggaatgtcatattaactgtgaagacatgaagatataacattttcatttaagccctgttaaagctactgttgtatagacacttaggaactcttgctaatctaattaacatgctctcgttggtatagatgttttagttcataaaagaattaaaaacccacaagtgtggaagaatgaatatgagtaattgatatgcctctcccctgttatttaaaaaatgtttgggctgggcacagtggctcacactggtaatcccaacactttg

SEQ ID NO: 78827 - DNA, 1650 bp, Homo sapiens
gagttcgagacagcctgaccaacatggagaaaccccatctctactaaaattacaaaattagttgggcctagtggcgcacgcctataattccagctactcgggaagctgaggctggagaatcgcttgaatccgggaggtggaggttgcagtgagctcagatcgtgccattgcactccagcctcggcaacaagagcaaaactccatctcaaaaaaaaaccaaacaaaactgcctgtcatcactgaatcatcatgtgacatttttagaaaataatctttcctagaggtcttatttccctagtaaaaaagagtctacctctaggggaagagacagatttaataggctccaggctatcctggggaagtaggaaaaagactgtagcagagctcaggaaggaagcaaagggcccctcttcttaggttccactggtttgggaaaatgctggtttaaattttgagccctagatttgttctttgtctccctaggatttggctatccagaaggacctggaagaactggaagtcattttacgagactaaccacgtttcactggccttcatgacttgatgccactatttaaggtgggggggcggggaggcttttttccttagaccttgctgagatcaggaaaccacacaaatctgtctcctgggtctgactgctacccactaccactccccattagttaatttattctaacctctaacctaatctagaattggggcagtactcatggcttccgtttctgttgttctctcccttgagtaatctcttaaaaaaatcaagattcacacctgccccaggattacacatgggtagagcctgcaagacctgagaccttccaattgctggtgaggtggatgaacttcaaagctataggaacaaagcacataacttgtcactttaatctttttcactgactaataggactcagtacatatagtcttaagatcataccttacctaccaaggtaaaaagagggatcagagtggcccacagacattgctttcttatcacctatcatgtgaattctacctgtattcctgggctggaccacttgataacttccagtgtcctggcagcttttggaatgacagcagtggtatggggtttatgatgctataaaacaatgtctgaaaagttgcctagaatatattttgttacaaacttgaaataaaccaaatttgatgttatcagctctttattcttacttgacacctccataattgtttctacctacagaggctgttgcaggcaggttatggttaatgctctttacagtatataaaatacaggtatcgagcttatttttagcctaaacaaggcctattgcaactaagcaggtactccctgcctttctcatgttcatttttagggccacgagcacaaacccctaaatccacctagaagaaaatttaagactgagatgcataggccgagcgtggtagctcatgcttgttgcttgtaatcctagcactctgggaggccaaggcgggtggatcacttgaggccaagggtttgagaccagcctggccaacatggtgaaacccccatctctactaaaaatacagacagaaaaaattagctcggtatggtggcgcacgcctgtaatctcagctactagagaggctacagcaagagaatcacttgag

SEQ ID NO: 78828 - DNA, 1393 bp, Homo sapiens
ttgcctgccacctgcccctctcatacctttaggaagctctggagggcatcttccacagtggcactgagagggctttcaagcaaggctgtagcagtttttttttctagccagctcaggtgagagacctgccacaaaaagatcaaggtgtgtataagaggttttaaaaggttttttttctttaaatctttggggatatattgaaaatagggtcaaacggggctgggtcgaaccaccaataatacgagcattcagaagaaagggcacctgagccagagaaggctgaggatcttgttcttcctggcaaggaaatcggtgtcagaaggcatttaggaccattatgtcaagcactgaaacgcagcttacctgatagcaccacctgccaagaagaaagtgagccatggggttttctggctggagagcaatggctttgtccacatgctcctaaggggaaaatgtaaatataaactaacatcagacaccagagttgctaaaagagaggcaagggccggatgcagtggctcatgcctgtaatccctgcactttgggaagctgaggcaggtggatcacctgaggtcaggagttcgaaaccagtcctggccaacatggtgaaaccccatctgtgctaaagatacaaaaattagccgggcatggtggtacatgcctgtaatcccagctacttgggaggctgaggcaggagaatcgcttgaacccaggaggttgcagtgagccaagatcacaccactgcactccagcttgggcgatagagtgagactctgtctcaaaaaaaaagaagaaaggcaagtcactgaggctgtagaaaagtttttggcagggagctggaaaggagtggggaatctgggataggccagcacaaggaaggaggaaaagcctgtcctcaccttgaagctaaagccactctggatgcgcctctggatgctctcatgctcagccagctgaccacaaagcaccgcatacctaggggggaagcagcaagctcagggacaagggctgagtaccatcactgcaaggaatggatgccccaaccacagcctagttgcattgtcccctatccctgtaccctcaactagagctgaaaatacctaattttcatctgtacgtaatccccattctttacggacctctggccccaattagtattctttagtagataatggtaggcttacaagtctccaaagtattctaggtataaaaaaagctgggttcaccacagtaaatctctcttacacagtaaatctctcctacactcataaggagtacagccacaggcattaataaaaacttgaaaagcatgaaaacaatcagcataaaagtatgagacctgactatactacttatcttctgggcagacaaaaaagtgggtctcattagcctt

SEQ ID NO: 78829 - DNA, 1052 bp, Homo sapiens
tgtgtgtggctgcccatggcctgaggctgcacccacccatgttggttgtggcaagtgtctctgactgataaggcaaaaacgagcagggacttctcacatttgccttaactgtcacagggcctcagctggttgtctgctctttccttcctggatcattttcccagcccttagttcccataggaaactttctctcaaataatgatttctgctgggcatggtggctcatgcctgtaatcccagcactttgggaggccgaggtgggcggatcacttgaggccaggggtttgagaccagtctgggcaacatggcaaaaccccgtctctactaaaaatacaaaaaaattaggtgggagaattgcttgaccccaggaggtggaggtttgagtgagccaagatcgaaccactgcactccagtctgggtgacagagcgggaccctgtctcaaaaaaaaaaaaaaaaaagaaaaaaagtctgcccttaagaggtatgaatgattgtgatttggtgctttggacaatgccatgtagagtgcttctttgggggtgagggatagacagaccctaggggctctgagctgaataatcctcttgttgtcccttacatttctctgccagttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtggtgaggctccagctgcctgtctccttctccttccctccctccctccatctctctgttcctgacccctggggaatgaaggcccgtgtggttactgcccctacaaggtgacatgggacgagaaatggtgagacagctggttttgcatctgtcccccagg

SEQ ID NO: 78830 - DNA, 1194 bp, Homo sapiens
gagaaactccaagttttccctactattatttgtgaagtgagagatcagaatttgagggagctcagttttagttttagttttgctatgtggttggtattgactccttggtattgggcactatatggtgaggtgaaggtttttgtttttttttaactctagcaggacagctgtcctccttcaggttccacacttgggcaagcatgttacattatctatcgtggtgtgcagcattcctgaagggccctggtatggaaggttcttggagcagagggctctcgtttagagatccctgggtagtttcttgagacttgttaccatgacctggctgtgaacgtgtgctatctgagcgtcactgggccttctcttccaatggaaagcaggtattcttgaattctgggtgtgagatctcttccccaccatattcctgtgtgtcactggctcccattcgtttcccccttcagtgatgctcctgcgggctgtcccaggtggggctggagatgcctcagtgctgcccagccttccacgggaaggacaggagaaggtgctggaccgcctggactttgtgctgaccagccttgtggcgctgcggcgggaggtggaggagctgagaagcagcctgcgagggcttgcgggggagattgttggggaggtccggtgagtaatgcggcttcttctcctgctttatccctcccctgcagcttttcagctggggtgtgttctggccttcgctgtctgtctctaaagaataaaccagttctatagcttctagcctaatctgggttgaagctgtacatttggtacctcgccttgcacatgctccttgctgcttctggactctcatggttgatctgttgtagcagctgaagcgctctgtttgcctaacctagtctgtctgtgcgggctgggcccaggaagctgccctgcttgccctcctgagggttagagacttaggattttctctgcttttagccctttaatgaggagcagtagtaagaggcaccccatggtgagcagaaagacaagctggatgggacctaatggtacccttcgggatggggcctgctttccagatgccacatggaagagaaccagagagtggctcggcggcgaaggtttccgtttgtccgggagaggagtgactccactggctccagctctgtctacttcacggcctcctcgggagccacgttcaca

SEQ ID NO: 78831 - DNA, 1006 bp, Homo sapiens
ggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgggggttgaaggcccagaagccggactctgtgacccgggtcggggggtgtactggaggggcggctacgtccaggctgggtgagaagagaggcagtggggcccaggaggctggaggaagccttagggttcagactggggtgcacgtagtcgagagctcagggtttgggcaaggggatacctgccggggttcagccttgagggtgggtttaccgggttcacgaatctctctctctccttacccccgcccgcccgcccgcctgcctgctcccggtgacttctgctggccgcaggtgcagcatgtctagactgggagccctgggtggtgcccgtgccgggctgggactgttgctgggtaccgccgccggccttggattcctgtgcctcctttacagccagcgatggaaacggacccagcgtcatggccgcagccagagcctgcccaactccctggactatacgcagacttcagatcccggacgccacggtaggagcccgtctcctgagaccgcggtcactgcagactaatgggcctgaggtctgggctgctttcggtggagactgtgggacagggtaacggagagaagtgctttagggtttcacttttttggaagcttgttgaaaaagcagtcgtcgggctgggcgcggtggctcacgcctgtaatcccagcactttgggaggccgaggcgggcggatcacctgaggtcaggagttcaagaccagcctggccaacgttcaaccagatgtcaacatggtgaaaccccatctctactaaaaatacaaaaattagccgggcgtggtggcgcggcctgtagtcccagctactggggaggctgaggcacgagaatcgcttgaacctggt

SEQ ID NO: 78832 - DNA, 1459 bp, Homo sapiens
cctcatgtgtaaaatgaaggtatgtatggaaaaacctacctcacagggaaatcaggaggagtaaacgagataatccaataagtgcttgggaacatacctgactcatagtgagtactcagtgaatattctctgcaatcatgatgttgataaggaggaagaagctatttagtaaaaccagccacatctcaatgctcagtagccatatgggcttcatggctaccatcttggacagcacagatatagaacatgatatggaatgtttccatcatcatagaacattctgttggacagtgctgtttgaaggcttcagagcagtggttttcaacaaaggatgattttgcccccaggctacttgtggcaacatttagagactttttggttgtcacaacccagaggatattactggcacctacaggatagaagccagggatgctactaaatctactatgtcacaggacagcacatcatgatgaagaattacccggtccaaagtgtcaagagaactaagattgagaagtcctgctttagaggcacaatctcattgaatatcctcaataatcttatgaggccaggtgtggctcacgcctgtaatcctaagcacttaaggaggcagaggcaggagggaggatagcttgagctggggaatttaagacctgcctgggcaacatagcaagactctgtttaaaaaaaaaatcttataaggtacatactattcttttttataaatgaggaaacaggcctggtgagcttgaggaacttgaccaaggtcacacagctattaagctgcagagatgagacttaaacctaaagctgtgattttaaacctcttgctctgaaacactaaactgaaggtgactgtgtcagagccacacctaatctggtaaaattcttcctgcccagtgatatacaagctcttagcttccttcattgccctctctgtgctaatcccaggagatgctaattcctgccctgaaaggcaaagagatcggctgaacctgggccttatcatgtcttgatcctttagggcagtgattctcaaaccataggacgcccacccttagggcagaatgttaaaatatcaggtagatggggatggatgtggttggaaaagacatgggtaaaattattagttttttacatttggaaaaatggaggaatactaattttatttgtgatagaaaccataggcgctagtgctgagcaaaaagctgatgatctgtgattagaaagggttgagaaaagctgggcatgatggctcacgcctgtaatcccagcactttgggaggctgaggcgggtggatcacgaggtcaggagttggagaccagcctgaccaacatgttgaaaccccgtctctactaaaaatacaaaaattagccgggcatggtgtcacgtgcctgtaatcccagttactcaggaggctgaggcaggagaatcgcttgaatccaggaggcagaggtt

SEQ ID NO: 78833 - DNA, 1002 bp, Homo sapiens
actccgcctcctgagttcaagcaattctcctgcctcagcctcccgagcagctgggattacaggcatgtgccaccacacccggctaattttgtatttttagtagagatggagtttctccatgttggtcagggtggtcttgaactcccaacctcaggtgatccacccgccccgcttcccaaagtgctgggattacaggcgtgagccaccgcacccggctgttgttttttcatccattccaaaatataagatatggtgggctggatttggcctgcaggcttagctgatgctaagctatagctgatgcaggtagagtacctagcatgctgcccagcatacactcagccagtgcctctatttccaacccttgcctgtctgtcattgtctgctggttcgggtggcctgccttctcccaaatttaacttctcttatgacttaacctatatgttccctctaaatccggtttcccttctgcctgtaccctggcttttccttcccagttcccagagactggcaggggagaagccagaagcatcagcccagcgttgtttctcacatctttatctccattcccttggctgctctggcatttgggccactcctgttgcatctgccctggaccgctgcactggtatacttgccagcctcctcgctccacagaatgcttccaaacagatgggaaaatagctgctgctcagagctcaggagtgctcctgctgcccaagccctgggcccctccctttgaactcctggacctctgtcatgtatctaggaggtcaatgtctggtgcagctggcctccaggactctacgccactgctcacggccagtgtctgtcccctttctgtactaccagttgtttaatatttgaatgttactcctgctgtgtccaaacaccctggcctggcctccaggacgctttaagatcaactcaagcccagcgaactggccttgcaaattcctaactccttgctttggtttctcatgtgttctgccattttctttt

SEQ ID NO: 78834 - DNA, 1760 bp, Homo sapiens
gaggtatttctattgtagaaaatagaaataagcctatcccctcaagtaagtgtctgtgtgtgtgtgtgtgtgtgtgtgtgtgtgtgtgtttactcaataagatcagatggcagtttgttcagtaatttgcttcagaaagagggttttacagctgggtgtggtaattgtacctttagtcccagctactcacgaggccgaggcaggaggattgcttgagtttgaggctgtactggccatgatagagtctgtgaatagtcactgtgctccagcctaggaaacatagcaagaccccatctctaataaaaaaaaaaaaaaggaaagaaagtgggttacaacataaaaatatcttcagtataccaaaaacatgctctctctgaatagagatcaagaagctggttctgttgggggctcccacccgcaccccatgcaggctgtggagtcccagtttggtctaggtggggcccatactttcaccaccccactttgctcctgagagaagcctggtccatctagtgagaattgaccttatctcactttctctccccgccagggtctgggatccccaaggcctgggcaggcatagacttgaaggtacaaccccaggaacccctggtgctgaaggatgtggaaaacacagattggcgcctactgcggggtgacacggatgtcagggtagaggtgagacactgggctgactctgaccccgccctctgcctgccagccttcttggagcccctttctggggccctaggccaaccaatggccccggatgggatggggtggagagaggctgaagatgcatttaatccaactccccctggcctccccaggggtgtgggtgtgtgtctggccaggcctggggcagcccaagggcatcagggggtgcccaagcctgatagccactcctgtgtgcagaggaaagacccaaaccaggtggaactgtggggactcaaggaaggcacctacctgttccagctgacagtgactagctcagaccacccagaggacacggccaacgtcacagtcactgtgctgtccaccaagcagacagaaggtgagggaggggtgaggagcagcacctggagcccccgctgtgcggattggccgcacggtcccctcataagctctcccccctagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggtgggcctttgagaggcagctctggggctcaggcgactttcccccagggtgagtggtctctctcttctgtggccagggaggtgggtggtgggagctctcccttgcccacccaccccaattatctcatccccactggagcctggtcatgcctcctctcattctctgttctctctcccaggcccctccatggaaaggcgccatccaggtgggctttactcccctccccatcccccatccccaccacatctctagcccatatcatccctatgcccctaagcagcctgcctttgaccaagccattcctcccctcagagtttgtggaaggaccacaaacatcccaccccttccagcccagcatcgtcctatgaggatctgcccagtttgcgtggggcaggagtggggttggtggaaagggaatgggggatgtgctgtgtctgggcagagagggccaa

SEQ ID NO: 78835 - DNA, 1358 bp, Homo sapiens
ctgcaaggagagcgacttgagctgagacctgaggcccaccagagttcctctgagctcctggacagagctgttcagctgttcatatgtgggaggtctgagtcgggtgcccatgtccttccatacctggcatccatttgacttggtctcttccatagattgggggtgggtgtcagaaccaggcaggccctgggagccccttattctaccccttcttcccccaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacgcggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctatcctctcttcctcttcccccaagattgagctctctgcccttgatcagccccaccctggcctagaccagcagacagagccaggagaagctcagctgcattccgcagcccccacccccaaggttctccaacatcacagcccagcccgcccactgggtaataaaagtggtttgtggagtttctggctctgttctgtgggccaggagagggactaggttgctggggggtgatgggaccgtcctgttcagctggttcaggcttcagccaccctgttgagcaggttttcccatcgtctctctcgaaactggcctggcccctgactttggagagcagtgccatgtttgaccaccagaggggaggagtgagcgggccacgggagccacgagtgtggggaggctgcagtgctgctgtgtagcatttcttcctgg

SEQ ID NO: 78836 - DNA, 1108 bp, Homo sapiens
gtgggggtaggtgtggagctccccgcttggggctcagctggttcccaggagagctagcgtgggaagcggcctggaaacgggtttccccaggtgtcagcgccagagctggtttcccatgacctcacctggtgggtggagcccctcccctccacccctcctttctagagcaccatgctcagcactggagctcaaggtcagtccccagccttctaacttttctgctctgttccttctggcagttcacagggccctggggctcaggttaggggaccatccccccctccgacctctattcacagcctgaacataaagggaacccatacagcctaaacctcaatcactggccaaagttcttagacttgggttggacccagtcttcagccttggcacctaaggagctagtgaaggtcagggtgctgcttgtgaacaatttaaatagaggtttatccccaagtatcctgtgcaagagcgagttcattgggagaggacttggagaggagcagggatctggagaacattccctcatgttggagcttgaagggactttgaaggacacccagggagaaaatgaaacaaaacaaaacttactttaccataaggagactgaggaccagacagaaaaggtaatagcttaaatgatatgtatcacccagtgactgtaagagcactttgcaaactctagagttggatacaggggtatgtgttactctgggagaggaatttctttctttctttttcttttgaggtagagtctcgctctttcacccaggctggagtgcagtggcgtgatcttggctcagtgcaacctctgcctcttgggttcaagcgagtctcctccttcagcctcctgagtagctgggattacaggtgtgcgccaccatgcctggctcatttttgtatttttagtagagatggggtttcaccatgttggtcaggctggtctcgaactcctgaccttgtgatctgcctgcctcagcctcccaaagttctgggattacaggtgtgagccactgggctcagctgggagaggaatttctgaggcacacctggcacacctgctaggcagctgctgggtcagatgagcactcatgccctggcccagcccacc

SEQ ID NO: 78837 - DNA, 1009 bp, Homo sapiens
gtgggctctgagggtggtgtgggggccaggaggaggctgaggatgggaacggcagcatccactggggcgccatgctctccccactccaggctctcacctgctgattgccctgagcagcacggaggtcctctacgtgaaccgaaatggacagaaggtacggccactagcacgctggaaggggcagctggtggagagtgtgggttggaacaaggcactgggcacggagagcagcacaggccccatcctggtcgggactgcccaaggccacatctttgaagcagagctctcagccagcgaaggtgggcttttcggccctgctccggatctctacttccgcccattgtacgtgctaaatgaagaagggggtccagcacctgtgtgctcccttgaggccgagcggggccctgatgggcgtagctttgttattgccaccactcggcagcgcctcttccagttcataggccgagcagcagagggggctgaggcccagggtttctcagggctctttgcagcttacacggaccacccacccccattccgtgagtttcccagcaacctgggctacagtgagttggccttctacacccccaagctgcgctccgcaccccgggccttcgcctggatgatgggggatggtgtgttgtatggggcattggactgtgggcgccctgactctctgctgagcgaggagcgagtctgggagtacccagagggggtagggcctggggccagcccacccctagccatcgtcttgacccagttccacttcctgctgctactggcagaccgggtggaggcagtgtgcacactgaccgggcaggtggtgctgcgggatcacttcctggagaaatttgggccgctgaagcacatggtgaaggactcctccacaggccagctgtgggcctacactgagcgggctgtcttccgctaccacgtgcaacgggaggcccgagatgtctggcgcacctatctggacatgaaccgcttcgatctggccaaagagtattgt

SEQ ID NO: 78838 - DNA, 1845 bp, Homo sapiens
cacgtggtgcaggaagaggaagatgtacagacagccatggcttgcctggctagctgccccttgctcaagattgaggatgtgctgcccttctttcctgatttcgtcaccatcgaccacttcaaggaggcgatctgcagctcacttaaggcctacaaccaccacatccaggagctgcagcgggagatggaagaggctacagccagtgcccagcgcatccggcgagacctgcaggagctgcggggccgctacggcactgtggagccccaggacaaatgtgccacctgcgacttccccctgctcaaccgccctttttacctcttcctctgtggccatatgttccatgctgactgcctgctgcaggctgtgcgacctggcctgccagcctacaagcaggcccggctggaggagctgcagaggaagctgggggctgctccacccccagccaagggctctgcccgggccaaggaggccgagggtggggctgccacggcagggcccagccgggaacagctcaaggctgacctggatgagttggtggccgctgagtgtgtgtactgtggggagctgatgatccgctctatcgaccggccgttcatcgacccccagcgctacgaggaggagcagctcagttggctgtaggagggtgtcacctttgatggggggtgggcaatggggagcagtggcttgaacccacttgagaaggctgcctcctaggctctgctcagtcatcttgcaattgccacactgtgaccacgttgacgggagtagagtagcgctgttggccaggaggtgtcaggtgtgagtgtattctgccagcttttcatgctgttcttcagagctgcagttatgccagaccatcagcctgcctcccagtagaggcccttcacctggagaagtcagaaatctgacccaattccaccccctgcctctagcacctcttctgtccctgtcattccccacacacgtcctgttcacctcgagagagagagagagagagcacctttcttccgtctgttcactctgcggcctctggaatcccagctcttctctctcagaagaagccttctcttcctcctgcctgtaggtgtcccagaagtgagaaggcagccttcgaagtcctgggcattgggtgagaaagtgatgctagttggggcatgcttttgtgcacactctctggggctccagtgtgaagggtgccctggggctgagggccttgtggaggatggtcggtggtggtgatggaggtggagagcattaaactgtctgcactgcactggtggctttgtgtcgatgctgggccgagcggtgtgtgagtgatctccaggcggggctggagtgtcacagggaggctgccaggccctacatgcccccacaccttggcacgcagtccttcaccttgtccgccaactctgcctctccagggctcattggggattgcagccaaccaacctgaattgtgaagcaggggctgttcttccctttggccagcagatggtgctgctccccacagaatccttggctttccggcagctgggagcagtgatttctgtcactctattagtgcttgcttcctccctacttgtcgcaagaattttcttggagtcgcccgggcatggtagctcacgcctataatcccagcactttgggaggctgaggtgggcagatcacaaggtcaggagatcgagacaatcctggctaacacgatgaaaccccgtctctcctaaaaatacaaaaaattagccgggcgtggtggcaggtgcctgtagtcccagctactcgggaggctgaggcaggagaatggcgtgaacccgggaggcagagtttgtggtgagctgagattgcgcc

SEQ ID NO: 78839 - DNA, 1080 bp, Homo sapiens
cctggattcccaaaaggaaaactgaggcagaggggcaaactttggtccaggatggccaataaaagggtcacaaaatagggttgtcatttcaaggggattggccccactctctgaatgcccagtaattgggtgctttcctctccctgagcagctttaccgtggctcagctttcaccttgaaccagcccttactgagcagtcagaaaccataccgtgaggtcaggagaggctgcgcggccttagtttggtggccagcaacccatgtccactgagaataagcttgggcagagaaaagggaaaggggcactggtctggccccccggaaggtggctgctgcttctggttcccaggctgctgtggccaaaggtctgtttgtgtttgccaggtgcagaggcaggtggctgcagctcaccttccctccatggcatgatctcccagctctgacccttgacctgttccctcgcggcatctccacagggctagaaggtgaaccctacttcctttaccaggtcctctggtttctcttcccaggccaggacctaaaccgttcacaactcccagcaggccagagctgcagagacctcagatagagactataaagtgctgtggaagccttgttcaaataaaaacattcatgaatgtccagtacttgaaattggtatgctgagattctccgatggaaactgggctggagggacccacactcctgttcactcagcctgttctccactcctatctcaatgtctctctctctgttttttttttttttttttaatagaaacaacaccttgttctattgcctaggctggagtgcagtggcgccatcatagctcactgcagcctttaattcctgatctcaagtgatcctcccaccccaggctcctgagtagcaaggactacagacaccacacctggctaatttttatttctattttttgtagtgacgggggtcttgctaggttgccaaggctggtcttgaactcctgacttcaagcagtcctcccacctcagcctcctagggtgtccggattacaggcatgagccactgtgcccggccccctatcacgatatccataagatg

SEQ ID NO: 78840 - DNA, 1038 bp, Homo sapiens
aataataatagggatggccggtgtggtggctcatgcctataagcccagcattttgggaggctgaggagggcagatcacttgaggtcaggagttcgagaccagcctggccaacatggtgaaaccctgtctctaccaaaaaaaaatacaaaaagtagccaggcatggtggtgtttgcctgtaatcccagctactcaagaggctgagggaggagaattgcttgaagctgggaggcggagtttgcagtgggcagagatcatgccactgcactccagcctgggcgactgaatgagactctgtctctaataataataataataataataataataataataataataataaccttggagccttggagagtggctgagggactgtatcagattatgcattcatgggacccaataaacagtcatttcctttcccccaggtgacatccagacagtcaggggcagacttagagtggaggggagctccctgactgcaaatgagttccagaaggaaatgaaggaaaaaggagaaccgcagacaaatgctcataagggatgaggcatgaggagcagagggtggggaaaaaagagaggaaagctaggtggggctcggaagggatccggaccctgtggaaaaagccaactgttggaggtcctgtttgtggcaagagggtgtgacaaagttcttgactggagggagaagactggagctttgagaatgggtttggggaagatatgaaggtttggaggaactaactgctcacagtcttggccttcggaaaccaagacggcactcctgccagggccaagtgtaggtttcaaattgtaacccctcctccttcatggtggcagttcagagctgagacctgtggcaggaaagaggggcatcttctgccctggtccttgaagctcctggcagatcagccctctctgtgtcaccaagacagcacactgaccgggctggaccatccactggctgatggctcatgactgatgacccaaatgtgccaaggaagggatgtccaagtggttgggacccttggcagga

SEQ ID NO: 78841 - DNA, 1060 bp, Homo sapiens
acaggggggcgacacggcgcagcgccgaaagagttaatctgttctaggcgggggaagtgcgggcttgggggtgggaggcaggacgcttagcttggcctggagctgcgccccgcgctggacgctcggattccgctcgctgcctggactcagagcacaattgcgtttcctgcgggttatttttggcgtgggaacgcggggagtacggcggtgagaaaggctgaagctgccagcgccgctgacgggccccttcctgtattttacacctttcgcgaattccgctcctttggaaagggaataatggctttgggatgttgttctgacacagaggaaaaggatatttcagcagcacaacaattctcactttgaaaaggaaaaaagaaaaccattacccacctctggaggcagaacccctgaatgggcaccaaaggaccccctgctcccagggtcctctctagcctggggagcttttctttctttttctcttttttccattttgacctcttttcctctttcccctccctatctgcctccaagaccctgggatatcttaacatccttctattgtcccctttttgaatactatcaggccccctgcacatgcacacacgtagggcagctacgtagcggggctttgggtccctctggcctgttcttgctggcaggcgggggtcatctggataactgggctgattggttggctgatcaccatcatcacagccaagaaggacattggccagccgtcactggcacccttggggactggcgacccttccctgacccgaccctctgccccctcagaggccttgccaccagatgcactcatcagcaagatcgccatccagggctccctagctgtgggtcagaactggttattggatgagcaaaccagcaccctcacaaggctgcgctactcttaccgggtcatctgcagtgacaactactatggagacaactgctcccgcctgtgcaagaagcgcaatgaccacttcggccactatgtgtgccagccagatggcaacttgtcctgcctgcccggttggactggggaatattgccaaca

SEQ ID NO: 78842 - DNA, 1020 bp, Homo sapiens
ccacctttaatttgcatgggtatttcaccagggaattcggagtttagtagttccttaacagcctggagccagtgccctgcctggagaatcaatttgaccccacggtgacctgaggacagctgcttttccagggcccctcggctggtagagtcagggaggggttgtgcagaaggagaaatgactttatcctgcttgctcagccagggttcctctcctgcctcagggccagggtcagcctggtcagggggtagggaaaaaaggacagtggctcccacctcccccatcccaggctagaaaaggccaccagactaaaccacggtggtgtggatgctccatctcttgactgggacccacagagctctccgtagcttccctcgccgcagctctcccagcctctccctctggatccacaggatcagcggccccagccctccgccccacgtggcttgctgcattccgggaagggggtggaaatgattcactgggggaactgtgactgtcccttcctcgggcggggatgcgcctgcgaggtcccagcggccttccctgggcggctgcgccctccctcgcgcccagggcgccccgaggcctgcgcggcggcggaaggggcaggtgcgcctgcccgcccgggtcagccctccacctgccgccgccgtgccccgcagctcccgcggctccccgccccccgcgctctttgttacagcccgacttcctgtttgcggcagccgacccggctcacttcccgggccgggaagccgccgaaggccgcgagcttctcggaggctcccccgcccgctcggctccgcctcctgcctccccaatctcgctccggccgcggccgcgggaagcggagccgcgggcgggcaggcgggctggaccgcgcgggccccgctgcccggcactagagggcgctgcgcggccgtcggggctgcgcgcgggaggggccgccgaccccgggaggctctctggggccgccctttctccgttcggggccgatgggacgaaggcggcagggggcgg

SEQ ID NO: 78843 - DNA, 1344 bp, Homo sapiens
ggtgggcgtggtctcccggcaagaaggtttaaagggcgcctccatggggggcgctcagctggagctaccgagcggtgccaggccaggtgtgtgcgtccgtcggtctttccgtgcccacgccggagaccagccccggaggccgcctgggcctatccctgtgccaggcaccatgaagcaggagtctgcagccccgaacaccccgcccacctcgcagtcccctacgccgtccgctcagttcccccgaaacgacggcgaccctcaagcgctgtggattttcgggtacggctccctggtgtggaggcccgacttcgcctacagcgacagccgtgtgggcttcgtgcgcggctacagccgccgtttctggcagggagacaccttccatcggggcagcgacaagatggtgagcatccaaccgtgcccaggggagtgagggggttgggggcgggatactgggcgccagtgccctggaatgtccggggctctctgggccaatagaaagaaatgtgtaaacctgtgtctggggtttgtggctcatttaaatgtatgtgcccagtgcatcactgtgatggctggagtctgtgaacctgtggatccctgtgttgatcaccaactgggaccactgacatgtcagtgtttctggacgtttctcctacatccgtgcatcgctcccccaccttcccctgcatgaatgggactcagcatgcagagtggggcacttggaggcccgggtcagcgggattgataaaggtttccttgctgatggcagagctgatttctaacttgtctatttcaaaatatttcttccctccctagcctggccgtgtggtgacgctccttgaagatcatgaggtaagtgcccgaatcatgaaggggaaccctggcccagtgtgaagggggaccagcagagagagctcataggctcttggctgcaggctagctctgtctgatgcttctctggcagagtagaaacgtgttctagctcagtgcttctcaccaaatcacatgaggatcttgttagaatgcagattttagttcagtagcatgagaatgggtcctgagacacagcattcctaactagcttacaggtgatgccaccacatcctggaccacactttgaggaggaatcctgtcttccctggtactagaccactttgtcaactgttttttttttttgttgttgttgttgttgttttgtttgtttgtttttgagacagagtcttgctctgttgcccaggctggagtgcagtgatgcaatcttggctcactgcaacatctgccttccagattcaagcgattctcccacctcagcctcccgagtagctgggattacaggcatgcgctacc

SEQ ID NO: 78844 - DNA, 1030 bp, Homo sapiens
aatgacaggctctagcagcagaagagcttgaggccaagggctgggtgtggtggctcatgcctgtaatcccagtactttgggaggccaaggtgggagaatcacttgagcccaggaattcgagaccagcctggacaacacagtgagaccccatctctataaaaaatacaaaggaaattaaaaaaaaaaaaagtgccttgagagtccaacccagcctcctcctcattgcccagtcacctcggaaaaagccttcagccccctgggtacaagttcactgtgaggggacgatgccgtgggatgatgtatggggcaggctgggtggtatgtgttgctgctgttcttgcggctggtgtcctggattggtctgggtgtctccagcagggtcaactccgatcaggttgtgcagccgttgtggctggggagggtgccatgcctgggccgtgtgctcatgtcttggcggccttgtgtcttggccattgatgggaagagtgtggagtccagccagcttcttctgggtgcctggtgagggcaacacaaaaggaggaggcagcaggtggcagggagccctgggcagctgcctcctgtgtttcctgggcctcttgccagacagccagagcacagccctgctccatcctgggagctgatggtggggagggctgcttgccagctgcacgtagggggctttcacccatcaagccattcgatcagcaagtatttccttaagctcccactgtgtgccatgcaccattccaggcacggggatacagcggtaaagaactcctcctcctcaaggaacttggagtctagaaactgatggtgaccattcagcgtggaatgggagaagagggccttgagcacccagaaagggcttctgacttgagcagggcagtcagggaaggccttcttggctttcttggagagggaacctgagaaggggcctctgaggaacagagagtaagggaacaacacgtgcctgaggggaggcaagctcagaccagctggaacagagtggcccggacaggagacacgagcc

SEQ ID NO: 78845 - DNA, 1423 bp, Homo sapiens
agcatgaaattgaaaaggaaacatcttatcaaacttgatgttccaagaaagaagaaaggaaaaacctgtttgtgcctagtaagttacagctctcatcctgtaactttggtgtctcagattgtaaaatgtgtgctctatctagagtgtcaagatgaacattttaccatctgtggatgaagtagtatagagagggttgggtaggtatcattttctcttaaaaatctattcctcttactgaaaagacagttgacaggaagagcaagcaaacatgccaagaagttgttagcaaggagtggcagggaggaattgcccaccacttctcctccagctcagactctggtaaccaaggccacaggctccaaggaagcttacgcgggactggtgcttacgttcttgtctctctccgtccccacaggaatctccgccagcagtcctctgcagacatcccttgttcggcctgctggccttgctgactttggaccttcaagcgcctcttctcctttgagttcccctttgagcaagggaaataatgttcctgggaatcccaagaacctccacatgaccagcagcctagccccagactctctggtccggaaacagggcaaaggcaccaacccctctggaggacggtaaccatctgggccctccgacttccttcaaccaaaccagggctagagtcctgacctgccagtggtctttggatggcttgccccgtgcagcatcttgcatcctgagtcagaagtggaaatgtccagcaggggaaggacaggcaggtggatggtgtgagcacttttatcatctgtgtctcatcaggagcatctggggtgcctgtaggaggaaggccacagggcatggatcagccccactgcatctcaagtgaactgtatagccaagtcttaaacctctcacggggcaagcctgacacagaccccctttagatgctcaggcatactgtttccatcccgattccactcttcggctctgacacgtcccttgcaaagtctccgcaggtgctgtgaagagccttccatggtagagatttctcttaagagtgtgatttctcatagggctagtaagggagattgtatacctgttgtccacagtcttcaggcagctccccaggtctctgaaccccagagtgtcatcattggagagagcagtgactgcgagagatggtggaggccgctaagcatggtagaggctagaggaagtctatccacaggcagttgtgttcccagcaattcctcccatcctgcatggttcacaccaagagaaccttcagatcctaccagcaaccgtagcaccttccacccaggggactcccagaagccagtagagagaccaggagccacctcaatcagcaggacagcctcactgcccctcttgcagagtcccctttgcccatcctgaatgcacagtctcc

SEQ ID NO: 78846 - DNA, 3049 bp, Homo sapiens
ggagaaaagagggtgtgaacctggtgatcccatttgttccctcggctgataactccaacctctctgctgacggagatgactccttcattagcgtggactcagccatgccaagccctttcagtgaggtgaggctccttttagatgcctgcatcacagccgtaaggagtgtcctgaccgtgtagcagggacacactgctgggcagtctttgcttctcctggagttctccagccttgttgaagtaggttgcacatgaggtctgtaaggagaaaaacaaatgaggacaggttggtttctcagaagccaaagcagcctcaactgtgaagcatgttcctagctgggtgcaaggccatgggcggtgagcacagggggtcgtaatgatcttaacccttcctcttctagatctccatcagcagtgagctgcacactggctccattcccctggacgagagcagcagtgacatgctggtcattgtggatgacccagcctcctcagcccctcagtctcgagctaccaactctcccgcatccataacaggctccgtctcagataccgtgaatggtaattgctgctgtcttgtacagcttgggcctggtccactgcccagcactggtttggttgtgggtaaggtcctgattccttctaggataatggtatttttattctttcaatagctttgtcaagtgaaatgagaaaacgaggtttagggaaagcaaaataagtaactttataaagatttaaaacttttctagtcatccccgactttcagattcaccattatttttgctgatttttaattaatgttagcttttctgggcctttcctcactttgctgtgtggggtctagtgttgctgccatttcttggggagctctgggttcaaaactcgagggtaaaatttgactctccaaggcaagagcacattagagtgtgcagatgagtcccaggtagcaagtcgcttccctttgtaatggacaaatttaaagaggaaactcaggagtaatgtaactgctcttcagaatgaaaagcagcttgaggagttaggatgttttcattgtttagaattcttagtattctgtgtgactcagtggtctagccatcattaagtggagacatagacctcctcatgggtcctaaaacaaatgccctaagagctcgctttccctgtcaggagaaggtgatgttaacatcttggagattgactttttttttttttctttcccttttggcccatttgttcccacaggaatttccattcaggaaatgccagctgcaggacgtggtcactcagcccgaagccgaggccgccccaaaggttcaggaagcacagccaaaggagcagggaagggccggagccgaaagtccacggcaggcagtgctgctgcaatggcaggagccaaagccggggctgcagcggcctctgcagctgcctatgccgcatacgggtacaacgtgtctaaaggtacagaagcccagggtggctgcagactttgttctggtcagagacagtctagaaattctgtcagtcaggtagaacatgtaggaaaccctgaagccgggagctttcttcctagagccccaattggggttcttcttctttgtaataagcactgttgactcaccccttgccctcctgacggtacagggctgtctgtggattggaagtagttgtaaaaagggagagctgaattgtgaactgtactactttaaacattctgaatttttcttgctttggggatttgttttcttcctaggctttcatttctgagatccacattttagtaatccaaattagcatagttaacgttcattcagctgtgtgatttatcacctagatatgaggcacctgctgcatgcataggcgtataccacatgggccaggcacagtggctcacacctgtaatcccaacactttgggagactgaggcaggcagatcacttgaggccaggagttcgagaccagcctggccaacatgaggaaaccctgtctctaccaaaaaacacaaaaaattagatgggcgtggtggctcacgcctgtagtcccagctacttgggaggctgaggcacgagaattgactgaaccctggaggtggaggtttcagtgcactgagatcaggtcactgcactccagcatgggtgacagagcaagactctctcaaaaactaaaaaacgtaaaaaggagtattccacatggaccttgctcctgagtgtataatagcaatgagaaggggaagccatgcatgcagtactcttaacagcaatccacggcaaaatacaggggaatgaaaagaaggcagccacagcagttgtaggtcaggaggagagggaaccatggtcctgctgataagttgcctgtctgtattcaaaagggaggagaagaatgaggaaggatttggactggtgacagagagctggcagtggccaaggcatactgggggtcactgagcagcttaggttccatggaagaggagcagtaggagtcaaggttgtaaacacatggcgaggcctgctgggcaggagcttagcagatgtgtgacaaggggctgcagacagtttgaggaaaaaagtggctgttgtgaccgtgatatgtgaaggatgattgtagctataaagtacaggacatttgagtgtggtgagaaagagagagccacttacagacctttcttcccattcaatacgtgggcttagtatgagctcatagttgtagcaagtaaaggcatactagtatagaaagtgcttggagtgtagtaattgctcagtaattgttagtttacttgccttttctcttactgcagaaatctcagctttcatttattggttcttccaggaaatatgaagtatgatagaggaaatatgaagtataatagcctcgcccagtgtttcttagccctttgccaacttaccacatccttggaaaacaacagtcatgccagtagtccaggctgccgtggcagggtctcacccatggctggggcattgcatatactcatcagggtttctcctcagaacctgcactgtgtagagggcagaaagggtgagggagatagaggg

SEQ ID NO: 78847 - DNA, 1042 bp, Homo sapiens
aagcaatgtgatcttggataaattgtctagctcatttgtgcctcattctcctaaactacaaaatatgtgagtcttaacagcatttaaataatgacgattatgggattttttttctcagcacaaataacagtgataattctgggatttaaatgagttaatgcacttagaacaatgcactgtaagtgttaaccgttaatgttattaatgtactaaacactacgttttaactattaatattattgccactctttttaagtgaaaactgaaaaaaataaaacaggagcatgtatcttttgctcagggcatgtgaaggaacggctttgtatcttctaagatgtatcttacttagctcaatatcatagaaacgaatcagaccctactgacgccaaactcgcaaacagacaattggctgggttgctctcagaatttctggtccttccctaagagtgcttcagtttttgctatattctatgcaggtgattttctatgatagcgactggaaccccactgtggaccagcaggccatggacagggcccaccgcttagggcagacaaagcaggttactgtgtaccggctcatctgtaaaggcaccattgaagaacgcattctgcaaagagccaaggagaagagtgaggtaagcacaagagaaagaaattcctacactggtggagcaaacagaaagtccaaccacattgactgcattgagactattttaaaactctcttgcctttcattggtcctgacgaaactacaatttcttctgaatagaaaataaaatcaggtcccatgcaatagcaattttgacttccctggccatgcctcattccctttcccctagaatggtttccatagcctggatccagctgttgttcatgtggagactgacaccggtaatggcctctcgcattcagtggaagaaggatggacattttttagttcctatcctagtactctcagcttatctgcctctgaattgtatgccaaatttgttattttttgtttttttcatcctgattcagtagccttagattttctagttag

SEQ ID NO: 78848 - DNA, 1030 bp, Homo sapiens
tataaattacatttccagtggcaggagaggagacaaagcataaagaaatggaaaaaatactgataatatggggccaggtgcagtggctcacacctgtaatcctaacactttgggaggcagaggcaggcggatcacaaggtcaggagttcgacaccagcctggccaatatggtgaaaccctgtctctaataaaaatacaaaaaaatttagctgagcttggtggtgggcgcctgtagtcccagctactcgggaggctgaggcaggagaattgcttgaacccgggaggcagaggttgcagtgcgccaagatcgtgccactgtactccagcctgggtgacacagtgagactccatctcaaaaacaaacaaaaaactgataatatgaatgctatgaagaaaaattcatcaggtaaggagtggtagcatgagaatgatcaggggttgctgttttatatggattggtaaggcatctctgataaggtgacatttgagccaagatctgaagaaagtaaggcggcaacctaagcatatacctggcagaaagaagagcattccaggcagaggagataagtgcaaagccctaaggtgagaacatgcttggcataatcaagcaaaaggaagcagcccagagcaggtagaacagaatcaactatggggagagtagtatgagatggctattgcagaagcagatcatataggggttagtagccatggtaaggactttgagatggggagcgattgcaagaatttgaacagaggagtaacatgatctggtttgagttttaaatgcatccttctagcttctgtttagagtgggagaaaaaaatgaaatgctacaaggagacataaacaggaagatcagttaggagtatcagaggttaagtggcaatatcacccaggcagcagagtctgaagttcaggagaaagattggggttaaagctgtattttctttttctttttatttatttatttattttttgagacagagtcttgctctgtcattcaggctggagtgcagtggcttgatctcgg

SEQ ID NO: 78849 - DNA, 1049 bp, Homo sapiens
ctcatgagggtagtggagaaatgaggtgcaagagtgtagaggcttgaatagattcacagcagcagggggaatctctctctctctctctctcactaatctgatactacacattctgtaatagcaactataggatgcaccttccttggcatctaaactttcagttaaccaggtacggcaagacgtcagcgcctgagggccactggaggcattgctgggtagctgtacatcatcagcatctgtcatactatgggagggctgtcagtgtggcatgtgttgttcctgtgggttctctgatgtggtggctcacttgagccatatcacatagtttctaccatatcagatagtagaaacttgcctttttccttgttatctcttggttccctgctctctgtatcttttaagaatttcagcatagtcatactctcaatgtgagtacaagattcatcactttgtcccagctgctcttttggactccactctcagttcccggcttcatacctgttgatccaaatccattctttgctatgctggtactctgttagtttctctctgccctttattaatcatgccactcctttgattaaaactcttcaggaattcttcatcaattataaaataaagtataaggctcttcatttgtgtcctttatctacctttatagcttaattatcagaccactttcccttccaaattttatattccagaaataatgattgacttctagttccctgaacacaccatgccatatcacactgttggataaactgttccctcagcctaagtcatcctcccatgagtctcctcttccacctggtgaacttctgtttgttctttaaaaccccattcaggtgtcaatattcctttcccagcccctccctttattcaagttaatcaaaatacattgtaagtaattattttacatactagactttggcctcaacaatggaaggaagtcaaaagtctgcatttctaggctgaacgcggtggctcacgcttgtaatcccagcactttgggaggctgaggtgggcagatggcttgaggtcaggag

SEQ ID NO: 78850 - DNA, 1030 bp, Homo sapiens
ggcctcactctgttgcccaggctggagtgcagtggcatgatcatgggtcactgtagcttcaacctccccagcctcaggtgatcctcccacctcaccctcccaagtagctgggactataggcatgcgccaccatgcccagctaatttttgtattttttgtagagatggggttttgccatgttgcccaggctggtcttgaactctgaggcccaagtgatccacctgcctcagcctcccaaagtactgggattacaggtgtgagccactgcacctcgcctgaataagtgtcttacacattcattcgacaaatatttcactaatgcctactatgtgtctgatactgtttgagacatttagggtacatcagggaaaacagactggaaaaacaatcagtccatccagatttgttttaggagctataattgaacacatcagaaaggattgttttgttactcttatgcattattccattaatggaaaaacccattttttgtatcctgaacttcaaaaggtggttggagagcaatgaaaagggtaatttcaaaaataaagtagaaaagatattccaacaaattatccactctttcctacccagtcttcttgcaggaatgcttcagtgtttgaaagggtgaagaaaagaggattcctggctgggcgtggtggctcatgcctgtaatcccagcactttgggaggccaaggcgggtggatcaccaggtcagaagatcaagatcatcctggccaacatggtgaaaccacgtctctaccaaaaaaaaacaaaaaaaatagccgggcgtggtgacacatgcctgtagtcccagctactcgggaggtgaggcaggagagtcgcttgaacccgggaggcagaggctgcagtgagccaagatcatgccactgcactccactctgggcgacagagtgagactgtctcaaaaagaaaagaggattctttttgaatctcaaaattattgctaagattcaaatatatttaataagaattttagtaactttgagatttaaaaatacgtaaatg

SEQ ID NO: 78851 - DNA, 1043 bp, Homo sapiens
tacatccttttactagggaagacatttcttaattttaaagtaggtcacagcctaggaatctaaaattatgtatggaaaacaagatttaggattagttctctgcgtaaaaaagcagagaacagctattcaacctgagttaatatagtgattctcaacttgactacatatcgcaatcacctgagaagctttaaaaaaatatggatttctagtcctatttccagagattcttatttattacatttgaaatgaggcctgggcatcaggatatttaaaaggtcctggggtgattctaatatgcaaccaggcttgacagctactaagttagtggaaaagatatgactgtgcaaggcagcttttgtttctttaattgcttctttgttgaagtttttctttttcttgtctgagtggtgacttattttttaagggacaggaggtcacagacctagaaacaggagagtgaaaatgagaacagataatcacaaactagtacaataagtctttatataaataaagtttgagaggcagaagtacctggttgtcagaagtacataaatgttctcatgtttttacatgtgtaaggcttcataccctcgccctgctacaccagggaatcgtaataagtaagtggaaattgtactgttattttccttatctaggaataaagcaatagggaccatatcagtacagaaggaatgaaggctagcattaaggagggttttcaggctttttggaagccaagattggcttgttgaattttgcaatgaatttatctgaaatcagtgggaggtttcttttaataatccggcaacttcttttagcaagagacataaatgatttttggggtcagtttcagcactaagtcttaggtttcatagccccttgaatgctgttgacagactaaactctctggtttgtattatgagtaggccacttattcctaaatgatggaagtgcttatgagtgaatgtaagtcaccataagagaggtgattaagctgttgtgtttgatgtatatattaactatgttaaatatcctaacagtag

SEQ ID NO: 78852 - DNA, 1368 bp, Homo sapiens
ctatcaaaattgagagaccttagggaattcaattactggagaagggtaattgtggtaagaataaaaccttaaaagttgttatgaaagctttgctgcctgctcagacttggaatttatacagtactccttgtctggtgccagggagagggcttagcagtcaattctgtcccagctgcagtcatttgattgtgttggtaaggagaccaacaaaaagaagagcatttcaataatctaaacaggaccaaacaaagagactgaacaaaggtgtgtgccacagcttcagggagcgggtggtggaaggagacatggcctggcagcattctgaaggtgggaaatggcaggctgcagtgcagagggagtaaacagccaggacctgtggctttgtagcaaaaacagagtggctgatgatttgttatggtgctgtcagcacatccgttcttgttccttgtatacaataattgtgcatttggcaaattgtggcaagaacagagaatgactgttgagaacttttggattgctgtcaacggtcagactgtggttctgaagaaaagccataggttcaaacccagaaactgaggaggaacattgtgtttttcttttagttgttagttgtctatataatatctccattctttctctctccctttttgtgtcctatggccacttccacatatactcttacccaaccccttaaacctaaactcttcccctcttaatgacagcaattgttcagggcatgtttatggaccagtctgcaaacaggaaactctacttcctgaatatgataggagttaaatgatactaactggataagatgaaaatttgtgagttaagtgttctttaaagatctgttgctgaaatgcttttcttgtgagaagaggaaagagaaagcacaagttagtgagtgagaggagcttcactgcagagaaactcaaagtcagtctttctgaaaagccctgctttctttattgaattaacatacaactagggttaacgacatttaccagtcaacctatttgcagtcctccaagagagctagttttgggtttaaaaaaaaaaaagggtaggggggctgggtaccatggctcagcactttaggaggctgagctgggaggatcccttgagcccaggagttcaagaccagcctaggcaatatggcaataccctgtttctacaaaaaaagagaaacaaaattaactgggtgtgatagctcacttgtagtccaagctactcaggaggctgagatgggaggatcacttgagcccaggaggtcgaggctgccatgagctgtcattgcgctgctgcattccagcctgggtgacagagtggaaccctgtcttgaaaaagggaaaaaaaagagagaggtta

SEQ ID NO: 78853 - DNA, 1321 bp, Homo sapiens
ctacagaatcccaggcaagagatgagcaccgttattgaaagaagcaagatagcaccttacttcttttttctcccttcttggttctggctcctaagttcccattacaggagtagatggcttattgctggcgttgtgggaatctcttgtggcttttcctgttctttgaaagaaaaatggaccttgtttaaatagcaggaagcgtctgagttctttttgcatcgataaaaagcaccagcctcactggctgtttactgtgagaaccaaccagctcctcaccccattgtgctctgtagactagctgggacagggcgggggttgggggtgtctcactggaaccctttatcatctctctttcctttatacttttacgttttctctttccctgagaagggttgcttccatattccttgagagactgaccaaaatcttctgggtttcacaccttttcttctccatgtttcaccagaaagatgtacaatcccttcaaaagtcccctttccttggaaaaatgagatattatttaatcttttgccctaattttactgccataggctacattctttttatctctgaacaggatcttacaccgtggatggtaaaaacctgtgtctaatgaaagtactataggattgtaggaaagtttgtaagagagtaggataggtttgttcatttaaacattttttaagctcctgttttattttatttatttttaacacccaatgatccagaaagctcctgttttaaagaagggtctgggcacaggtttgacttagcagaatcagctggatttccagagaagtgtgttccttgtgtctctgtatcctgcttagcgacaggtggagctcttgtccagtgcaacttaagtgactgctaaaaacttggctaacaaataccagccccagaagtcactctagtgtgttcagagaaagaaacctgtttttcctgcatatcttactaaggacaaatactagagactgattttctccatgctcaccagcaaatcagagatagtgttcattttgctgaagtgttttaaggctgttgctgaagtgtttcttcttagtcattttccttcagggcagtacaaagaagtccagtccatccacttctcccttccccacctacacaataacaagataacaagctgacagcaggtaccacttcttgcctcctttagtcatgttagagttctgtctttataagtatatgcacatctttatttctgagcttttctaatcctaggaacagttcattctgattagcaaagtaaagtagatgtgggaggcaggactgtttgaaaaccattgaatcatgattttga

SEQ ID NO: 78854 - DNA, 1793 bp, Homo sapiens
taggttcaagccattcttgtgcctcagcctcccaactatctgggattagaggtgaacgccaccatgccaggctaatttttgtattttttgtagagatggggttttgccatcttggccaggctagtcttgaactcctgaccttaggcgatctgccacctcagccttccaaagtgctgggattacaggtgtgagccaccatgctcagccgaaaacaagttccttttggagaggataaaggtgatatgagattctagtattgtttggataaactatttttgttgtgaactggttttggaactccaggcccagtttgctgtgaccctctgtagttttgcatctggaccatagatggcactgctccctagcaaactcagttcagcttcatctgcaagccagagtactctctggttattggtaaatgatgctctttctgtcacgttggtaccctccagaggcacctacagcccatggtcagctgttcatatgtctcaaggcagtatttctcaaggttcaacttgggacgctggggtgcttgtcaaaaacataggtctattggcccctccctcagttcttctggttcaaaatctacacttttggtccgcttcaaaggaggtccttatgtgtaccaaaacctgacagccatttccctaaagcttgatcaacacaaaaggagaaaagttaatagcaagatcaagttcccttggtgcctaacttccacgaaatgatagaactacctaactagatacagccggtgttttatgttctgatctctcctgtgctgtggcctttgcttctcatacgctgtttctccccatgtcttagtctagctttagggttcttctgagcaattctgcgtatgcagattgagtatctcttatccaaaaatcccaaacccaaaatgctccaatgagcatttccttagtgcatcatgtaggcactcaaagttttagattttcagattagggatattcaacctgaaatgggctttcagcatatttgtcagcgtgggcttgacagataatcacagcctccacattttaacaaaagctagccttgtcatcttcaagttccttaccagttgacttcacaggtatctgaatactgcctattagagtaggaataaacccagatagccaaagaaggataaaatctgtgtttctgaattggcaggagccctctactccatcgagtgagcagcagctgagtgttgtttggttataccttgtattgagataagaatttgtgtatagcctttggccaagccaggaaacaaatctgctactctctggcaattgcttccctaccctcccctgcctccgcactcccccttccccagtttatggcctgaaagaaagtttctcttccattaggtttgtcagtcagcaacctggtcagggaagaggagaaagctgttgataaatttgggagctttgccacaaaagcattaaagatgacttcaaatatgccaggccaatattctttagtttttaaatgaagtctgactagctgcagctccctttctggcatcaccatcatgcatatggttaagagaactttgccaagaacaatatctagcagtgaaggggaggtggcaaaatgatcagatatatatgcatataatagagttattgctgacctggtattctcatttatctgcaaactccagctctctttggatctttagtttgtttgcaggtttcattttataagaggttggctttttatctggaaaagctcactaagtcattcattagggacagcttagtgtgccagaacagatatttaaaaccact

SEQ ID NO: 78855 - DNA, 1519 bp, Homo sapiens
gttgtttattagaattaatagtatttacagggaagaaagctcttaaagttagatgtttaatatgtggctttttttttcattttgcttacattaaacataattatagttggcattcatttgcatttttattttgcagtctcttgttttcagcagccactgtaaagcagtgagtggctactcagaccaggttgtccatcagcggagatcagctacctcctcgctgcgtcgctgcctgctcactgagctgccatcttttttgtgtgtggccagtccacgagtaagtgctccaggagggaagagatgaaatagatggcaataggagaaataaaccaatttttaagggatttatttcttaaacagaattgttttaaactatttggactttaagaaacatataaattctagtattttaaaatgtgggcatttgtgattctggcctgccccagacaacacttatattcaccttcatttgttgatttaagaatagttgtatggtcgatagcttctttttatttagtcaggggctctaaactatagtgggaataaaccatctgtcaggtagaatatatatcacccaatagcagggtcggggcgagggaaccatttgtcacctgtgttgaggttttgagggttttcatgagagggcgtcagattggtaaggattgggggagatttgatccggtcatatcacctcagtacagtctccagataacaaaaggaaacataacactccagcatcaagaaccttctcagtgttgtgttttcttgctttccaaagcagcctcacttggactgtcattcacatgtctgttccatctgaaaagtgactgttgtatcttctttgctattcaccatttgtccactgttgtttgcagattgggcttagtttctattgtggtttcaactttagcagttgtctgcatccttcctaataccctgtttatcaaaatagagccctcttgccattgctgacaagcattgctggaaaggctttaattggcacactggggttatttactttgcctacatcttccatcctcttttttatccatgttgatcagagccagagaaaagatctaccaagaagggaaataatcgaactgtggccaggttctgtggttagagccaagaatgaatttctgtcttcccagttcatttctttttgctccaagaggcaactttccgttagccaggaagctctaagaggttgacatttcttacccttttatgtttttctcttgtttctccactcatcttagcaagtgtactgtttttacaggtttgttggttttttttgtttttgttttttttaatgcttttgagacagggtttcactctgttacccagcctggagtgcagtggcattatttcagctcactgcaacctcaacctcctgggctcaagtgatcctcccacctcagcctcccaagtagctgggactacaggtgcgcaccaccgctcctggctactttttaaattttttgtaaagacgaggttttgtcatgtcgcccaggctatt

SEQ ID NO: 78856 - DNA, 1078 bp, Homo sapiens
ggtgcgcacctgtaggcccacctactcaggaggctgaggtgggagaatcgcttgaacctgggaaggcagaggttacagtgagccgagatcgcaccactgcactccagcctgggtgacagagaaagactctgtcccaaaaataaaaataaatgaatgtgttctaatttgggaatgaccacccctgggaatagaattattgctagtcagactttttccagaaaggtaataacaaataatgtgctttgttaaaagaactccctatggtgagttgtattcttttcttagtaataactacagtgctgaagagaagataattggaggaaatgttcattcttttattttctacctttatattattggaacaaagtaagaaacaggtttctgttgaattttgaattttagaatactcaaaatgaagatgaattaatgcgatacctgatagagacattatttagtgactggtctgtagaagttagtaagaattcagaagtcttcaggtcagctactgctgctgcctcagccatctgcccaggaatggtctgattgacagtggatgtcccagctggcagccctgaactactacttagctggcggtgatgagcagaagttgctagacttgtcatctctcctccccagtgagggagcaagatgggctactgctgatgtcagaaatgcactttcaggaaacaaacaaaaaacgtggctacatctttttacctttttcctcctaattattcagtattggaagaacagtctgacacctagcctgctaatctttgtaacgatactcatgttagacattcaagtgataatgggcataaacatgtagagagataatgaacttcaacggagatgctacccaaaatcaagatgggaacacagatgttattgaaaagctgtcagaatgttaaaattcttctttgggtaatgacagggacctcaacatttagagaaaaggccaaacatatcatagctacatgggcctagcagtatatcaaatgttgtaaacacttctgtagtctgtagtcagaaaccacctaaagacagcccagctatcctggaaaatagctatagtctt

SEQ ID NO: 78857 - DNA, 1051 bp, Homo sapiens
gtgaggtttcaccattttggccaggctgttcccgaactcctggcctcaattgatctgcctgtctcattctcccaaagtgctgggattaaaggtgtgagccactgtgcccggccaaggtgaatttttttttttttttttttttgagacagagtctcgctctgtcgcccaggctggagtacaatggggcaatctcggctcactgcaatctccatctcccaggttcaagcgattctcatgcgtcagcctcccaagtagctggtattacaggtgcctgacaccacgcccttttgtagttttagtagagactgtattttgccatctaggtcagcctggtctcaaactcctgacctcagatgttccacctgcctcggcctcccaaagtgttgaaattacaggcgtgagccactgcgcctggcaaatttttttaaatactgataggagctttgcggaggattttagttttcatagtagcaaaccatgtaatgcgaaataatgtatctgaaagtaggaaagtaggaaagaactgtttctaaaatgataaagatttacaaaagagttatgttaatgagagacaatccttgctgctatgaacgaccctcaaacctccatggagcactgaataagcgtgtctgctgtggtttgtttcagatggttagctcttttcctgtctctgaaagcctcctacaggctccatcagctacgctcctggggagcgccagaaggggagagccaccagagatacctgaggaacaaggatttccttcttggggttaattttccactctcctttccaaacctttgcagctgccctttgttaaaggtaagcaattatttgagcataaattacctacttagtatcttctttccttttccttgaataagtaaaaataatagtaaagtaaatgaaggcctgagagaaccaaaaagttcccagaggagtgggcggtgcagcatattgagttctaacttaatttacactttgtatatatatttttgagtgtatttatattttcaaaatgttttttttacaatactgtgaagtacacagatc

SEQ ID NO: 78858 - DNA, 1763 bp, Homo sapiens
ggatttaggaaatactagaacatgaggtgtgagagagcattcagaggtgagttaagtttgtctttcccaactgaaggaatggtaatgctgttaaccaatttagtaaattgtggaaaagagaactgtttttctgacacatcacatatgccattgctgcagactgagtggtactcttagagttagtagttgcaggtactggcctgggttatgtttgggaatgtacttttgtatgttactgtgatgggtgttagttggcacagttagaaatggaagaaattgcccagggaaagcaaatggaatgagtgatgaagagaagagggccaaggaatatacatttttttctgaatgattgtccacattcacaggtttatagagatactgagttcacatatgtttattctcaatcataatatggtttgtgtgtgttttcaactttaagctgatgctgaattttcttaaaaactacttttccaaatataaatgttcttattgatttttagattgagattctaatgtattgccaactgaccagccgacagaagctgctatatcaggcactaaagaacaaaatttccattgaggatttattgcagtcttctatgggctctacccaacaagcacagaacaccaccagcagcctcatgaatctggtcatgcagtttaggaaggtaagagcttacgtcagttcccttgaagttttgttttttgttttttgagatagaattgtcttgctctgttgcccaggctggagtgcaatggcgtgatttcggctcactgcaacctctggctcccaggttcaggcaattctcctgcctcagcctcccaaggagctgagactacaggagcctgccaccacgcctggctaatttttgtatttttagtagagatgaggcttccccatgttggtcaggctgctctcaaactcttggcctcaagggatccacccgcctcggcctcccaaagtgctgggtgagccactgcgcctggccttgaagttgtctttattaacctttttcaagaaaaacagtctatccttgatgccagataagcaaaggctattaatgagatgaaaatgggaaagtatccattcccaaaggtaaacatttgggatttgggatcccctgtcattacgtatgatgtctgcatgtggtaatattgtcttaccatttcccttccttttaggtgtgtaatcacccggagttatttgaacggcaagaaacttggtctccatttcatatttccctaaagccataccacatttcaaagtttatctaccgtcatggacagatcagggtcttcaatcattcacgagacaggtagggaagtattactatctgttcactattagtgttttataatttacagttttatggcttagtagataaatttagtggagagaatatgagttcccagcaatgagacatttaagcaaagggtggacaactatttgttgagggatcttatggaaggaatttgagcactgttaaaacttcagctaggtggccttaaaggccctagtcacttctggttcttctttgaatcaggaatgtgcaccaatttgtaaatatgtacttgcagcaagtatgcatatctatgccccattgctgaaattggtttgtggtggcttactttacatttggaattgcacttgtgggtgaactgattgtattgtaagttaatcaaatttacctttttctcagagtcagcaacgataaatttagtaaagtttgaagtggttgttaaggtaatgcactagagacgac

SEQ ID NO: 78859 - DNA, 1002 bp, Homo sapiens
gtgtttattacacagacatgagcttgctcactattagaaaaatccttatgtgattttacactatgagttgttaatttgctgacatcctttggaaggtaatttttggggaacactgagagtctcagataatttttcttatacttacaaccctattagtgataaaatgtccctaaaacctaaaaatgaattctaatgaaaatagagcctagtatatttatcctgttgactatagcaagatggtataaaaaattaaaattccttgctttcctacttgggaaaaagtttcagtctgcttttagagaatcattgagccaaaggagttttgaagagtttggtgagaggtgaatgtggtatttgtttctgttgtttttgtgaaatcactataatgtattatttgggggcctcccggcatttcagatcaactttctcgcttacacatgattttgaagccatttatgctgaggagaatcaagaaagatgtggaaaatgaattatctgacaaggtaagtaaagaagacctcatgtgtttaagcctcaataggcaccaacttaagattccagggggagaaatttattgatatatgtttagttgaagtttgcttgaaggaagacgtttaaacttgcatggatcaaagaggacttaaaatgaggcaaataattgaggaaaataacatctttttttctttttttgaaatgctttttactggagaatttgaaacattacaaaaatagaaagatagtataatgaatccccttgacccattgttccgtgacaataatcattaactctacctctctcttattcaaaagcaaatcccagatgttttataaatgaatatttgtttatgaagtattttcatgtatatttctaaaagatttggtttttttaaacactgcctaaccacatgccattatcacacctatttaaaaagaccagttccatgatagcatcacgtatctagtcagtgttcagatatctccagttgtctttgtgtgtctgtc

SEQ ID NO: 78860 - DNA, 1003 bp, Homo sapiens
tggttattaccagctatcagctggtggtgcaggatgtaaagtatttccagcgggtcaagtggcaatacatggtactggatgaggctcaggcgctcaagagtagttccaggtaacatgagtagtagaaaccaaactcaatgcattgggttaagtacacacacacacacacacacacacgcacacacacacacacacagacttgtatatatgaataaaatcaagatatgagaagttttatttaatttttttaatagagacaaggtctcgctttgctgcccaggctagtcttgaactcctggcttcaagcgatcctctcgcatcggcctccccaggtgttgggattagagggatgagccacccgtccaatatatgagaggttttaaatatgacgtgacatgatctctgcatcagtcgtgtacctgatcagaaggcaaaaattccctttttttattttttcatggaacacaaatgttaatgccaagaataccaagacttttctcaacttttatctccctgttcaagaaggtgacatttttacaggtcatctcttcagggaaaatttctatagaggaaggagtctctgcccttgctttaaggtattattttagataggagttctaagtaggaggtagaatgttaggttatgtggattggatgctctgtttgttttatgttgattatctgagaccctggatggttttcagatctccaagaatccttttattctaagttatgtgtttaaaatattccaatacctttgaggtcccaaagtaaataaaaagtgttatttggtgatattaaacctcaggcttgatattttttttattaactcatggtgagtcgttagaaatttattagaggtccatgttaactggctagatgatattttctgtagaactttgttttttctattcttttctttctttctttttttttttttttttttttttgagatgtagtttcactcttgttgcccaggctggtgtgcagtggcgcagtctcg

SEQ ID NO: 78861 - DNA, 1375 bp, Homo sapiens
aaaaaaaaaaaagtacaatgtagtagcattaggtgcattcacaatcttgtgtaaccatcactgctgtctagtttcataactttttcatcagcccaaacagaaggcctttacccactaagcaatcacgttctattcaccttgtgctgtagcctctggcaaccacaaatttgactgctgtggctggatttgcttattctgaacactttgtgaatgctgtttctgtctggcttcttttactgagtataaagttttcaagcttcatccatattatagcatgtgtcagtgctttattcctttatatggctgagtaatattccattgtgtatatatatatcacattttgttcatccattcatctgttgatgaatatttgggttgtttccaccttttggctgttgtgagtagtactgctatgaacattcctgtgcaagtttttgtttgaacacttttactgttttcacttcttttgggtatgtacctatgagtagaattgctaggtcatatggtaattctacttattaaggaatcttccacctgttttttttgttttttgttttttgttttatgacacagagtcttgctctgtcgcccaggctggagtgcagtggcgtgatcttggctcgctgcaacctccgcctcccaggttcaagcaattttgcctcagcctcccgagtagctgggactacaggggtgtaccaccacacccagctaatttttgtatttttggtagagacggagtttcaccatgttagccaggctggtcttgaactcctgacctcaggtgatctgccctcctctgcctcccaaggtgctaggattacaggcgtgaatcaccgagcctggcctgctacctgtttttgaatggctgtaaactaagaatagtttttactttttaaaattattgataaaaaaataaactttcatagaatgtgacatacaaagttgaaagtcatacgtattggaacacagccccacactgcactctttttctaccttttttttgagacagtgtctcgctctgtttcccaggctggagtgcagtgacatgatcttggctcactgcaacctctgcctcctccgggttcaagcagttcttctgcctcaagctcccgtgtaactgggactacaggagcctgccaccatgcccagtgaatttctttattcttagtagaggctgagtttccccacgttggccaggctggtctcaaattcctgagctcaagcgatccttctaccttggcttctcaaactgcttggattacagacgttagccaccatgcccagccagcttttttctttatctgatgtcttgagatggagcttagagtattgattttcagcttctaatagatgtacatttaaggatactcattgc

SEQ ID NO: 78862 - DNA, 1173 bp, Homo sapiens
gcccccagaatagctgggactgcagacacatgccaccacgcctgactaatttttgtattttttgtagaaacgggctgtctccatgttgcccagactggtctcaaactcctgggctcatgcgatatgcctgcctcggcctcccaaagtgccgggacgggcatgagccactgcacccagctgatgtctttttgtttttttgtaacctggagatcctactggagaatatttgtgtatttcttatggtttgtcttatatggacttggtaaatctaattgcttttgtgtctgggttgtattagctaacagattggccttgccctgtctcatgtatcatggttcatagttgtagctgtagcattggcaaaagcaattactatagcagtgggtaaaagtgctgaggctgagtatctctggtcacttctctttaaacaagcctgttatcttggtcgttctttttggtaacaggttgaactttatttgatgaaatgcatgaggtgttgaccatgtattttttttccccagggtattaatggcattcttgctgatgaaatgggccttggtaaaacagtacagagcattgcccttctggcccatctggctgaggtgggtagatgcaatctttctatcttcatttctctagaatttagggtaatttctgttgaaaatcagccacttaaaagcactatgttaagctgtgtagcattccaagatagtgggactgggttcttgcctcagagctttataaggggacagtgttttataactttttggtttttaagagggctaggacaatttttgagcatgtgattttgagacactcctttccgctctgcattaattaccaccagtgtagtggcaagggccatatagttagatcagaacaccttgcctaacatttcagctctactcttattaccagtgtaaacttgggcaatttagcctctttttcaacttaactctctgaggcttagtttcctcttcctcttcctcttctatggagacgttatctactttataggaattttataagaattaaattttaaaaatgcgtaaaactgaaaaaaaagcaaaagctctatacctattaaataactacaagattgtcggataactagtatagtagaaaacaatacatacaagtcagtgtgtcatgaatgctttgtggataagacct

SEQ ID NO: 78863 - DNA, 2223 bp, Homo sapiens
tttctcctaatgattcctgtatctggatgccctgctctctcagccttgcagattggccctggtaagcaacatgtttttaatcaggatagtgctaaggtttaggtattgtaacatttttctagtccacttcaagccttacatgtaacttaacatcttcccaaaagtatacagaagactatttaaggcatccacaatgctgacttattcttcttgaatgcttctttaatcgttttatgtatggcgttgagacaatacatctggatgacttatagaagtaatatatcttgcttggcttgacattttctaaccctctaggaattgagtaaaagactgttcattctacatagtcttagttcaaaaatgaatcctaaatgaaatattgttttttaaatattttaggcaaataagcagaaagcttcagctcgtaacctgtttctcaccaatagccgaaaggtaaaattgtagttttgtattttccatttcatgttttgctggaatatattcttcttctttggggtccatcttgctgctcttgtccgtcgtaacctgttgatcatgaatctaatagttcgtaagagagtttctgaatgttctcaagctgtttattttttatttttattttttgagacagagtctcagccacccaggctggagtgcagtggcagtgatcttggctcactgcaaccaccgtctcccaggttcaagcgattctcccatctcagcctcccgagtagctgggattataggcacctgccatcatgccctataatttttgtattttagtagagacagtttcaccatgttggccaggctggtcttgaactcctgacctcaggtgatctgcctgcctcagcctcccaaagtgctaggattacaggcatgagccaccgcgcccggcctcaatctgtttattaaataaaattgttcttcctcacatttctggtatttgaacctttttggataagaccatagcccaccctgatttcttgagcagatcatggaatcttcctgtcttcagtctcgtctaagaaataatgatgtgaataccttcccttagaggagactaaaacaacttcctttaagaattgtgaggatcagattaggccatgttattagttgtgtttctctggggtagtcattcaactgtgtttcctcatttataaatgagggtgatggtaatgccaatttcatagggtttttgtgaagagtaaattggtttaatatatttttcagtggtgctaaagatgtaataagcagtgatagctgttattaatgtgtgcaataacattttgtaacttccaagcacatcccaggtccttcttcatcattataatttttcatcttctaaggtgatagaaattggatagatttcttatccctgataataccacagggtctgggcctatgtcacagtactgtacaaggacattaatcaagttgcaggagaaagatgtggtcaaggatgacagtttggctgaacagattgaggaatgatgtggtttagagtccaggaagaaccagcttctggtatggggtcctttccgctgtaatgctgttgttgttttcagcttgctcaccagtgcatgaaggaggtgcgtcgagctgccttgcaggcccagaagaactgtaaggaaaccttgcctcgtgcccgccgcctcaccaaggagatgcttctgtactggaagaaatatgagaaagtagagaaggagcaccgcaagagagcagagaaggaagctttggagcagcggaagttggatgaggaaatgcgggaggtagggcaaaagcataacattttgaaaaccctaattactacagccatttgaagagattcgtttgcattttgaaaattgtacatctaaccaatgacactgtcaattttttgttttttttttttttttggtagagatgcggtttctccacattgcccaggctggtctcaaactcctgagcttcgagtgatccgcctgccttgatctcctaccgtcagaaatttttttaaagacttaattttgaggatggtgattttagactagtaaaccaattctgcttttagtcttttggtaaggccctcctcaggcctttttctcttttcttctaagctgtcttcctctattctgggctcttattcctcaagaaaaaggaatgagcaaaagagaaagaaagtagcttttaattcatcttggtttgtttgtaggtgctgactgcagttttgctttttttgga

SEQ ID NO: 78864 - DNA, 1022 bp, Homo sapiens
ctactaaaaatacaaaaatcagctgggtgtggtggcgtgtgcttgtaatcccagctacttgggaggctgagacacgagaatcgcttgaaccaaggggcggaggttgcagtgagcccagatcatgccgctgcactccagcctggcgacagagcaagactctgtctcaaaaaaaaaaaaaaaaaaaaaagaaaagcaagcatgaggaaccttagtaaatctgaggaactgttggtaatagaagtatggcttatttcttggtggtgaatttccaaggggagacatttctgcaaggaattaatttcatgtcttagtatatgtcaggtttaagtaagtatgtagaaattcagaagcatgaagagttttgctttcttaaattattttcagtgacttgttacgtgtataggagttgaactcattttgtttgaagttaagtaagtgattcccttagatatactagatgttactgatctctttgtgggaagaatactgtatttaggagctatgatttcctctggcttagttttctgtagtaaaggtaatttgaaagctgtactatagaaaacaggcccatcatggtctttgcctgcttcagttgcagcaatatcagtactacagtgcaggcctgctctccacatatgaccctttctatgagcaacaacggcacctacttggacccaagaaaaagaaatttaaggaggaaaagaaacttaaaggtgagcatgttgaactgccttccacgtatattcattcttagtttcagaattgcatgtggcctactggtgcatttggactttatatataagtccatatggtagaaatttgctttatctgaaaaactctcctttctaattagtagcaagtacagttttccctttggtatccatgggtgattggattctggacccctggcaggtaccaaaatccagagatgctcaaattcattatgtaaaatggtatagtatttgcatatgagctgtgcacatcctctcgtatactttaagtcatctctggattacttataa

SEQ ID NO: 78865 - DNA, 1092 bp, Homo sapiens
tactaaaaatacaaaaagttggctgggcgcagtgactcacgcctgtaatcccagcactttgggaggcccaggcgggtgaatcacctgaggtcaggagttcgagaccagcctgaccaacataaggaaactgtgtctctactaaaaatacaaaattagctgggcgtggtggtgcatgcctgtaatcccaggtactcaggaggctgaggcaggagaatcgcttgaacccgggaggtggaggttgcagtgagccgagattgagccactgcactcttgcctgggtgacagagcaagacttcatctcaaaaaaaaaaaaaaaaagaatttctaaaattctctggaatcaatgaaattaaactactaatacttcggatgtactagactaaaagatatgttcttaaaaaaaaaaagatacatcattttaactttaggtagcagtggagcagctttattgagatgtaattcacataacaaaacttcagccttatatagtgtgcaattcagtgtttttttaatatattcatagttgtgttactatcattactgcctaattccagaacatttgcatcacctcataaagaaaccgcatgcctcttagctgttgcccctcattctttctgtccctcagtccagacaaccaccaatccactctgttccttttttcttttttttggacagagtctcgctctgttgcccaggctggagtgcagtggcgcgatcttggctcactgcagcctctgcttcccagggtcaagcgattctcctgctcagcctgctgagtagctgagattacaggcgtgtgccaccacgcccggctttttttttgcgtttttagtaaagacgggttttcaccatgttggccaggttggtctcgaactcctgacctcaggtgatcctcccgccttagcctaccaaagtgctgggattacaggcgtgagccaccatccccagcccaatctgctctgtttctataaatgtgcccattctagacatttcatacaaatgcaatcatgcaacatgtgcctgtgtccagcttctctcacttaatgtcatattttcaagattgattaatgttgtagcatgtatcagcatttc

SEQ ID NO: 78866 - DNA, 1034 bp, Homo sapiens
tgaatcctatcataatgtgaccttttatgattgacttctttaattgagcataatattttcaagattcttcatattgtagcccctactcatgtgttattccttttcatggctgaattacatctcattatctggatattccacattttatttatccatttatcaataaatggatatttgggatatttctccttttgggccattacagcttgctttctatatttttttataccctataggtagttgttttttttgccttcctgtttggcatgtatgtatagtttgtatgtatatgatatttatgtattatttatacttttgtaagtattcagaggaatttttagccttgttgctgataacatgtcccatgttttattgcattttagtttgtattccctaagtttaattagtattcttaatgtttttcagttgaatttataaagcatgtcataaggggaactggagtgactatctttctgctgtttttgtcattgttttggatctaggaaaaaatgcttggattataaatgggattgcttcacagcaaaagatacatttctattttcacccttttcagagcattctgctaagtgatgaatccagcgaggctgattctcagagtgaagacgatgatgaagaagaactcaatctcagcagagaagaacttcacaacatgcttcgactacacaaatataagaaacttcaccaaaataagtatagtaaagacaaggaggtaagagtttcaggagaaacacttcaaactgaatattcaccctctgctttatagtcattaaagatacatcattttggctgggcgtggtggctcacacctataatcccagcactttgggaggacgaggcgggcggatcatgaggtcaagaaattgaaaccatcccggccaacatggtgaaaccccctgtctactaaaaatacaaaatttagctgggtgtggtggcgtgcgcctgtagtcccagctactcaggaggctgaggcaggagaattgctcgaacccagaggcggaggttgcagtgagccg

SEQ ID NO: 78867 - DNA, 1971 bp, Homo sapiens
gagatatcttggagatgggacccaagttaataaacaccaaattcatttatcttttatatacaccttatacacatagtctgaaggtaattatatttttcccttggggatgttgaataaactctgttttgtatacctgtgttttgactgtgacctgtcgcgtgaggtcaggtgtggaattttccacttgtggcatcttattggtgctcaaaacctttgagattttggagtattttgggtttttagaatagggatgctcaacctgttataacgtactgaggggaaacaggaagtacaaaaatttatcagatgaagtccttgcactcattgggtcacataatcaggaatattaattccataagttccataatttatattaattccataacttccataagttcctgagtagtttattcatttaacagatgttgatttagtgcatccatgtgcatgtgccaggtacgattatggttgggcaagtttcctgcccagtggtgcttacattctaaaggaggcaggcagttagtaagcctgtaaacaagtaaataaacatggcttctttaaagacgtaacatttcaactgattctgaatgatcacagagaaccatcttatatccagggtaacggcatttcggtcagaaggaacaactgcaaaagtcctgagaaaagaaacaacttagtatgtttggtggaaaaagaagtctaatatggctagagcacagtgaatgaggaggatggtggaagatgaagttacaagactgtgatcacacaggctttgtctatgttaaggagttcgtgttttactgtcgtaggcataagccgttggagtgtttacaagcagagaggttgttaatctcatttacactcttacaagattactgtcagtggccaaactgaattaaggatagtatttcttttattgaaactaattatttctcttttatacttttgctatgaagtactcaaaagcaattaaaacccttcattattatcactaggtccttcaaaaggctcatgtgtaaaaggtccgatttggttaatatcagttgcactttaggctgttggaaatgcagaaattgttatgcttagccgtcatattttgaaaaattgagttataattcattgtcataaaattcaccttttcattttattttatttttatttatttatttttgagacagggtctcactttttcaccctggctggagtgcggtggcacaatctcagcttagtgcagcttcgacctcctgggttctagtgatcctccagcctcacccctgtgaagtaggactacaggcccgcaccaccacgttcaactaatttttgggggtttcaccatgttgcccaggctggtgtcgaactcctgagctcaagcaatctgcctgcctcagcctctcaaagtgctgggattacaggtgtgagccaccgtgcctggccaaattcacccttttacaggttaaaatttagtagtttttcgtgtatttacaaagttgtatacccatgattacaatgtaatctcagaaaatttttaacattctgaaatgaaccccgtacccgttagcagtcactctccattttcttttttcttttttttgagacggagtcttgctctgtcgcccaggctgtagtgcagtggcgtgatctcagctcactgcaacctctccctcctgggttcaagcgattctcctgtctcagcctcctgagtagctgaaactacaggcgcttgccaccacgcctggctaatttttgtatttttagtagagacagggtttcaccatgttagccaggctgttctcaaactcctgaccttgtgatccccccgcctcagcctcccgaagtgctgggattacagacatgagccactgagcccggccggtagtcactctccattttctatttcctctgtcctttggcagcgactaatctgctttttgtctgtattgatgtgcctcttctggaatttttgtttttgtt

SEQ ID NO: 78868 - DNA, 1755 bp, Homo sapiens
ccctaatgttgtctttaacaatgtaaggtagcaaagagaatgcttaggctatacctgtgtttctcaccctcacttttactcttttagctccaattttctaaatttaaattttactcattatggcatttttacaaaggatagtaaaatactctgccaatacatctattcccttgtaaataagataccttacatatatgtatgaatatgaattcaaaatgaagagggcagcacctattttgaaggtgatgctgagaacgagtgctcctctagtactttcctttctgaggtgcacaacagtgagcttggggtgtagatttggatagttgtttattcatagttttgggtaattttttattgaaagggataaaggaagtgggtatacattttaagatactgttttgaaaaagtatagtatgaattttcattgtgaaatgtaactgtgttgctgtatttttatattctttatatccttttaacttctgcctttgctttaggaggcagtgtctaacaagagctttatcatgatctttctgcagactcctgtcttttcagtgtcttgtgttctagaaggtctgatttctcttcacattgggaacaagcaggcaagagaaagggagaatggatagtaatttcatctttcacttcttatctctgttctgcagccgtgcagtcggaggtccttgtgcatgaagacagatttgttctatggcctcggagttgggtgccagggatgatggaggctgcactgagctggcaaagcccctctatcttcagtacttggagagggccctccggttggaccattttctgcgacaaacgtcagctatcttcaataggaatatttctaggtatgttattgtatctttgcaatatgttttaccaaattcctgatttccatcatccttacagattttacaggattaaagtatcttatgatttttatgtttgatattttcttttgcctctttcaaataaaaaagtcaatttatttcagaggaacagtttcttctgtaaagtgtccagttctaactttaaattatattttattgggtcagctgtaattgtggactcattcttcaatttatagtgatgacagtgaagatggactggatgacagtaatccattattgccccagtctggggatcccttaatacaagttaaggaagaacctccaaattcattgcttggtgaaacttctggagcaggcagttctggaatgttaaacacatattctctgaatggagttctacagtcaggtcagtgtggtgtgacatccccctttggactatcgttatcttggggcagtcatcctttaatttttttattctttgtgtttctttatacagaatcaaaatgtgataaggggaatttatataatttctctaagctgaagaaaagcagaaagtggctaaaggtaagagataaagcagggtgtttacagtgcagatagtctactaaagttactaatagatgggaaagttatcaactcattttggcagattgacagagtttttcaaatatgattctcttatactggatgtggtttttttgaagagattattgagaaaatctggaggattcaatgaagtcatttagcaaacatgaattgagtacaggttgagtattgctaatctgaaatgcttgagaccagacgtgtttcagattttgtttttgagacaacattttgctcttgttgcccaagctggagtgcaatggcatgatctcagctcactgcaacctccgcctcctaggtt

SEQ ID NO: 78869 - DNA, 1034 bp, Homo sapiens
gagtgctgggattataggcatgagccaccgcacatggcctcatttgcttttaatgccaaataatattctgttctagttgcattttatgtttgaaatttccaagctcctcctcctataaaacaatttgagatcattatgtgtggtaaaagttgcataccttctagactttaaaatgaatgtttttttttttttgttttttgagacggagtctggctctgtcgcccaggctggagtatagtggcgtgatctcggctcactgcagcttccgcctcccgggttcaagcaattctcctgcctcagcctcctgagtagctggtattacaggcgcccgccaccacacccagctaatttttgtatttttagtagagacggggtttcaccatgttggtcaggctggtctcgagcccctgacctcgtgatccacctaccttggcctcccaaagtgctgagattacaggcgtgagccaccgtgcccggctgaattttgtttttaagggattgaattccatcattttagcttactgtgttcttttcctctacgttttatttcagtagaaaccaaatcaatttttgaaagtctgtaaattgtgataggaaataattgtagtgagcacaaatgtgattagaaaagtttatgactaataaaaacattttgagtacatcaaggtggaaatgtgattaagccaaagcaacaaatcgagagctattctgctgggcatggtgtctcaagcctgtagtcccagttactcaggaggcaagaggatcacttgagtccctagtgagctatgattgtgccagcgcactcaagcctgggtggagagcgagaccctgtctctaaaaacaaaacaaaactaattataagctgtggtgttagaggttcacttaatgaaagtttgttggccgggtgcggtggctcacgcctgtaatccctgcactttgggagactgaggcaggtggatcacctgaggtcaggagttcgaaaccagcctggccaacatggttaaactctgactctaccaaaaatacaaaaaatt

SEQ ID NO: 78870 - DNA, 1223 bp, Homo sapiens
cctctcctcccccccgccatggctccccgtgtccctgctccgctcctctcagtgagtgaaagtggccgccgccgccgccggcccagcgcccgcagccgcctcagcgccgccgccatcttggggtcccaggagccgcggagggagcgagctaggagcgtccacgcccaacgcagtcaccgtcccacggcctcagagagcgaaccgcggctccaccgtcggcggggcgacccccccctccggaccccgcccgcaccccgccccccctccgccgccgtcgcggcggcggggccaggcggcccgaggtgaggcaactagacgtgggcgggcgaacggagtgggggttgtgtaggtcttgttgcgcccctctctgcgggcgacaactgggccgcgtcttaaaggggccgtcgcccccggcccttggatttgttggggttagtatggaggatgggtgtggacactccccgcagggttgggacctcagggactagggccttgtccttcccgtttcatatctctggagacccggggtcatgcggtgacctcagccacctgaggaagcccgtggggcgcccacacgtggggagtgtgttagaccaggtgcacgtgggacccggtggggcggtgtcgggctaacacgtgtgtaggtttgggggtgggcaggggcagggcggaggctggaaggccttgagtgggaaccccgtgaaggttgtgtatctgtcattttaaacaaatgagatctaagggcttgttagtgtgtcattttgtaaggggcaagttgagatacggttgaatggtgcacgctgctggctggtgttgggtgggggcaggctgacacctgcatagacttgggagtgtctagatgacacctcttctggttttttaggtttttacatagcgactaggaaagtgtcatcctattttgacattccttcttgagctcgctaatggaaagtactacttccgtaatctccgaggctagaagccccctacagtttaggaatgacagaacctaggcagccacttactattctagttaacagccaactgtgcctggaattctttgattcacacactgtctctagtttgatgtacttgttagaaatgggggaaggaatttggaggttgacctggctaacgtcacaggttacttttccagtcagtgactttcattatttcctccacaacaaaattattgtggcttttcagtggcaacttaaattaaa

SEQ ID NO: 78871 - DNA, 1027 bp, Homo sapiens
acggcggctcacacctgtaatcccagcactttgggcggcagaggcgggcggatcacgaggtcaggagatcgagaccacggtgaaaccccgtctctactaaaaatacaaaaaattagctgggcacagtggcgggcgcctgtagtcccagctactcgggaggctgaggcaggagaatgacgtgaacccggaaggcggagcttgcagtgagccaagatcccgccactgcactccagcctgggcgacagagcgagactccgtcaaaaaaaaaaaaatacttcatggaatagaattacatgtaatcagaatgactacataagacccttttctggtaatgaaagcatggagtcttaaccaaaaagctaagcagaattgttagatcttttggtttctgtcataatgcactattggaacttcaagtagatatagtacattaatatgaaatactttgaaatacaccatcttctaaaaaaaggcacttacacaaaaatcatgtaacactaggtaggatgttgaaatgactggtatgcaatatttttttaaagacttcatttttggtcagcataagttttctttaaatatttttctgtttccagttggacttcactttgaggcttaacatatcaaagtgagtataaagttctacaatttagtcattgtggattttatgtcatttatgatgaaaatggaaatgtgtagttaagaaaattttcttcttctgtaacatctaactcttcatcctcatcatcttctgcttgttgatcctttcttagtcgacaagtggatacctgtcttgttccagatacacacttagctgacagtgatctctgaagaggtgactttgaattcgctcttacagtatctaaacaagatgaataatctggtgcatacagagaatttcggaaaacctctaaatcttcatcttcatcaatgttttgtatattccggtaggcagcagtgtagacctctaaagctttgccgtgaaataacatttcgattgtgataaattcagaaaatatagtctttatat

SEQ ID NO: 78872 - DNA, 1024 bp, Homo sapiens
ggcccaaggattggttaagtttaagacagatttggtgaaacagtgttaaattctcttactcaattctcgcagccttttaattgtgcttgttatttttctcagaaggggatttagcatttaactcttcaaggatttttatgttttcttgggccatactttaggaatagttggcttaatgcagcacttcgaagaggacgacattttgggtgggatttcagaaagccccaccaaactgatttaaatcaataaggaactagttaggctcacgcaacaagaatgtttggcatagattgtccaggctggtacagtacctaactgatgtccaggaaccaggcttattctgtgttcctgccctggcatccatagctcatattactcacctcatggctccagggtggctgcagtgccaccagacagaatgaggtaagaagaatgaggaagggcaaaatgcaaaggactctcccttagtctttgtcttcttatccagtcacctagataagttctgcttacatcattgcctagatgagaagataaaggtttcagccttttagctgttacttagtcacatgatggtaaagatggggatacattctgagatatgcaatgttaggcaattttgtagttgtaggaacatcatagaatgtacctacatgaacctagatggtatagcctactacacacctaggctatgtggtgtggcctattgttcctagactacaaacccgtgcagcaagttactgttctgactactatatgcagttgtaacataatggtaagtatttgtgtatctaaacatatctgtggctgggcatggtggctcacgcctataatctcggcactttgggaggtggcagagggagaattgcttgagcccaggagttgaaggcctgcctgggcaacacagtgagacctcattcctacaaaaaaattttgaaaaattagccaagtggctgggcgcagtggctcacacttgtaatctcagcactttgggaggcggaggcgggcagatcatgaggtcaggagt

SEQ ID NO: 78873 - DNA, 1648 bp, Homo sapiens
gcggtggcttacgcctgtaatcccagcactttaggaggccaaggtgggcggatcacgaggtcaggagttcaagaccagcctggctaacatggtgaaacctcatctgtactaaaaatacaaaaattagccaggcgtggtggcgcgtgcctgtaatcccagctacttgggaggctgaggcaggagaatcgcttgaacccaggaggccaaggttgcagtgagccgagaccacaccactgcactccagcctggcaacagagtgagactctgcctccaaaaaaaaaaaaaaaagttacgttttactgcacaggaggaaggggggaaaacattactcagataagagcttgggagtgttgtaatcttcataacctttgtaactgttactggttttctcccccaggttttggagaaggtggatgtagaacagaaaatgagcatccgatttcttcactaaaggagaccaaactgttccttgcggtctagtatttaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctgctgaatgccacacatccatccagtctgagaaagtgagagaggcaatcatgccaagaacaagccagcaaagctctttcaccagatgtagactgtagccctgctgccttccctccagcgagtctgccagcatgcttcttcatcctttttatatgttctttgcttcctacttccctgtcttccaacatactgttcacttactctggcagtctttctgcttttcattaagcctcaaaatctcctctgttctacttggcaccacaagctatgtcctatatatgtatttctgacttggcaggatagttcaggggtctggcagtttttatttaccttcattattaaatgggcctctgggatgttgcctcttcaggagctttttggtaatcaatacttctctcagaagtatgagaccatcctctgcactctgctctgtcatcaaaggctgctgggtggagataccctttttgaaaggtggccttggtgagaggtatggagccaagtcttctaggttgcttgcccacatcactctatctctggcctctgattctcaactttgtacctgtgtggctcctcttgttagtgcaatgttgactgttgaaaaagcagcagtatgcttacaggtttgcttagtttggggacaccgttaccaccagaatggctgctctgacaatatgcctagggactttctcatggcttttatttaataaggaggctgggcaccctataaagcctcatgcattcacacctttgcagcatggtttatgcctcagtgttatgtgcactggaatgttttccacttcacatttccaagtagaaatattagtgttacggaagtgcctaatatcccagtccaaatttttttttttttttttttttttttttgagacagagtcttgctctgtcacccaggctggagtgcagtggtgcgatcgctca

SEQ ID NO: 78874 - DNA, 1108 bp, Homo sapiens
ccgtgctcagccgcaaaattctttatgaattttacacttggcaaatgttaatgacggaagccatagtctgctcctaatacatgtccaaagcattgactgttgtgtcattagctgcctggttacattagctccctggcttcttgtttagaccactgctaatcccttaaaaacaagaggtctggcactagtagcacaacctaaggtggcattacagatctttgagcgagccacagcaacttttctgccaagtcagcttagtttagacttcagtgaatcaggctattgctatcctaatgtatgtctctatgagtgtatttagccacacatctgcccttggttgactttctgactcattgcttgcttgcttgtttccttgctttggaaaactattgaagattgctaaaaaataccactgcaaagtgatggaaaagggtggagaacaggggagtagccaggctggatggctcaaatataaatgaatgaggaattctttatgaagtatcagtcagattttatgattaagtgatgtaatataggaattatgtaaaagggaagaatgtctgatactgatctattagagaggtactttagaggcttcttgattggcataaagttcctaaggttatagattttccccccttttggctgtatagcaaagtgttttaatccacggttgtgccttattgttccattaaaattgtatcttcgatccatcaataaatacttgtggttgaaacaaaataacttttgtccattttacaagaattttatgtaacttagtcccttcaagtttgaaatcacagtgtctcccttactcaagtttatgtctgtacggtcagctgcagtctactctgctgctgcctggatatatgaagtggaaacattcatcgaggggccagcacttttggcttcgacatggttttgtcagccgtggccacttcccattcattccagctaagacgcaatttctattcttgactccctgactccttaaatgtagaaaaagcctaaaaatccagtatatgtccattccttaaattgcccacctcctcattcatgtgcagcctcagcggtgacatactctggttttacatggctttttctttgc

SEQ ID NO: 78875 - DNA, 1020 bp, Homo sapiens
agtcaagatcgcgccactgcactccagcttgggcgacagtgagagactctgtctcaaaaaacaaaacaaaacaaaaaccctcgggcctgagaatgaaattattagtactacagtttaacctaacagtggcttaaaatagtcacgcggcctagccacactatcttaccacgtggtacagcttctacggcggaaattttacattcttaataattgaattacaaaagcatttctccctgttacctcaattctgggacccaatccggatcgaaagagtggggcgagtgctattgattgacgtgcattccaaccaacctacgacgcaaggagagcgcgcgcgagcaagacgatgcccaataaacactcagccccagcggcgggggcggggcttgtgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggtgagccgagaaggccagtgacggtgggacgagcaggcgccgaggaggtggcgtggcccagacgggccgggtacggaagcgcgcaggaacctgcgagttgcgggcagccggcctcggcctcggctgggcgggggttccaacctcggcggctccagggcagccgtcacccgccttctgggtgtgttgcacggcccacccctcagcccgtctcggtccttcccagtgccgtgcctttagccacctttgtgctttctgcttgcacccacacggggctgtatctggcagccgctgcttctgccatcgatttatttttcgaagaatatctttgttttattgatttacttatacccctcgccttaggacttcgttccccctctttgcccgtcagcggtatcagttgaggcctgttgtggctctgagtattttgtgtccccagcccgttgaccttgagacttgtaacaggtttcccttgggaattgcattcgggtgtgtt

SEQ ID NO: 78876 - DNA, 1120 bp, Homo sapiens
aggagatggaatttcacaaggtaatgtcatcagtcaaggcaggaactggccattttcacttcttttgtgattcttctgttgcttcagaccatctggatatatacgtgcaggcttgggctcagaggcctgacacaaaggtcttaagtaggggtccataaactactggaaattttatgcacaattatacatttttgtgggaagaagaaggtccatagtatcagattctcaaagaggacactgtttcataaaagcttgagaaccactgctccaagacttgacatctttttaaaattaatgccagtgcaggtagagagtaactgctttcttactgttccttttgaatagtttatgatattgatttttttttaacaatagcttgtctgtttgagtaatattgtatactaaaattactagcaccagtgagggccatatccttaatgttctttttctttttaggttccttatcacaggaagaaaattttccttgacctttaggtgcttttatattcatctcaaaaacaaaattctgaactcaggacttggcaagtaagtaattgtgggctaatcgttccaaatactgtttaagtagcttgaaaacaggtacatagaagtggaacaataagccgttagcttcagcagaagacgaacatgaaaaatgactgtaagctattgaaatttaagttaaatcttttatttttcaacaaaagaaatgtattaaataaaaaggagtaatcttgatcatttgctcaaactaccaataattttcactgtctaaagaaaacagacacatatttaattagattgaaggaaatcaaatgattaaaaaataggcctggcccggtggctcacgcctgtaatcccagcagtttgggaggccgaggtgggcagatacttgaggtcaggagtttgagaccagcctgggcaacatgggggaaccctatctctacaaaaaatacaaaaattaagcaggtgtggtggcacgcgcctgtaatcccagctacttgggagactgaggcaggagaattgcttgaacttgggaggcggaggctgcagcgagccgagattgcgccactgcgctccatcctgggccacagagacagactccatctcacccaaaaat

SEQ ID NO: 78877 - DNA, 1052 bp, Homo sapiens
gagtagctgggactacaggcacccgttaccacgcccagctaatttttgtatctttagtagagacggggtttcaccatgttggccaggctggtcttgaactccggacctggtgatccacccacttcggcttcccgaagtgctgggtttacagatgtaagccactgcacccggcctattcttttctttacattttagatattgttttgagtcagcttatgcaaaagtacctgtcctaatctttctgtttttattttgtatttctaggtgtctctatgttgtctcctagagtgggtagtcctgcttcttttacccagttactttcccgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatcccagctactcgtgaggctgaggcaggagaattgcttgaatccgggaggcgg

SEQ ID NO: 78878 - DNA, 4534 bp, Homo sapiens
tgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggttttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaaaaaaaaaaaaaaaaactgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagac

SEQ ID NO: 78879 - DNA, 1115 bp, Homo sapiens
cttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgcactgaaatctcattgtgtgtcgttacttgaaatgggtaattttaaataatgcagtacatactgatgatgggagaaggagcctttccaaagacctgtgccaaagtactcttcagatgttaaagaacaaaggaccaggttacttgagacctagctgtagcagtttccagtgtgttgtacaatggaacaggcagccattcaaacctcaatatgtaatgctgcttttacagccataaggagttttggaatactttttctaacatatttgtaattgcctttattttgtgtctctgtgtatccacatacatggagtttaataatagtattcattgagcaccaactatgtgataagcactgctctaattacattagatgcattaattaactcatttaatgctcactacagctctaattactatagtttttatccctattttacatagaaggaaattaaaacagataaa

SEQ ID NO: 78880 - DNA, 1041 bp, Homo sapiens
gcgcatttttttcattaactttcttttttaatataagcaaaagacaaaccttgattttagttctatgaacaatttgtttagtaaggccccagtcaacttgattatttttcaacaactgtgaatttatataatgatagccattttacatgatttgtagttttaaatgtttaaatgttaatcagattagttagctctttttgtgtttattaggggtaaattacctttctcttctgaagcgacaattatacatccatgattgctttgaccagaatatacgagggtatccgcaatccagcatgtaattaaattacaatctgagttaccctttcttgaatgtgacattctttccgtctcattcctattacaatgtaattttcaccctgacttaggtgttaggaatgcttcagagactagttattttttatttcttatatgattttttattcttacccatattgtgtttttccccacccctagtacttacaaccttttattctgtggttcttgtgggattcccgttggtttccatctgtattctacccatgctgccctggctgccttgagaggtcacttctgcctttccagtgacaaaatggtgtggtgagtagacttagatattgatcatcaaatacattttattttatttattttgagacaaagtccatcaaataaattttaaaaggtttttcaggaaagacaaagtaggctgagcacagtggcttatgcctgtaatcccagcactttaggaggctgaggcggtggatcactcgaggtcaggagtttgagaccagcctggctaacatggtgaaacccatctctacgaaaaatacaaaaattagccaggtgtagtggtagacgcctgtaatcccagctactcaggaggctgaggcacgagaattgttggaacctgggaggcagaggctgcagtgagctgagatcacgccactgtgagatcacgccactgcactccagcctgggagacatagtgagattctgtccaaaggaaaaaaaaaaaaaagtagctgggcatgctagtgcaca

SEQ ID NO: 78881 - DNA, 1147 bp, Homo sapiens
cccagccctgcggggccgagcggcgaggaccccttcaccacctgcgtatcccactccatggaggtcgtaaaagaagcttggtcaatcgccctctcagtgccaccacaaaagtccccccggggcggcgttgcacaacgtgagcgatgccgcagcggctgagccgccatcttcccgcagccggcgccttcctttcgaatacacgccaggccccgccccaagcacagctcctgcgtcctcattggacatcatgggcaatccaagcactggagtccgagtccgcgcactcgttacctgaacaggcgttacaggccctttggcgcctgcgtattcgtgaagtgtgaaaaaagcgcgcctctgttgggacgggaaatcagcctttctattggtcagggttagaaaccccgcctttgaggcattttcaaccaatggaagcgcggcattcttcatttaaactgtctataaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggtacggcgctggcggtgcgggtccctgggcgggcgcggcgggaatagcggcctcggggagatgcggtgcgaagggaccgagagggaagcccgggactgaggcagctctccctgcccctcgggcagtagatgtggttcacggtagtcccagttagaactctgataaacggaagaggaactgtagttttcacctcattttgaagctggcttgtctgggtgctcacatgataagctctattccgagggatggtttattgttttttgttttgttttgttttgaaattactgtatacctctcagggcgtcgattacgaaactcaggcccagaaagcacaaggggtgtcgttaatcgttagacaattaagtaaataattggctcagcttctggaaaaccccaaacagactccagtgatttgtaatattgccgataatctcttgatactttattgatggacctgtcagaaaaaaaaaatcgacttttaggggagcacc

SEQ ID NO: 78882 - DNA, 1043 bp, Homo sapiens
tttgaataaaaggataagataaaagaataaaaccagagtctacggaaagcaagcgagggaagccccttgctaatcatgtgatcacactgctgaaagactaagtacagggtgatcaccaggccagggacaaggtaggaaggagaatttaaacaaacgaaaaaacaacaaaaaacacatttaatgcttgtttctctttccttcctacctactacacctcacttaagtgaacactcaatgaatgttcatatttatacaacaaatatttaatgtgagcttaatacttaaaaagtgcttcctgaggcccaagccctgggatgcagtgatgagcagctggacttgggtctgggctttcatggagcttacagcacacagtaaccttacaaacacatgacatcacatgggaatttaaaaagaaatctccataaaagtatgccaattttggcataggtggtttattttcagtttgtatatttccattcacctgtgagtcagggtccacacggacagtcttgcaccttctccttgttttggtgacatggccaagtggctgtctctcagcttcttcctggttgctgatctgtatctcagtctcatcacaagaggatgcagaagtttgactttcatcctgaaaagagaggtattaatctgctatgtgctatgtctacagttataatgctcaggaagaatcagaattgagacagaataaaaaacatattacatatgcaaaagaaaaaatttaaaactctctagcggtaaattgtaggcaaagacaagaattatagagtatttaggccaggcacagtggctcacgcctgtaatcccagcactttgggagaccgaggcgagtggatcacctgaggttagcgagaccagcctggttgacatagtgaaactccatctctactaaaaatagaaaattacccgggcatggtggtgcatgcctgtaatcccagctacttggaaggctgaggcaggataatcacttgacccggcaaggggaggttgcagtgagccaagatggcgccattgcactccagcctggg

SEQ ID NO: 78883 - DNA, 1038 bp, Homo sapiens
aggggtcggggggagggtggtgtctggagcttattcctttggccttggctatttggacagcgttatcttctaactgtcttcaaagtgagctactaggcagaggaaaacttgttcttttctttttaactcttgccttgccacattctgggccttagtttttacttttcttggagtgaataaatgcagtacttattattatttaaatttctgcctcaatgtagtcacttgctcagtagactgtctaggtttcttcatttgtccttgctaacagagctaatcttgccatttctattttcctcttaatgtgccctagtatctcctgttctcaaatttacattctcgtgacagttgataaggcagagaaccaaatctgccaccaaaaatctcattctcctacttttcttcctttaaccccttttccccctcactttggtacttatctttggaaggcagcaattcttatttatcatcgaaatcttttatttcctttttaaatttgtagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaaacgtggaataaatggtatgtcaagtaactttaaaaaccaaaattgctagaagtagccaggtacattaatttcctaggactgttgtgacaaagcaccacaactgggcagcttagaacaacagaaatttactctttcatagttctagaggctggaagtccaaaatcaatgtgtcagcaggaccatgcttctctgagactctgggtggactccttccttgcctctgactactttgcgatggctgtcgacgcttggtgttccttggcttgcagctgcatcattaccagtctctggctctgacagcgcatgacattctctctctatgtcttcttaataggacagcagtcatattggattaggatccacccaaataggccaagcatagtggctggt

SEQ ID NO: 78884 - DNA, 1025 bp, Homo sapiens
gacagagcctaccatgtgaaaatactctgttaacttacacacgtttttttttttgtttttgtttttgtttttgtttttttagaggtggagtctcactctgttgcccaggctggagtgcagttgcgcgatctcggctcactgcaagttccgcctcccgggttcacaccattctcctgcctcaacctcccgagtagctgggactacaggcgcccaccaccacgcccggctgactttttgtatttttagtagagatggggtttgatagtttataagccaggatggtcttgatcttctgacctcgtgatccacccgcctcggcctcccaaagtgctgggattacaggcgtgagctaccgtgcccggccacatatttcttaatgagaacttttttgaaatccttcattatttctgtgtctttggatttaggtaacagagattcaaaggtaccttcagaaggaaagaaatctctctacacagatgagtcatccaaacctggaaaaaataaaagaactgcaatcactactccaagtaagttttgtagacaaagccataataagtaatggttgccccacttcggaatgatgttggactgtaacagctgaaagcatagaggctggaaccagtttacattctagttctctcgtcttttaggtttgatatcttggggaacttactcatcctcaataaactcacttcctcagtgcaaagtggaaatagttatactatagtgcctatttctttcttttttttttttttttttgagacagagtcttgctctgtcacccaggctagagtgcagtagcgtgagcttggctcactgctacctccacttcccaggttcaagtgattctcctgactcagcctccctagtagctgggactacaggtgtgctccaccacgcccagctgatttttgtattttcagaacagatggggtttcaccatgttggccagcatggtctcaacttcttgacctcatgatccgcctgcctcggcctcccaaagtgctgggattccaggcgtcagc

SEQ ID NO: 78885 - DNA, 1114 bp, Homo sapiens
caatttgccatatgtaaagaatggtaaagaatgggcttatttctctaccacacaaatgaatgacattcttttaggaacatacaagacctgttctcaccactcacctagcatagcagtcttctgctacctgtgacttcccctaacctggaggaggaggaggaggaggaggaaggggagcttttggcttgcctcttggactataatgaggcctccacacctattcctccatcaccatcattgtccaaggcagggagagcagaaaagacaagaacatattttacaaataatgttagttgatatgtgatttaatttagcattagccttttaggaatatgtctcttctgcaaaagaggttcgttcctatgacaattattaattgaggcccttttcactgcttgctaatagtcaagtggttttatttataagctagacacaagttactcttgccacagtactcatgtcttgtactctgctgtcctatttaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctggtaaaaaaaaaaaaaaacaaaagaaatctgtttcatttttaagccatgtaacttcccaaaatgattaggtatatctgttttttttgtttgtttgtttttttctgagatggagtttcgcttttgtcacccaggctagagtgtaatggcgggatctcggctcactgcaacctctgcctcccaggttcaagcaattctcctgcctcagcctcctgagtagctgggactacagacacatgccaccatgcccggctaattttgtatttttaatagagacagtttcaccatgttggtcaggctggtctcaaactcctgacctcaggtgatccgcccgcctcggcctaccaaagtgctgggattacaagcgtgagccactgcgcccggcctgtatctgtttccttaaaccctttccatttctataatcaaaagcaaaaattttaccatagtgtatttttaattgtgtactagtggggg

SEQ ID NO: 78886 - DNA, 1011 bp, Homo sapiens
aaaaaagcaacacataaacttcaagaaatttggtcccagttctttttgtaaaattgcaaattggttggacacagtggctcatgcctgtaatcccagcactttgggaggccaaggcaggcagattgcttgagaacaggagctcaagaccagcatgggcaacatgatgaaaccccgtctctactaaaaaatacaaaaattacccgggcatggtggcatgtgcatgtagtcccagctactcatgagtctaaattgggaggatcacttgagcccaggaggcggaggttgctgtgagctgagatcagatcacaccactgcactccaaactgagcgacagagtgagattctgtctcaaagaaaaaaaaagtataaatgttgatagcaggtaaccccacagatgaagagaatgaagttgggaatataaatcaaacaatctttttaaaattctttgtctctgtcctaaactaggaaagctaaaaccatgggggcaatctaaagaaaataattatctaaatcaacatgtcaacagaattaacttctacaagaaaacttacaaacaaccccatctccagacaaagtaagtacataattatccagctttataattattttaatttcaaaagcagcacctctgagggataggggctcagtaatagtggtgttttaagaggaggttagaagtggtattatggccgtgtgcggtggctcacgcctgtaatcccagcactttgggaggccgaggtgggcggaacacgaggtcaggagatcgaaaccatcctggctaacacggtgaaaccccgtctctactaaaaatacaaaaaattagctgggcatggtggcgggcgcctgtagttccagctactcgggaggctgaggcaggagaatggcgtgaacccaggaggcagagcttgcagtgagccgagatcgcgccactgcactctagcctgcgtgacagagccaggcgccgtctcaaaaaaaaaaaaagtggtatcatgggccaggcacggtggctca

SEQ ID NO: 78887 - DNA, 1042 bp, Homo sapiens
ttcagtggcacaatctcaactcactgcaacctccgcccactgggttcaagcgattctcctgcttcagcctcccgtgtagctgggactacaggtgcctgtcaccacacctggctaattttttgtatttttagtggagacagggtttctccatgttggccaggctggtttcgaactcctgacctcaagtgatatgcccacctcggcctcccaaagtgctgggattacaggcatgagccaccgtgcttggccggaattgcaattttaaatccaattctaaatatctatttgtaaaaggaaattaacataaaatgtgtaatacctaatacattttaacaacaaatttaacttcctccccttcagcttcttatttgcattcttgttatcagatgggaactagatcaaaattccctttccctgcacatcctaacaggggtattgatgccttcagtttgtctgttcagcactatgccagactctcagaataatcaaagaggaagatctctgccctctagacattttcacgaaagacctttagcacaagttcactgtcagtgctgcttgggggtctttaggaatcctaatgcattctggatctttcctgccccaaataccttgtgctgctccatctggttctgagtcttcactgggggtataacattagacttgctgtctagcgtatggtacttgtggaaggaacaaaccatgacagatcactgagtatctagtgtggattggaatgcagttcgtaaggaggccttttgtccctgggtttttcagatgggaatctgagccattatgtcaaaaattttacctccaatttattccttactgaaggtgagatatatgggccttctaggctggtttttcctggtggtaggggcagacctctgtgtcagaagccacctgggttgcttatttaaaatgtaggttgggacttagagggtgcagcagttcccatcctagacctactgaatcagactctcaggggatagaggtctggactctgcatttgtaacaggtatagctcaagtaattatgattt

SEQ ID NO: 78888 - DNA, 1054 bp, Homo sapiens
accatgttggccaggctggtcttgaactcctgacctcaagtgatccacctgcctcagtctcacagaatgttgggattacaggcatgagccaccacgcccagccccagctgttattcttgaaccttacttactgaaaggtattttatttcacttgtaaattcagttcagagtcactgggttggaatggtttctatgctgggtcctgagacctaggaatatgggtattccttgctcattagagataatttgctctctgaaatcttgaagtttctttactttcctgccttcatcatgctcaaaatactcagcatctcaatgccaccctattccagagcaaccagtccccgccttgtgtttcttcccatctttcagttgcgtgcccagaaggatagctgcttcacagaatggggacctgcttataacattctatacacactcagcgtgacatgggggaatatagtactcaccttccttgtttcactaggtaattgttgcccattaaaatacctgttacatcagtgagagtcaaactgctgatctctgttattaggaagaaaacatattccatccagtctctttttaagttttcttcattgcatatttacaaaatacttttctggtgttctgtggggttgcatacatgtacacctaggaaagcaggatgtcagtgtgtacaagagtcctgacaatggatcctttcctttacccagatggtttttgagcagtggtcattgggagatcctctggcctctgtacttggttcagatgcacaccggtgggtgctcattttctcattcttggcttatgtttggtgcatttgagggcagtttgaaggttataacagagcttacctttcagtagaaccatacttctcaaaacagattaagaagtgcaaggtcattttctctacttccttctggatggggaaagtataagagcatccctttaattctttcctttattctttagatcccatttactactacatcctggtgaaatcattcattttccctctgtctcagaatcaggtgaataagatttttgcagggatggg

SEQ ID NO: 78889 - DNA, 1019 bp, Homo sapiens
agtgcagtggcgcgatcttggctcattgcaacctccctcccggattaaagcgattctcctgcctcagcctcccaagtagctgggactacaagtgtgcgccaccatgcccagctaatttttgtatttttagtagagacggggtttcaccatgttggccaggatggtctcgatctcttgatccccccgcctcggcctcccaaaatgctgggattacaggtgtgagcccctgtgcctggcccgtagtctctcattttaaacatattccaacttaatgctatcaaatattttatattttgttgtaattaacatattaaatatttttaatgtacttaaaaggtacaccagagtttcttgcaggaaagccaaaatatctattagctcctttcccttagttcctttctcctatctaatagaaatcagtttttatatacatttcattgctacttaaaaaccaaatatcttttaaccagatttgaaatcaagaaaaaactaaaaacagccaaaaagaaagaaaagaaagaaaagaagaaaaagcaagaagaggagcaagaaaagaaaaaactgacacagattcaagaatctcaggtaggagattcagtgttcctcattgtccaaagaataaacctgttttgagtgtgtgtgtgtgtgtgtgtgtgtgtgtgtgtgtaaaaggtggatttatattaatcagcctaagtttataagacttgtgacatggtttcattaatctctggacatatcaccattagctgtgctgttaaatccttagcactttttcctttgctttcctttttccttttcttttttctttcttctttctttttcccttttcttcccctcccttcctccttcccccttcccttcctccttcccttcctcttccctttccctggtctcattatgttgcccgggctagaatacagtggctattcactggcacagtcataacacactgaagcctcaaactcctagtctcaagcagtcctcctgagttgctgagactacaggcatatgctacc

SEQ ID NO: 78890 - DNA, 1049 bp, Homo sapiens
gttgactgtaatggattttattgtaaattgacttttgaagcactgaccaagcccatttggtttccagtgctagctttgggatctcaatcttggcagctcattaaaacagcctgggatgattttatagggtagctaggattgagaaccactgcaataggtatatataggtggtacatagtctggtaaggttgctttgcttgtactacagtcaacatgcacatttcttggagatgctgtctctcttttatgtaggcatggcaatgaccaacgcgtgttccgtttagagtttgtctcaaaccaagaattcaccgaaagtgagtttatgaagtggaaagaagcggtacgtggctagagattacctagcagttgttcgtgcacgttgagaaaatatctttccaaaatcccttactaataatctcgtatcgtgtttttgatccagatgttctctgctggcatgcagttgcccactctagatgaaatcaataaaaaggaattatctattaaagaagctcttaattataaattcaatgatcaggacattgaagaggtaagaaaactggtgccccagaacccggaggttcatcaagaaccagtgttgagagaacatgattctcttttatttccctatatcttgacatttttagctatgcatgaaaatgagggaatactaatattactacctgattatttatagttcatcaagcttttttctatacattctcatgtccggatgaggctaacatagactgaagtgtattcagagttcagatgagacaacaaatgaggctacatacactaaagtgtatttagggttcaggggtctgtattctgctaggcttgatccttcaagagttttccttttctaaaacatcttggtaaaattatttgatctctgttctcttggacagtggctagccttacactaccaggcccttgggctgctgtttcttggtgcatgttccttcagcctgtcccagaagaatctccgtgacccaggaagcagcatagtatcccttggaatgaacccgctctctctctctctggggcat

SEQ ID NO: 78891 - DNA, 1045 bp, Homo sapiens
ggcaacgttccttggccattttccattccctaaattcaaactcatcttctgcgtgtgtgccagtcttcttactttctagtcacttcagtttcctttgtaataaaatagaccctggggtggtatttaacactgagtctgaacagacagatgacactgtcaaggccacctgtggctggtgattttccattcttcacactgggttggggtgggccttgttatggtggtttagccaccctgtgaggcctggggttctactgccaccagggacccacagccaggtagctgtatgggaaggtgttccccactgtactgtgcactactataatataaattatatcttgtatttgtaaagtacttctacagtattcttccacatctcctgtcctttgctcaccacatgagatatctttgcctgtgctggaagtaaggggatacttgatatggagtcagttgtatgtagccaagaacgaactcacacatctctctatgtgtaggccatggctgaggacctgggggatcaggacaaggccaaacaaatccaagatcaactgaatgagctggaggaacgggcagaggccctggaccgccagcggaccaagaacatatccgctatcaggtgtgttatggagcctatttttggcccgcagaccttggccaaaattatcaggcaagcctgtggcctgtacactctgtgctgcactgaccccatagatatctgagttcagggctcagtggttccctccctcccttgtttcacagccactgactcatccctcttaccccacagttacatcaaccagcggaaccgggagtggaacattgtagagtctgagaaggcccttgtggtaagaaaactttatctgaatcactaaaacaaagttaattaataaaccatgacatcttttctacatcttgcctaagtttattttttaattattgaaataacgtaggcacttaacgtatacacactctctctgtatgtccacgtacatcgatataatttattcataatgaaaagcagcagtcttctgccctgtcctacctc

SEQ ID NO: 78892 - DNA, 2121 bp, Homo sapiens
cacaccatctcccaccagcctcccctcccccagggccccacccagtgtgggcctgggctctcttgggctttatccatgtctttagatttgtgtttgccttttgtttttttaaccgcgcagttcattggccactctgcacgcattcagtattaccatggagctgggaatcttgctggagcccctggggcaatagcagcagcaccaggcggtctcctctacagactgccttggcccacccattgaacattcggcacgtgaccttgtggggggagcggggattgggcacctgcgatcctctttcctctcttcatctttctcttctgcccttctttttggaagaaggggtttcaaaaccagtttagtttccaaaaagtgtacatttgtggggggggggggtctaatttgagagcgagagtgtgtatgtgtgtgtgtgtaagtgtgtggatttttttatcatttttttaaaatgcagtactctttgtatcagtctgtcatgggtctatagctgtttcagatttttttcagctgtacttgagcatctgaaactgcaagaaagaaactcattaaatgtgattcttcttactaaacaggcctgactgctgtagctgtgtaacttccccattcccacctactcttcccatcctttcccaactttggagaaaactccccagtttagccccctgacctgcaggctgtgtcctggcaggtgtgggagggaagcccatggccaggtaccagggagggcagtgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataaactgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgca

SEQ ID NO: 78893 - DNA, 1036 bp, Homo sapiens
aatgactagagctagggttaaccccctctcctgaagcgtgcagggcagctcagaaactgtgcccttttcctccccagaccctgccagaactctgctcgcctcaggatgagctggatttcctcatggaggccctcatcatcaggtgcacctgggaccaggggcagggctggaaggcgggaggggaatgcccgggaacagtttctcttcaccctgaggctgaggtagcaagtcaggggacacagagggcctctccagctttgtggagcctaaaacatggtttccgtctccctcctggtaacgggatatgtcccccaccccactcagcaagtttcgccatcagaacattgtgcggtgtgtggggctcagcctcagggccacccctcgcctcattctgctggaactgatgtctggaggggacatgaagagtttcctgaggcacagtcggccacacctggtgagacccttgtcttagcccccccaggcccctctaaagaccctgtccatgtgtctgagacctacatggactgatgccccctctgcctgacccagggccagccatcacctctggtcatgcgggacctgctgcaactggcccaggacatagcccagggctgccactacctggaggaaaatcacttcatccacaggttaggagcagtcctggctcaggggacccccatcccaactccctccccaaggaacagcccttccacacagcttttaaggaaatagatcaggaagagcaagaacttctagattctggcagtgattttttttgcctactctgtagggatattgccgcccggaactgcctgctgagctgcgctggacccagccgagtggccaagattggggactttgggatggcacgagatatctaccggtgcgggacttgggaggtgggaaggctcttgctccaagggggttttccccgcaccttggtggtgaacaactcatcattcacctcctccctcctgtagggccagttattaccgcaggggggaccgggccttgctcccagtcaagtggatgcccc

SEQ ID NO: 78894 - DNA, 1299 bp, Homo sapiens
agcccttttggacgctgctgcagttgttaacagagcagccctgaatttggagccaggagacctaaattctctttcttccaccgacgacacttaactcttccgagcttccattacctcattagtgaagtgaggatcaggctaaccacacccaagaatgattgtgagacttcagtgtgactgcatggctaaaaaaatggtatctaaatcagttacacacatgtaatagccatccgctactgagtgtttactctgtgtttgatactcccttatgtatttatctacattttaagtattttacttggaccatgagatagatactattattatccttattttactctgaggaaactgaggcccagagaagttatgtaaactcatgcctaggcagctggctgtagtgtgcatcctcttaactgctacacagcactgcgcgggaagtagttaagggagcagagaggcacaggtctggacctaggagcctccaggaagttccaaagagctggcacagcctccaagtgctgtggttccagccctcatttttggcttttgggtcccattacagggaaagaacatcagggggtccagaggcagccgacttctctgaccagctgtcgttaggaagcagcagggtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctc

SEQ ID NO: 78895 - DNA, 4672 bp, Homo sapiens
atatatatgtgtgtgtgcataaataaattagctaagagaaggaaattctttctgtaaatgccttctttttggccctagtcaacattaacttattcattctacagccacttacattggaactgtgacctgaaaccaaagggataggcataggaacctgggccagtggactgtgagggatagagggaaaggtgggcaggtgggcaggtgggcctagtgaccccacaggtgtgagaaggctgggtcattgatgggccacaggagcacccagaaggctcaggcccaggctcggaagcagcttgtcctgtccttggcacccacagacaggcgatattcagcgggttccaggtctgtaggaggccagggaggatctaccctcactcactctcccctctaccttcgcctctagaccccagcttggttgctttcttgagatctcacagccacacgcaagagcaaacaggagagacagcctctgaggagcagaggccaggaggaccctctgctaatgtcaccaaggaggaacccctcatgtcagcttttgccagtgagcccaggaagagagacaagctggagccagaagccccaggtttgcaggaggcgggggtcatattttggtggataaaagtaggggaaattgtcccttttcctaggcctggcaaatgagagaagagagaagcttctgtgcttttggacatctaacattaatcctcattattggcttcaagtcagtcttcattgctgatgcatgtcttcttcctgcacatgcttcctgttttcttgtcctgttactgccccttctccgccttcccttttaagaggcagcaatgcgtgatggctgaatcccactccacccgctcccggcagactatcttcctgtccttgctgtagctgccccagctctggctctgtccatcccactgttctttctctctctgctcacagtgctgggggaaagatggcagggccagagtaataagagaggcagaatctgacaaagatcttatgaacatgccagaccagaagcagagaggccagtggaagcactcatttcccagaaactagattatttcattagtgattaacaaaataagaaattgaattatgagagccaggaacctcatgcccccggaggagctccaggccagctgagcaggttgggtgggggtaggcgtgaaggaggaaaatgctgtgggatttgtttctgtatcctgccccccaggagcagtatagttgcctcctcctcattgtccccactctcctactcctttaagggctggtactggaaagtggagatggtgccttcctgacatatgtggtcctccttcttcatctttttctcctttctttctctttcttccttctccttctcctcctctctcccctcccaacaaatccttggggtcagcaaggggctggagcccaggatggagtgtgtctgtcatatttgagactttcaccccagccccaggagttccagtccctgggccatgccatttagccataaccgagggtagaagctggcagatcctggaacagaagtggatgtggcagctgctgggtgatggtggggacccctgtggatagtgagctgagccgtttgggtaatactatcatgctttgtctccccagctctggcattgcccgtgacccctcagaaagaatggctgcacatggacactgtcgagctggagaagctccactggacccaggacttgccccctgtccggcggcagcagacacaggaggtgaggagggccacctggcctacaaggggtgggtgagatagggcaggagaggagctgctgctcttgccctcagaactcaggcctttctattgcccagagcctgagaagcatctctcctttgctctcacccacctttaccatcactctgcctggcccccaaggccagataagccccatttctggtagaagtagagtcagtacctaagtcctgaaaggcctgggattaaaggtggggagtgggtgtgggaaggttgctggagcccccagaccacagtcctctttctcttcccattagaggatgcaggctcgattcagtcttcagggagaactactggcccctgacgtggacctgcccacccacctgggtctgcaccaccatggagaggaggcagaggtgaggcatgggactggagaggatggggcagctcttttaacaaccccatggaaaaggatctctggtcaactgcctttgaccttctgtgtgccctgttctagttcatgcctttgctgtgcattcagtttctttttttggagacagaatctcgctctggcccaggctggagtgcagtggtatgatcttggctcactgcagcctccacctcctgggttcaagccattctcctgcctcagcctcctgactagctgggattacaggcgcatgccaccacgtccagctaatttttgtatttttagtagagacggggtttcaccatgttagccaggatggtcttgatctcctgagcttgtgatccgcctgcctcggcctcccaaagtgctgggattacaggcgtggcattcagtttcttaggctcaaaatcttgatcctctctccgtattctggtcagttgctagaatttgccgatcttctgtcacctcctcatgatgcctcctgcactgtggccttgcttccttggtctgctcactctccatgccctccattctccgcccccctgccattccatgtctctcggggctgctgtgctgatttcttctggcccagctcaggccatgccttgcctccagaagtttcccagcttccctctgctcacaaaataaggttctggtctcagctgggcaagatattccttctaccttttgtccctgctgaccctgctgctctgcctccttcacttcctgctacaccactctgctggcttctccccacatacctcctgtgctcagggccctccaggactccactcgctccaggaaatgcctttgccttttgctccatgtcaggccatcaaagctctacccatccactgagaccaatttaattttccaggttcccttctctctctctcctgtccgccggtcgcaaattaaacatcagttatcacgttcctctgcatctgcctcatggcatggttacttgtatgcaagtcttatctttaccggcttgaggctccatggaaagcagggcagatttcacttatttatctttgtctttcctgtgataccttgcttggtgttttgggggcactgtgctgtatcctggctgcttctgacttcttgtccctgccccagagagcggggtattccctacaggagctgttccacctgacccgcagccaggtttcccagcagagagcactggcactgcatgtgttagcccaggtcatcagcagggtgagtggattgccagcctggtcctgcccacccttcccttcaccccacagcctcagacttccccatctcctgcccttttcactctggctcactagccagctatgtgcttttaacaacctaggatcataggggggcaaacgaaggattagggcaaagcctctagataacttcagcatcttcagcaaggttttaccctcctgccctcaggcccaggctggtgagtttggggaccggctagcaggcagtgtcttaagcctccttttggatgctggtttcctcttcctactgcgcttctccttggatgacagagtggatggggtcattgcaaccgccatccgtgctcttcgggctctgctggtggctcctggagatgaggtaccacagggataggaatggggcttgggctgggaggtgccagggtccatattcctgttcctgggcatggccccattgctaaggctttgcgggcaagatgtagaatgggatggcaggcgtctccctcatctcctaaagtccctaaagcccaggaggcttgcctttatggtttttattggggagcatcctctctactcctggatccatttcctggccccttcagcattgccccccaactcccgttcctctggcaggagctcctcgacagcaccttctcttggtaccatggagctttgacgttccctctgatgcccagccaggaggacaaggaggatgaggacgaggatgaagaatgcccagcaggaaaagcaaaaaggaaaagccctgaagaagaaagccggcctccacctgacctggcccgacatgatgtcatcaaggtaaagggacagcttctttcccatcccatggcccaggggacaagcacatgctggaaagaggggccatcaatgcccagggtccagctgcatttgtcagtgggtttctctctccaactcccaggggctcctggctaccagcctgctgcctcggctgcgctacgtgctggaggtgacatacccaggacctgcggtggtccttgacatcctggctgtgctcatccgcctggcccggcattccctggaatcagccacaagggtgagaaaaaagggagcagggaatgggcaaaaagcctagctgggccttgtcttgacccacagcctcccttcctcccttttacctcctgtctcccataggtcctggagtgccctcggctgatagagactatagttcgagagttcttgcccaccagttggtctcctgtgggggcagggcctacccctagtctatacaaagtaccctgtgctactgccatgaaactacttcgt

SEQ ID NO: 78896 - DNA, 1082 bp, Homo sapiens
acttggccccagcagtgcttgtttattaattaccctaatgataacaacagcagtgctggcagcagcctgagacccagctgggggcgcccccaggcggcagcaggaggagagactcatgaggcactgtcaagacatggatggcaggggccagatatctctgtctctgtttctttctttttttttttttaattggcatatttgtttatttctcagtttgtgaaaatgttcttaatttgttgatgtagcaaacaaatttcaactttgattgctatgaaaaaaacaagataatctgctttgcaatgaactttatatagttaaactgcatacaggcaacatgctatatatgaaaaagttactaactgatctacaggtattacatactgaaaagagttaacagtttattataatttattttatttaacaatctaggaagttcgcagccatcagcagttctagtacaatttcaggtgcaattgggaattcaggaatctcgatggagctgttagtgtagcgaaccttgtaggtaaaatacatgcatactttcgatagcacatgtgaaggtatctctctaaaattgacctcattggtttcgttctcagcaaactgacctcacagcataaacaaaaattaacttaagaccaaagacctaaatttaaaagccaaacccataaaacgcctgggccactcaacatggcttttatcgtgcctgatgttaatgcatgttctctttttacaataaattcatggccatcagatgatatcaatttgacatacgtggcatcagggccttcacagccaccataggttttctcctctccatccattttgttcttatgaaattctactttgcttccccaggaactttagtagtttcctggtgaggcgaggacacagagtgtgtggctcacttccgtctcctctgtctctgtttcactgagctctctggcaattatgttcttcttccttcttccttcttcttccttctttcttcttcttcttcctctccctctcttccccttccccttccacttccccttcccctcctcctcctcctattcttctctgcttcttcctcttcctct

SEQ ID NO: 78897 - DNA, 1008 bp, Homo sapiens
ttccaggccagcctgggcaacatagagagacctccccgcgaccaatctcaaaaaaaaaaaaaaaaaaaaaaaattcctaaggagcctgaaaaagagaagcaccgcctacctctcaagctagatgcctgttctgctgttgacctaatcataaggggcctgtgggaaccttctgcgtggaggacttcagatgtaaacagacttgtgatttgtacagtaggaagccaagaggtggcagggctcactcctcactccccttctctcctaggtgtgccatttttcacagtggagccaaaagatctggcagtgccacccaatgcccctttccaactgtcttgtgaggctgtgggtccccctgaacctgttaccattgtctggtggagaggaactacgaagatcgggggacccgctccctctccatctgttttaaatgtaacaggtgagcagcctcagaagggggctgggagtggagaaggagctgggtcctggagggcactgaagctggcagtttcagccactgagcttgcggttgtgagcgtccagagcaagccccagtgtctggggacgtgagctgcaccattactaagctcattagtcaggtgtgctaggctggctgggtgggctgattagtggtgatcctgctgtgtgtgcttaaggagggtgtggggccacctttggttcacagcagtccaggccatgcacagctggccctcagagatgaattgtatgagaccaggggcacccatcccccacccctcccaaggaaaggagccagaaaccagcccacgcagaactagggaggagtatctggcagacactgagaagacaagactctcaggctgcagagaggggagaggagggagagagaaggggtagggggaggttagcacaaagatacagggcctcctcccctaatggcgctttccgggaaacctccacacgttttctcaaacaactgtgtctgtccatacctctgcacagtcacacctgcacacccacctgggccccaag

SEQ ID NO: 78898 - DNA, 1974 bp, Homo sapiens
ctgcctcagcctcccaagtagctgggattacaggaatgtgccaccatgctgggctaatttttttttgtatttttagtagagatggggtttctccatgttggtcaggctggtctcgaactcctgacctcaggtgatctgcctgccttggcctcccaaggtgatcccacctcagccttccgagtagctgggactacaggcgtgtctaccaagcctggctaatttttgtattattatagagacagggttttgccatattgcccaggctggtctcgaactcctgggctcaaataataccccccttcggcctcccaaagtgttgagattacagatgcgagccgctgtgccccaccagggaataaaattttttaaaaccctagtgccatatgatgaaggggcccctgcttttgagggaagggctcctgccttttctcacgcttctctccaccccaggtatgatctcatgtaccagtgctggagtgctgaccccaagcagcgcccgagctttacttgtctgcgaatggaactggagaacatcttgggccagctgtctgtgctatctgccagccaggaccccttatacatcaacatcgagagagctgaggagcccactgcgggaggcagcctggagctacctggcagggatcagccctacagtggggctggggatggcagtggcatgggggcagtgggtggcactcccagtgactgtcggtacatactcacccccggagggctggctgagcagccagggcaggcagagcaccagccagagagtcccctcaatgagacacagaggcttttgctgctgcagcaagggctactgccacacagtagctgttagcccacaggcagagggcatcggggccatttggccggctctggtggccactgagctggctgactaagccccgtctgaccccagcccagacagcaaggtgtggaggctcctgtggtagtcctcccaagctgtgctgggaagcccggactgaccaaatcacccaatcccagttcttcctgcaaccactctgtggccagcctggcatcagtttaggccttggcttgatggaagtgggccagtcctggttgtctgaacccaggcagctggcaggagtggggtggttatgtttccatggttaccatgggtgtggatggcagtgtggggagggcaggtccagctctgtgggccctaccctcctgctgagctgcccctgctgcttaagtgcatgcattgagctgcctccagcctggtggcccagctattaccacacttggggtttaaatatccaggtgtgcccctccaagtcacaaagagatgtccttgtaatattcccttttaggtgagggttggtaaggggttggtatctcaggtctgaatcttcaccatctttctgattccgcaccctgcctacgccaggagaagttgaggggagcatgcttccctgcagctgaccgggtcacacaaaggcatgctggagtacccagcctatcaggtgcccctcttccaaaggcagcgtgccgagccagcaagaggaaggggtgctgtgaggcttgcccaggagcaagtgaggccggagaggagttcaggaacccttctccatacccacaatctgagcacgctaccaaatctcaaaatatcctaagactaacaaaggcagctgtgtctgagcccaacccttctaaacggtgacctttagtgccaacttcccctctaactggacagcctcttctgtcccaagtctccagagagaaatcaggcctgatgagggggaattcctggaacctggaccccagccttggtgggggagcctctggaatgcatggggcgggtcctagctgttagggacatttccaagctgttagttgctgtttaaaatagaaataaaattgaagactaaagacctaaggttttgtctctttttttttttctttttttttgagacagtctcactgtgttgcccaggctggagtgcatgg

SEQ ID NO: 78899 - DNA, 1028 bp, Homo sapiens
gtgcatgtaaatgagatagtgcctatgtgtttatagaacaatctaggatcaaaactgtgtacattctaggccagactgtttaattgcatgcattctctctagttttttgtttgtttccccttaatattcagaaaaatctacttgaacgtgcagtctaggaaaatcaaggcaaagacttttgtgttaggctggaccaataagttgagctatgataactgaaaaaggtggaacttaggagcatcactttagcagttagcttggcattcttaaaccttcggttatatatggatgccttttaaaggaggaaatttcttacattatccaaagtatacaaccaagaactttagtatgagaatgctgcattaaaagttgaatgtaaccatttaagtggttactcaaagcaaacaaaaaataaaaaagaaaaacaagcggttacttggtacctgcatgatggtaaatccaaactggatccctgaaatgtgtgtggtggtatgattatttttagaatatcatctaaaaacacttaaaagttctcataggaccctcagattcttgacatctcccgacctctctaggttaggcggactccactttgaaaaactatggatagttttcctctcccaccgagatctgtagtactgaatcttcaaagttcagcgttttttttttgttttgtttttttaaagtatctagtatttagttatatgtttgcctggtgtagggaaggagtaccaaaagagaatctccattccccttcttcccaagttgtcctcacagatcccccagttagagagatcatttgggttaacttgtctctttggggatgcatggttgttaaccagtcattcacaccttatgatcatatattttaatgctaaatcaacataaatttacttcttccccagaaaatggaaaatttttatgaggaaacctcagatccttgagaggaaggcattcttggtaaggtgggagattctgacagggcagcttgtaggaaagaagttcttgggttcagggaagaggaggaa

SEQ ID NO: 78900 - DNA, 1023 bp, Homo sapiens
ttgggggtctgcggagccccgtgtgggtggggctgggcgcggccggggcggagccggcgaggagccctagggaaagggtgaaaggcacagttgagaaaggcccgccgggcattggtttcacagtttccacgaaggcttcgtgtgcaagcctgaggagtttaggtgcctccctcctgcctcgcctttcttggttctagaaccttcagtaggcttttctgggttgcagggacccggaaaagcagcggcttccactcggggggcgggtcccaagggtcttgctgctgctctggggccgtttggactcctggtgttgggggaggggtcagggaggtgctgctcgcgtctccttttgcgcctgcgcggcgggctccgagcgggtaggagcgcgtgcgcggtgacgtggacgtccggtgcgcgcgcgcaggctcttcagctggagcggacacacggtgtgcgaaccgaacagaataacccgcccccagcgggatgtgaaggactccgggtgaggccggccacgccccgcacggtaactctcgggcctgggtggagggcatcgcttagtactggcccgattggagtttttcgagagtttgaagctcttgtgtatttgaacggcgtgagaaacgttccgctgagagagcttcgcacgccctcgccaggccgggccttgcgcagggccgcctttggcgcgcccctgtggtccctgagcgaggctgcgcatgtcacctcgcgcgcgtccccggcctcacttccgcgtcgctcagctacctaactgggaacatcgacgccagagagagcggccacgaggcgggaggggtgagaagcgcccatggctcggccctgccctcgcgtgtgtggggtgccgctccgcgtggtacggtccgcgtgacgacttctcgcccggcgccgggctctaggtcgagagccacgcttacgcgcttttcagtttagagcctaggtctcgtggttctagaactccaagggaaacggtgtcggcgtcgcttttctgagaacttggcgcag

SEQ ID NO: 78901 - DNA, 2185 bp, Homo sapiens
ttaaaaatgcataaccttcaaatttaactttttaattttgtatacttttttaataatgaatatactcttttgtttctttgtgtgagattatagtatttatagtgaattgttagaggattaggatataagcaccttaactaattagattaaaatgaactttaaaaaatgattagatattccagagtaaatattcttactgtgattgaaagaaaagcttagaagcaaagtcttagaagaatttaggaatattttggggataacataatcgttcttgtatttttgttcaagaaataaatactcacttgattaaagggtgttttttgtttttggtttttttttgcttgtttcttaggatgggaaggccattgtgactatgtggtgattacagttgtcttactactgagtttcctactgaaatcatggaggagaaacagcagattatattggctaatcaagatggtggaacagtggcaggagcagcacctaccttctttgtcatcttaaagcagccaggaaatggcaaaactgatcaaggaattttggttactaatcaggatgcctgtgctttggctagtagtgtgtcatcaccagtaaaatctaaagggaagatttgccttccagctgattgtactgtgggtggaatcactgttaccctcgataacaatagtatgtggaatgagttctatcatcgaagcacagagatgattctgaccaagcaaggaagacgcatgtttccttactgtcgttattggataacaggtttagattcaaatttgaagtatattcttgtcatggatatatctcctgtggataaccatcgttataagtggaatggtcgttggtgggaacctagtgggaaggctgaacctcatgttttggggagggttttcattcatccagaatctccttccacaggtcattattggatgcatcaaccagtatctttctataaactcaaacttaccaacaatacactggaccaagaagggcatatcatcttgcactctatgcatcgttacctgccgaggcttcatttggtgcctgcagaaaaggctgtggaggtgatacaattaaatggccctggtgtccacacttttaccttcccacagactgaattctttgcagtaacagcttatcagaacattcagattactcagctgaaaatagattacaatccatttgccaaaggctttcgggatgatgggctgaataataagccccagagagatggaaaacaaaagaacagctctgaccaagaagggaataatatttccagttcttctggtcatcgggtccgtcttacagaaggtcaggggtcagagatacaaccaggtgatttggatcctttgtcaaggggtcatgaaacatcaggcaagggtttggagaagacttcccttaatataaaacgagactttcttggtttcatggatactgattcagcacttagtgaagttcctcaattgaagcaagagatttctgaatggtaagtagtagtttttctgttcttagaaataaaaggaagattgagatgggccaggtgttggatttaacatcttggttctgtggaatgctacagatgttgataaatgtaagccactataaaatatactacaactgcttttacattctgtgaagtgacatcatttttctgtaatgagaatcagttgggttcaggatctagaattgtaggcaaattggataacttatcagaattattcatatgtatttagaatgttccttgatatccttgggggattggttccaggaccacccaagaataccaacacctgactacatttgagactccatctcaataaaaaaaagaaaatcataccaattatgacaacatagatgagcctagagaatactatgctaagtgaaataggcaaaacaaaaaaagacaaatactgcaaaatattcataaaagtagaaagtagaatggtggatgccagggggtagagagagactgaaagatgttggtcaaagggtacaaagcttcagttatgccaggtaaattttaaagaaagagtaagcatactattttttttgagatggagtctcgctctgtcgcccaggctggagtgcagtggcatgatctccgctcactgcaagctccgcctcctgggttcacgccattctcctgcctcagcctcccaagtagctgggactacaggcgcccgtcacc

SEQ ID NO: 78902 - DNA, 1869 bp, Homo sapiens
cgctcctgcccaattttttatttctaccatattctcaagatacattggtacagttcttaggctttcaatggatgattgggaggagggggaaactagatgtttatgttgtttttggatgaattatacacaatatatctgggtcatacgtatttgcctttaactccctatcttttattttggaagaattagtggtgaattctttatattgaaagtgagtttttcaattttaaagttggaaaatcatctggcaacatcatgactatactaaaaaccaatgaattgtatactctaaaattgctgcaatattatgttttatgttatgtgaatttaatctcaaaacatacaggaaaatatcagctggcagtttaatggccctttccggtttgtgttgcaattcttagttgtgatggatgtgtgttcgctttacagggttgttaatcaccgtgtggatttttagagtttttgagtgtttttgaggaatggctcaggaaatctgatgtgttacttggattcctaacatctttttttttttttctcttcaagtcttgttaatggatcattttgtacttttaaaatccctttctcctctctctctccagtcttattgccagcagttttgaagatgactcccgtgtagcctcaccgttagaccagaacggaagcttcaatgttgttattaaagaggaacctctagatgattatgactacgaacttggtgagtgcccagaaggggtcactgtgaaacaggaagagacagatgaagagacggatgtatactcaaacagtgatgatgatcctatactagagaaacagctaaagaggcacaataaagttgacaacccagaagctgaccatctatcttctaaatggcttccaagcagcccatcaggtgttgctaaagctaaaatgttcaaattagacactggaaagatgccagtagtctatctggagccctgtgctgtcaccagaagcacagttaagatttctgaactccccgataacatgctttccacatctcgaaaggataaatcttctatgttggcagaattggaatatttgcctacatacattgaaaattccaatgagactgccttctgcttaggcaaggaatcagaaaatggtcttagaaaacattcaccagatctcagagtggtacaaaaatatcccttactgaaagagcctcagtggaaatatcctgatatatctgacagcattagcacagaaagaatactcgacgattcaaaggattcagttggagactcactttcaggaaaagaggacttgggcagaaagagaacaactatgcttaagattgcaacagccgcaaaggtagtgaatgctaatcagaatgcctctccaaatgtccctggaaaaagaggaaggccacgaaaattgaaactctgtaaggcaggacgaccacctaagaacacaggaaagtctttaatttctacaaagaatacacctgtaagccctgggagtacctttccagatgtgaagcctgatctggaagatgtggatggtgttctctttgtttcctttgaatcaaaggtaagattgtaattttcaggattctttaaggctaattagtcatacttgaattgtatactggcttgtaagtaactcgatttacaatctagttttgtgatatctatttgtgagggtgtatggggggtggagttgggagggaagtgtctccaaaatgtttggtttagttaataggaataacttaagatacttcatttgaatagacttaaaaaagtatgtcttgcttagatttcagtttacgatttttgcatagctgtgtttaaaaaaagtcttcgggtcttactggaattttcatcattatggattttggaaaggactaaaaat

SEQ ID NO: 78903 - DNA, 1219 bp, Homo sapiens
ctcctgaccttgtgatccacctgcctcggcctcccaaagtgctgggattataggcgtgagccactgtgccaggctgtctttcttaattgactacacagatgttggatatttaatcccttctacctgttcttttcctcccttcttgttagctgagtaagctatctgaatataggctctgagaagtgaacatgcaaattggcgtatactttgaggtcagttagctcagtatgacatcgtattcacatttttttacttcccccttttccccttctgattattaaagtaatattaatgtagaacacttagaaaatatcaaaaagtatgaaaaaattgctcctgttctgccaatgttagcgtaactgtaggcatggagatattttccttctggtctttaagttttttttaatcctgttttacatttaagttttcagaagcaatatgaactactatttttttttttttttgatgtataggaagctctagacattcatgcagttgatgggacaacagaagaatcttctagtctccaggcatcaaccacaaatgactcaggtattataaaatagtataaaaagagttgtatttgtggtttgggctccagcaatgaaacatgcaacattcatttgtctgtagtgtacagtagcttattttattactatttattttgggtgtaggttacagagcaagaatttcccagttggaaaaggaattgatagaagatttgaagactttgcggcacaagcaggtgatacatcctggtcttcaagaaggtaatagactagcgacttctttttttttgttttctttttttctttcttccctactgtttctcctctttttcctctctctttctcatctctttttttctgttttttcctctttctttctagccttgatttcatttctttcagcacgtctttcagtttgcatatttttctcttctctgtctccataattcttccctttagtttaaaaaccatgtctaatatcttatgtaagaaaaaaatgtatcatggtaaagcaagtgatattttctttgttcattcttataacctggtattctccccttcccgtttctcatcttaatttggttgcttttgtttatgtgtgtgtgtgtgtgtttgtttgagacggagtttcgctctgtcgcccaggcggctggagtgcagtggtgcaatctctgctcactgcaagctccgcctcctgggttcatgccatt

SEQ ID NO: 78904 - DNA, 1691 bp, Homo sapiens
cattctcttcacttggttttatttattttttctttctgaggagggatagtttgtttattaagtatttattttaaaaaatttatttatgtttttagggacagggtccttgttacgttacttaggctggtcttgaactcctagcctgtagcgatcgttttgcttcttcctgtcaaagtactgggattacaggtgggagtcactgtgcccagctaagggatagtttagaagattcactatcttgtagctcaatattcttggccatttttagtgtttttatggagattcataaatctgtcctagatttctttaagcattttatgttttcttatttctaggtggaaattcagaaagttcactgaaaaatcgttctgctttctgtagtgataagctagatgaatacttggaaaatgaaggcaagctgatggaaacaagcatgggtttttcttctaatgctcccacatctcctgtggtgtaccagcttcccactaagagtaccagttatgtacgaacacttgatagtgtactaaagaagcaatctactatttccccttctacctcttattctttgaaacctcattctgtaccccctgtctctcgaaaggcaaagtctcaaaacagacaggcaactttcagtggccgaactaaatcatcttataaatccattttaccataccctgtttcaccaaagcagaaatactctcatgtgattctaggagataaggttaccaagaattcttcaggcatcatctcagaaaatcaggcgaataactttgttgtgccaactttggatgaaaatatatttccaaagcagattagtttgcggcaggcacagcagcagcagcaacagcaacagggaagtcgccctccaggcttgtctaaatctcaggtgaagctaatggacctggaagactgtgcactttgggaaggaaaaccaaggacatacatcacagaagagcgagcagatgtatccttaacaactctacttacagctcaagtaagtagctgctgttttctggaggtatattagtgcttggctagaaagagcgaggttagtgaggggaaatgggaatggtactttttggcagggtgatcagctagtttttagcatttagaaccttcatgggaactaaggctatgtcttccccatttgttctttaccaactagatactcaggtgtagatttctcctgccatcagagagagagagtacaattgcacttttgaataacctctctctcctgtataaaggcaactgaccattctgaaaatctctgatttcattttccaacatatgggcaagtacattggctgatcttgttaaaacaactttgaaaattgtgcttttattttttattttttgagatggagtctcgctctgttgcccaggctggagtgcagtggcaggatctcagctcactgcaacctccgcctcctgggttcaagctattctcctgcctcagcctttcgagtagctgggactataggcacataccactgcacctggctaatttttgtatttttagtagagacacgttttcgccatgttagttagactggtctcgagctcctgaccttaggtgatccacctgtctcacctcacaaaatgctgggattacaggcatgagtcaccacgcccggcctgaaaattatgcttttaaaagatactaaatcccaggaaattgaaaattaaaa

SEQ ID NO: 78905 - DNA, 1665 bp, Homo sapiens
gcctcctgagtagctggggcctgtaggtgtgcactaccacgcctggctaattttttgtattatattaaaaatacaaatggggttttgccatgttatccaggctggtctcaaactcctgggctcaagctatctgcctgcctcggcctcccaaagtgctaggattacaagcatgagccactgcgcctggccttcatcattactttttttactttccattttgtaattctatgactgaattctggaactgaagatcatcagatgttggaactaaatgcagattattttattcgttattaatccttcataaagacttttatttatgtattgtcctattctttttttattaattaccctacaatagggaccagcaaactttttctgtaaagggccaaatagtaaatatttaaggctttgcagaccatacactctctataggagttactgaactctgctgttgtagttcttcagacggtatgtgtatgaattagcctggttgcgttccagtgaaactttatgacacaggctggatttggcccatgggtctcaacctttgttaatctttgcgttagaacattatgtataatttatattgaaaataaatccatccttgatagttttgcccataattgtctgtactaagcattagaatggcagattgtttagagccctggttagattcatgttctgtcctttgaatctgcattagtcctgtgctgttagtacttaaaatcagagagtaatgcagtccagtatatgaccataagttggtggtggtgtagggggatggtttagtggaattacaattttctcctttgactttaggcatccctcaaaactaaacctatccacacaatcataaggaaacgagcccctccctgcaacaatgacttctgtcgactgggttgtgtatgttccagtctagctttggagaagcgccaacctgctcactgccgccgaccagactgcatgtttggttgtacttgtttgaaaagaaaagttgtacttgttaaaggaggatccaaaactaagcattttcagaggaaggctgctcatcgagatccagtattttatgatactctgggagaggaggcaagggaggaggaagaaggaatcagggaggaggaggaacaattgaaagagaaaaagaagagaaagaagctagaatacagtgagtattaattgagagttaaaactgtgccatatcagtttttggaaaagtatggttattttagaataatacaacctaccttaatcccgatcaattatccaataagagctttgagacttcttattatccttacatgctctttctgactggctatctgagatgcacacaaacacacaccttttttaagttgaattgttctctgagaattgcttttttgtgctaaatttaaatcatactgttacttggttttctagaatgcccttgatctttgagtttcttccattttctggattgtgcgcatgtgcacacacacacaggtagacacacgtacgttccttggaaagactatagatgatccatataatgcatcatgttttctaaaaggagaagtttgcaaaaagaccctctgctcatggttggagatttggggacaaagtaggattgtggtaaagctgaacatcatgtactgtgttgaaaattgggtttttttttggtgg

SEQ ID NO: 78906 - DNA, 1040 bp, Homo sapiens
aagatgggtaacattattggacactgttatgcatagctctctatgaaggttctatcatttaaaccttcaaccttatatgataaggaggcttcattctccattttagaaatgagctaattgagtgcttagtgacttgttctccaaggtcataaagatactaagtgagttgtaggggactgccaagtcctcatgctttttctgccttgtacaatttctgaaattttaattctgcctccttgttgtagaccccagtggcctttacttttatcacctgcttatcctttggtttgtcaaaaaatactgctggctgtgcagaggtactgtgcctagctgttgtgggtagtaccaagggaaagaataaaacttgtcatttctgttttcttagcccacttaatatacctataaattaacaatataaagaaaaaaaatcaataaaattgatacttgtagccagactgaggaataaagagaacatactaattaccattattaggaatgaaaggtgacttcagtacagacattgaaaggatgatatggcaatattatgaacaactttatgtcagtaaatggagaactcagatgaaatggaaaaactctttaaaagacacaagctacaaaactcactcaagaagaaataggtgactgcttgccttatacttattagagaattgaacttgtagtggaaaaccctgcaataataattctggtctgagttgcttcactgttgaattctataaaacattaaagactaaatcccatttgatacagtcttccataaaatggtgtcatcttatgaaaccagcattaccctgatattcaatccataagaagactttacaagaaaactgtagactgataacccttatgaacatagatgtaaaatttctaaataaaagtttagcaactcaaatccaacagtatatttaaagaatactgcatcatgactaagtggggtgtatcctagaagtgtgggatttgtttaacatttgaaaaatcaatcagtatactttgccattacagtggacttaaaaaaagaccag

SEQ ID NO: 78907 - DNA, 1417 bp, Homo sapiens
cgccattgcactccaccctaggtgacagaacaagactctgtctcaaaaaaaaaaaaaaaaattttttttcagtaaggtcttctctgaccctaaatataatggcaactcttgttttaattcttcattccttaattaccttgctgtgtttttctacatggcttaccattacttgatattatatatttatgggtttgtcttcccctactggattttaaactctgagggcaagaactttgttttattcatagctgtgttcattctaatgcctaaaacagtatctggttgatagctggtgttcaataaatatttaaagatgaataaatgaaagtatataaataccactaaatgccctttgtttggggagggggtcgtctatttgattattttaacgagttactgccttttgtgagggagcgtattttgttttggcagtgcctcagtattgatcttttgttgccaaaagtacctaaaaccttacccttcttttttgttaagctatatgtgagacagagcctgaacagcctgttcgacattacccattatgggtaaaagtagaaggtgaagtagatccagaaccagtttatatccccacgccttctgtcattgagcctatgaaaccattgttattgcctcagccagaagttttatctcctactgtgaagggcaaactgctcactggaattaaatctccacggtcatatactcccaaacccaatcctgtggtaagtctggaatttaatcttttattacaagttaccaaagtcatgtgtaaagatggtgtgtttcaagcagatttttggttgatattttgtgaatcattttgctttcagtaatatgtttataagatatcttcctttctggtttaatcagtttagtgctggcactttaaaaatgtcttaaaagtagaaatgagtagtagtaattttaaaaaataaccatcttcaagaagatcatagaaacataggcttttttacatggcttggaaaaagttttttaaagatactactcctgtattgtagaatattagtaatcaatataagcagtatatattattagtagaaaaacattaggaaaaagcttttaaaagcttttaaaagcaaatttaaaaatgcataataatatcagtaaagtttaagatttaaagtaacagttgatataatatgactgaagactggtaggtaaaagtaggaagttattcattgtgttaatggcttaagcaagtcttattatcaaatccatgtgtcctcctagtccattagattgaagaaaaatcctatactacgatgctactgaatatgttctttgtagcagagctattatagtataaaactgtttctggtctgtgatgaaataagcaagggtgggccgggcgcggtggctcacgcttgtaatcccagcactttgggaggctgaggcg

SEQ ID NO: 78908 - DNA, 1115 bp, Homo sapiens
tgttattcaggggtcagctggatagaaaataagagtaaatatttagaaatttctacagcaagttgattagctgaatctaatatttaaaaaccttgcattttatatgtttttagtttttctagtaatttattgtatttactaaagtatcagtctatgatggactggtaattaacaatgtatccttcaccatagataatttgaaatgcactgctctggtatgatctgaaatttcctgatagagaactggatcctttctgactgccctaaggttcggcacatatgaactgtacttgtgctgtttgatttgaaagtttgcattaaaaaatttcgactgttgtaatacaaaaaaagattaaacattcgttttgttttggagtctagcggagtttttcccactgtatggaatattttgttgtatgaaatttacagattcgggaagaggacaaagatccagtctacttgtactttgaaagtatgatgacttgtgctcgagttcgagtatatgagcgaaaaaaagaggaccagagacaaccatcttcctcctcctccccatctccatcatttcagcagcaaacttcatgtcattctagccctgagaaccataataatgcaaaggtgagtttcttgttgcataagttctttttaacttctgattacctgtttttggtattaagatttgtattactatcagaataataattatcctacagggcagagaagtcatacatgacatgtataacagtttatttctctgtgtacctattgtatgatacgtcccttatggttattacaagtattctttcttggttgggtgctgtggctcatgtctctaatcccagcactttgggacgctgaggcaggcggatcagttgagcccaggagtttgaggctagcctggccaacatggtgaaaccctatctttactaaaaatacaaaaaaaaaaattagctgggcctggtgccgcatgcctgtaatcccaactacctggggtgctgaggaacgagaattacttgaacttgggaggtggaggttggaggttgcagtgagctgctatcatgccactttactccagcctgggtgacagagtgagactctgtttcaaaaaaatatgtata

SEQ ID NO: 78909 - DNA, 1060 bp, Homo sapiens
tcactgcaaccttcagctcaagcgatccttctgtctcagcctcccaaccaactgggactataggtgtgtgccaccatttgtggctaagcttttgtatttttggtatagatggggttttgccttgttggccaggctggtttgaactcctgggctcaagtgatcttcccacctcggcctctcggaatgctgggattgcaggcatgagccaccgagactggcctcaactggtgaattttctgaataactgtagtttgtttcatttaacagtaaatatgtttccctctttaaagtacaatgtgaatttttttcttgatgactcagtcactatcaaggacattaggtagcaaaactatgtgtttttacccagggttttatatgatagtaacgtagatgtgcatgtggattgaagctgttgacatttcagtcattctaatgatttaaacttctgtgagagatttaatgcttgtgtccaagtttctgtgggtattgaatatatgttaagttaaagtatttctgtgttactgtctccttcaggaacctgattctgaacagcagcccttaaaacaactcacctgtgacttggaggatgattctgataaattacaaggtcagaatgaaaactagatcttaacatttgataaaaattatttaggtctagattatagtaataatgggagaaaacccaaaccatcaattcagaatatgtctgcctaccctgtttcaaacttatgccaaaaacagggacaataagtaaaagttttttttccccattatttggtctgttaacactcctgctctcaaaaataaaagaaaattcattcatgttgataaagcatgttgttgcaagagacatttaggttgaggtcagtgagtttttttttttttaacctctttccaaaccccagtaatattggcatcattagcctttggtcctccatcactgccacctctggggaaatctagaaggagaaaggaaggaatattactgtgatttagctggcagaggctactgtcagaattactttgatgacaggtagtggtcaggtggttaccaatttgt

SEQ ID NO: 78910 - DNA, 2299 bp, Homo sapiens
tgactctaatctgtacatgtttcaaagcatctagcaagtagtttcactttgcctgtatgtatagcaaaatagtaacctataccagtgaagcttaaccttggttgtaggtcatggtttgtttgcaagctaactctaatgtaataattgtggcatttagagtagtgttaagggaactacctgttagagcccagtcagcaggataatgaggactattgtagtcttattctctggaactttttcttcctggaaaactcccaaattgtgaaagttgatacattttaagttactactgtgaaagaacgtgagaatgtgacagttttttttcagagtttcatacaaaatgctgtgatgcagaaataatctttcaactttttcttttttattattattttacatcagaaaagagctggaagtcttcctgcaatgaaggagaatcctcttctacttcttatatgcatcagaggtcacctggtggtcccaccaaactgattgagatcatctcagactgcaactgggaggaagatcggaacaagattttgagcatcttatcccagcacatcaatagcaacatgccacaatcacttaaggtgggcagcttcatcattgagttggcttctcagcgaaagagccggggtgagaagaaccctcctgtttattcttctcgtgtgaaaatctctatgccatcatgtcaagaccaagatgatatggctgagaaatctggatcagagactcctgatggtccattgtcccctgggaaaatggaggatatctctcctgtgcagacagatgccctggattcagtgagggagagattacatggaggcaaaggtctgcctttttatgcagggctttctcctgcagggaagcttgtggcctataaacgtaaacccagttcaagtacatctgggcttatccaggtgagaattatctttaatctgggtatagcacctttgtatacacctaggtagtatcatgatttttcagagccctttatggtcctgatatcctttatcttgacatttcctgggaactgggtgacaaaattattatctctttttgtaataggcctagtttagatgcatacctagagtgaatttttgtcacatttatgaacagaaacgtagagccttgtattagttttaattttctttctaatcttcccagaaagttgctcttcataaactttattgcctgcaggctctagtgatactttgacaataaagcaagggtaatcagggattcagtctagctcttggaatttattattagcagataggtttcaaaacaaaaccatggttagaacggtaggtgtaaggggaagatgaaattgacttaaagataggcaatatatgtttagaaacttggggaaaattttaaaaatttttatttattatttatttattgcaatcttggctcacagcaacctctgcctcctgggttcaagcaattctttgtgcctcagcctcccaagtagctgggattacaggcatgtgacaccacacctggctaattttgtgtttgtgtgtgtttttttttgtttttgttttttttttagtagagacggggtttcgccatgttgtccaggctggtctcgaacttctgagctcaggtgatccacccaccttggcctcccaaagtgctaggattacaggggtgagccaccatgcatggctgaaaattttaatttagtaaggtgttatttaaatacaagagtaaaaattcagccatatttacttaattatattttttctttatttgattcgtaggggttttgttagtgtaactgttgtaggacaaatacctttatccttgatacttagtaattcacgcaggttgtattagtaaaattatactggcatatagaaaatttgaaaagagacgttctgaattaatgtcatagtcagaaaaggtttttctagctgagcgcagtggcttacgcctgtaatcccagcactttgggaggccgaggtggtggatcacctaaggcaaggagtttgagactagcctggccgacatggcaaaaccccatttctactaaaaataaaaaagttagcccggcgtggtggcgcgcgcctgtaatcccagcttcttgagaggctgaggcaggagaatcatttgaacctgggaggtggaggttgcagtgagctgagattgtgccactgtattccagcttgggcaacagagggagattgtctcaaaaaaaaaaaagtgcacttttatattagagtagcaaatgtgtggaagtgtctgatattattgcaaagttagcttgactttcattagattggctgcttctaag

SEQ ID NO: 78911 - DNA, 1903 bp, Homo sapiens
gacagagtgagactccatctcaaaagagaaaataatattaatatgattgatctacttaattaaaaaacttattattgcagtttactgttgtgcatgctatgtaaatgcttctgttgatatttcttatactcttgatgaggagaacagtattttctctaccttatatattgattgacactttgaaaacagaggtttgcctgatacaatttctagtgagactagactccctaaaatacaagcatggaaattttttgttgtcttctgcccaggactcacaaagccaccatagaatgtgtctgcataagcagtcaggcaactgtaaactttgtaaactttggggaagctgcagagtaggcttcagcgcagtcccaagggatccgggagggggtatctgacctatttctgtatagcctgaaaagttacagtaaagtctactttcagggggaatgatcacattctttgtaccaaactcaaggcagagatattcttgatctctgtgggaataatcacaatttaaccaaagtagcaaagagtaattttgttttgtgtctctgaagatggagttgcttgctgtagctggtctcctcaccagttccctgttagagagtagattctacctcactccatctcccccaacccccgattttgaaatggtgaaaaggaaatatagaaaaggttatcttctctagagttgcctggcaatatgacctagagaacatgggtagagacttgggaagtttttgttttctttctttaaaaaaaaaagaaaagaaatcaacccccacaaaaaacaactgtgctggtacccatgatgggcagtctgataaactcaggcagcagaggggatctttacttcatttgttggttcactttcttctgactatttagttaattatgtctagaataagaatgagttcgtaccaacattcagtttgaacccatgttttatccaagagatgaaaatagtattttcaaagctaagctttttgaaaatgaaaaactgtgaggtaattgtggcttaggttattgcaacaatgattgtcttataacttaaagtagatttcacttatatttttcaaatatgaaggatgcttgaaaggacccttgtgtgagagcttcattatgtctctctggtcttatcagagagattctgtgggacactcatttttgctgatgaggttaatagcttaaccagaatgccttatttacaaggaaaacaattggataattctagttgtttagatttgatgataactttcacataactaggatgcagaaatgatgagtttccgattctctattttcaaactacaatatgaaggagatgagattagttcagaatatcagttgacagcatttttctaccttctgattactcagattattctaaatggaaaaagtctacttctttttcccttttaaatctgaaaaatagacttatgaaaacttgtaaaaatgaagcccctgtcaagggagaggagttagcaagagaattttatctttacagaatttctctttgccacttgtttcaggttaatggtaagagttacccgcaggctaagttgctattgggacagatgggggcattgcatccagccaataggctagctgcttatatcacaggcaggttgcgaccctcagtcctggacctctcaaccctcagtactgtcatctccaaggtagcatccaatgccaaggtggctgcatccaggaaaccacgtaccctgttgccttcaacatccaattccaaaatggcatcctcctctggcactgcaacaaatcgccctgggaagaatctgaaggcgtttgtcccagcaaaacggccaattggtaagttggggtgtatgtatggtttggaaaggcctatgacttggtggtgggacagtgggtacaggtatggagg

SEQ ID NO: 78912 - DNA, 1375 bp, Homo sapiens
aaaaagggaagacatttaaaaatagtttactattatactaaattatttactaaaatattttactaaattaaaaatagtttactattttcctgtgaggactggtgtttctggcctcttgttgaactcttgctggtgctatgtaaatgcttctgttgatacttcttaaacttatgaaaccaaggagctagcaaaagctagtggtgtaagtagtataggcttaaagtggaaagctcctataaatacaattttgaaagtgttgatttattccattcatctctgttctatgaatgaaaatctctcttttccttaacatttaaatgctgaagtctgtaataaattaccttcttgaaacatttgtgttttagcattgagagtatctatagttggtttattgaattcctctttttgttgtttcaaatctgttaggaatgttaggtaagagtgtcagttgaaatctctggctgaatggttagagttgtgtgaagatagaagatatttattgtttgccttaaaacctattttggccgggcgcggtggctcactcctgtaattccagcactttgggaggccgaggcgggtggatcacgaggtcaagagatagagaccatcctggccaacatggtgaaaccccatctctactaaaaatacaaaaattagccgggagtggtggcatgcgcctgtagtcccagctactggggaggctgaggcaggagaatcacttgaacccgggaggcagaggttgcagtaatccgaaatcgtgccactgcactccagcctggtgacagagtgagactccatctccaaaaaaaaaaaaaaaaaaaaaagaatctattttaccttttattaaggcagcttcagttgtgattaaggggagtaaaaaaagcaatcctatcctgatctgtttggagaaatgtctttatatattttaggaatatgtaatacgtaagcatctcataatagcacagctgtaaagaggtgagagtgctcagacaggaggaaatggtagaaacaagtttttacattagaaattgggggaaacaaaccctctcattttcttttatctgtattaggtgatgaagtttttgctactgtattgtctttttagtatcctgacagtttgaatatattgcacagtcaaaagaattttagtaggaacactctatttaattttttaatttttctttcaagacagagtcttgctctgtctcccaggctggagtgcagtggcactatctcatttcactgcagcatccacctcctgggttcaaaccattctcctgcctcagcctcctgagtagctgggattacaggcacgtgccaccatgccctggtaatttttgtatttttagtagagacggggtttcaccgtgttggc

SEQ ID NO: 78913 - DNA, 2115 bp, Homo sapiens
tgatctgcccacctcggcctcccaaagtgctgggattacaggtgtgagtcactgtgtctggcctggaacactcaattttaatccctttcttgttagaactgaggtttgtttttggtcaaggcaagcgtttgatttctgagagtagaaataagctcagatgctgggtgtggtggctcacacctgtaatcctagcactttgggaggcccgaggcaggcagatcacctgatgtcgggagttcaagaccagcctgaccaacatggagaaaccttgtctctactaaaaatacaaaaattagctgggtttggtggtatgtgcctgtaatcccagctactcgggaaggctgaggcaggagaattgcttgaacctgggagacagaggttgcagtgagccgagatcgcgccattgcactctagcctgggcaacaagaaagaaactccatcttaaaaaagaaaaaaaagaaattggcacaaataatacaggtaggtagtacctgtaagaaattgacccagtagtgcacagtaaatgtcggtaagcacagtcactaagaggataaaatatgagaactgaagatttttgacctgcaaatttctgtttgcagcggctcgaccctctcctggtggtgtgttcacacagtttgtgatgagtaaagttggagccttgcagcagaagatacctggagttagcacaccccaaaccctggcagggacacagaagttcagtatcagaccttctccagtaatggtcgtcacacctgtggtttcttctgagccagttcaggtgtgcagccctgtgactgctgctgtcactactaccacccctcaagtgtttttagaaaatactactgctgtgacacctatgactgctatttctgacgtggaaactaaagaaactacttattcttctggtgccaccactacaggggttgttgaggtctctgaaactaataccagcacctctgtaacatctacccagtctacagccactgtgaaccttaccaaaaccactgggataactacccctgtggcttcagttgcttttcctaagtctttggtagcatctccttcaaccataactcttcctgttgcttccactgcttccacctccttagtcgtggtgactgcagctgcatcttcctccatggtgaccacaccaacttcatctctgggctctgttcctattatactctcaggaattaatgggagtccaccagtgagccagagaccaggtaaggcctagatgttactagctgctttattttactgtacacctatttatataactttgtggttgtgttaggattatagatatatcaggataacagtataggtatttctgttgtaacatgatacatgtattcctgaaaacctctgcatgctgcaaaactgaacactaaaattaatagagctcatggttaatacgggattgcgataaatcactgaaaatatatgcagttttataagcagaacattaataacaataactgataaccttgagagataacttgaacaatcttgactgatagtttagtggagctggagattgcgactcaaaatactaaaaaacattacaatggaagtggtggctgaaggatactgaagtaatgcaggtaagactggagctctgagccactaacatgggcatgggaggaaacatgacctgtgtgctgagagctaggggtgcacatctttgaggagggagcctcaaatgcagatgttccttttgtggggtgtggggggtgctgctttttaattagagacagatgagcagacttcatctccttttgtgtagtaaaaaccactaatgaatcagcacctatttaattgctggacatgaactgattgaaatagaaacaaggaggcatatttgtttagggctctaatatttttataaactttttagttaaaatatttcttttattggcttaggttgagtgaatttgaaataggaatatcctacactttgtgtagtttttatatccagatgcaactagctaaagtaagtggttcttttaatctactcatagaggaactaatatggaaaagagcaagagactttgcaggatttgaggggaaataattaactaatagcaattctgtcttggttattgatgtttt

SEQ ID NO: 78914 - DNA, 1063 bp, Homo sapiens
cagtgagccgagatcttgccattgcactccagcctgggcaacagagcgagacttcgtctcaaaaaaaaaaaaaaaaaaaaaaaggtagatgaatattttttgtttaaattgcacatgattattttcatgaacagtttggttttgtgttttatttaatttttaagagtagtcttggattttctatataatttttcatctaaatgttatgaccatgactttctttttgaaatttgatatttttttgtgtgggcagagtgcctgtttgatagagaatcacgttaagctaaagtctttgttttgtttcatttgtttgatttttttttctcttcagtagcagactttttaagttttatttattaatgttaaataagcctaccaatttttatttattaatgttaaataagctcaccaatttgaatagtaatgttagaccagtttcatttatgcttactattaccatgattcctacctctttatctctttgatctaaaaaaaaaaatctagattactcatactgttttttcctatgtctttagtatttcgaaatatgtcttccaatcaggaaagggcatctttaaagtactattaatggtttgaaatctctattaattcacatcttctgcattaaatttctgctttttctttttgttttaaaaacatcttttgcctcttctaagccaggtttatttccctgcttctttgatgtctcttaatttcattccattttggggggcttaagtaattttttccttctgaaaaataattcccacaaacctttaagctttgcatatttgttagtgaattttaaaaaccaaaagccctttataaaccaaggatttttagttctttatcttcctcaggtggtataagcttagaaattgacccataactctagtaagtgttatgagctttaattttaaagttaaattgtgcagaatctggattttatttaaaaacataagaggccaggcacattggctcatacctataatcccaacattttaggaggccaaggcaggaggattgcttgagccccaggggttccagaccagcctgggcaaca

SEQ ID NO: 78915 - DNA, 2946 bp, Homo sapiens
ggctgaggcaggaggatctcttgaaccaaggagtttgagactgcagtgagctatgattgagctactgcactgaaggtgacaagtgcaaccctgcctctttaaaaaaaaaaaaatatagactgggcgcggtggctcacgcctgtaatctcagcactttgggaggccgagaacggcagatcacttgaggtcaggggtttgagaccagcctcaccaacatggtgaaaccctgtctctacccaaaaatacagaaataagccaggtgtgctggtgcacacctgtagtcgcagctactcggtatgctgaagtggaagaatcacttgaactagggaggtgcggaggttgtagtcagtcgaggttgtgtcattgcactccagcctgagcaacaaagcaagactgtgtcttaaaaaatattatgaatacttttttttcctacgtgtgttaaaggggaatttgggtaccatgtttccatttcctgtttttcagaaaatgctgctcaaattccagtggctactccacaggtctctcctaacacagtgaaacgtgctggacctcgattgttgttgattccagtgcagcagggttctcctactcttagacctgtctcaaacacacaacttcagggacatcggatggtcttgcagcctgttaggagtccaagtggaatgaacttattcaggcaccctaatgggcagattgtccagcttctacctttgcatcagcttcgaggctctaatacccagcccaacttacagcctgtcatgtttcggaacccaggtataaagttcttttttatgaacttttcttttgttgaatcacttggccatatggtatgttaatacaccaagattgtttttcttcatctcttaagagttacttttccaaaaagaaaagcaaacattggaagtcttgatatgggcagtcatgatttaaaaatttctctcttattttttaaaccagggtctgtgatgggaatccggttacctgctccttccaaaccctctgagactccgccatcttccacttcgtcctctgctttctctgtcatgaatcctgtaattcaagctgttgggtcttcttcagcagtgaatgttatcactcaggcaccatcattgctttcctctggagctagttttgtgtctcaggctggtacattgaccctgaggatttctcctcctgaaccacaaagctttgcaagtaaaacaggctctgaaaccaaaataacttatagctcaggaggacagcctgttggtacagccagtcttattcctctccagtctggtagttttgccttgttacagctcccaggacaaaagcctgttcctagctccattcttcagcatgttgcttcccttcagatgaagagagaatctcagaatccagaccagaaagatgaaacaaactcaataaaaagagagcaagaaacgaagaaggttctacagtcagaaggagaggctgtagaccctgaggctaatgtaataaaacaaaactcaggagctgctacctcagaagaaactctgaatgattccttggaagataggggtgatcatttggatgaagaatgccttccagaagaaggttgtgcaactgtcaaaccatctgagcattcctgtatcactgggtcacatacagatcaagattataaagatgttaatgaagaatatggggctaggaatcgtaagagttccaaagaaaaagtggctgttctggaagttaggaccatttctgaaaaagccagtaataagacagtccaaaatttaagtaaagtacagcatcaaaaacttggtgatgtgaaggtggaacagcagaaaggatttgacaatccagaagaaaactcaagtgaatttccagtcacctttaaggaagaaagtaaatttgaattgtcaggaagcaaagttatggagcagcaatctaatctacagccagaggccaaagagaaggaatgtggagactctctggagaaagacagggaaagatggagaaaacatctgaagggccccttaaccaggaaatgtgttggagcttcacaggaatgtaagaaagaggcagacgagcagttaattaaagaaacaaagacatgtcaggaaaattcagatgtgtttcagcaagaacaaggcatctctgacttacttggaaaaagtggaattactgaagatgccagagttttgaaaactgaatgtgattcttggagtaggatttctaatccttcagccttctccattgttcctaggagagctgcaaaaagcagcagagggaatggacattttcagggtcacttactgctacctggagaacagatacaaccaaagcaagagaagaagggtgggagaagcagtgctgacttcactgttttggatttggaagaagatgatgaagatgataatgagaaaactgatgattctattgatgaaattgtggatgttgtttctgactaccagagtgaggaggttgatgatgtagaaaaggtggtgagcccatttttgttgtgactgaaacctaaaggatttaaatgatttattaaagacagaagctttttcagaagagcactaaggcataatacatttaattggatgcctaggtttaagattatgacttaaatggcttagtagttctttaggctgtgtcaatcaagcatcatttattgagcttttattctttgagacttgtctggttttatgggaaggctggcttaaatatttgggggataggtgcttgagagtccctaccgagttagatttttaaaatcccgaaaccactactcccatttgacctcagtcaatttctatgacgttttctatgtgaggtggttgtagcttctctggtagatgttaatcagaaactgggaatgggtgaccttagaactagaggagaacttattcacttgcatatagagagatgtttttgtttttggagaaaaactggaaaataccatcatattctagtaccatt

SEQ ID NO: 78916 - DNA, 1183 bp, Homo sapiens
agtgcagtcctttgaggatgctgttaagtttaattatgtctgtttatttattttttatttaatttgttttgagacagtcttactcttgtctcccaggctggtgtgcagtggtgcagtcttgggtcactgcagcctcgaactcctggcctcaagcaatcctcccacctcaggtttccgagtagctgtaattataggcgagcaccaccatgtctggctaatttttgtattttttgtagagacagggttttgccatgttgcccaggctggttttgcactcctgagctcaaaacgatccacctgcctgggcctcccaaagtgctggattataggtgtgagccaccacggctcacatatatatatgacttatagttcttgattgttaattctaatgatatgttatctttctgtcttaattccttattatgactaacaatcttaggattatcagtactcatgatataacatgaatgtctggcattagttggttttataaggggaacaaacatttgaaaagtttaggtgtgcttgccactcaatacattatttacttttataatgatgtatttcagaataactgtgtagaatacattgaggatgatgaggagcacgtggacattgagactgtagaagagctctcagaggaaattaatgttgctcacctgaagaccacagcggcccacacacagtcattcaaacagccgtaagtcttatttctctttggattgttgtttttgtagttttgtaaccagaaacaaaatgagatgttctgttcaggagctctgggtaactcatctggttccttcttcctctagctttttttctgattagtatagatgaggagaggaactagaatttgggtaattaattttctttggtcgttggtaggaggcagtgtgtaaatgtgaataacatgcttttggagcccgatagactggtattataaaatattagttttgctagtttgtaggtatttaaccttgggcaaatctttaatctctctgaacctcagattctttacctatgaaatgaggaaaatgcccccatttgaagtgttaaatgaggtagtatgtgcaactagcataataactgatataagtggactactcaacaaaggttagtttcttttatcatttaagaataggcattacattctaaatttggttactttactagttgaacaggt

SEQ ID NO: 78917 - DNA, 1230 bp, Homo sapiens
tttttgagatgtattatttctcaagctagatggttcatatgtgggtgttcattatacgcttggtcctccttcacggatgggaagaccaagtttataatggaaaagcatgtatccacaaatatagaaagcatgtatttgtggattcacccaactgtggattggaaatacttggaagaagaaaaattgcatctgtattgaacatgtatagactttattttcatgtcattattccctaaacaatacagtataacaactgtttacttagtttttacattgtactaggtgttataagtaatgtagggatgatttatagtatacaggaggaggtgcctatgttatatgcaaatactatgccattttatatcagggacttgagtattcaaagatactgctggaagttttggaacgagtcttccctggatactgaaggacaactttaaatttgtttatatggttttgtatattaaatatttcatgattgtacaaagtaatttgaagttttagtgactatttgtacacttttagagaaaatatataatgtcaagtaaataatgtggccatatatcacaccttgggaaaaagaaactggttgtaatttggaatggtttggttgtagctgtgaaataggtcttagattattaaatttcagtaagacactgaaaaatcctgtctttatccaggtcctgtactcacatctctgcagatgaaaaagcagctgaaaggagtcgaaaggtatttaggatatatttagtgataattactcattgaataaaattgttaacatttatcttagggttgaaacaacattagctatattagccacgattttttctcagggctatttttgccagtgagttaatataatcagttttttctccttaatcaaattatactgctaatgtcctttttttcccttttaattcttctcctcagaggatagactaatgtagaggagttaaaaatggatatgaaatttatgagaatatatgtggttatttgaaaactgttcttgtaatggtctgatgtaaaacaaggtgccattctttcttgcttgggctcatgattttaagtgatttaaaaaactatgctctgcaaaatggctagcagttagggatccatgaaaaaataaacctttaattttcttaatctttttggtttatatcatagtaacataattaagcagggttttttgtttatcctaaccaacagtaggcatggaggagagtttgg

SEQ ID NO: 78918 - DNA, 3158 bp, Homo sapiens
aaaggaggctttaagcctttctggggatcaagaaggactttcctgaaaaagtgcagagtttgagttttaagtgttaagttttaaatgttaagttttaaatgttatgggggtttaggtaagaggtgggataagtaatctaggtacaggtaaaaagcctgtgtaatgtcagggaggtgtgggattgtgtagtatattttgggaatttctagcagataggaatggttggagagaaaggtgatttagaagagtggcagttgattttttaccagattgaggaggatcttacagtattttttgaaaaacatttaatgtaatttgtatcatgaaaacaagttttagtaatacaataaattacttaagctctttcagatctcgtacgcctgtaacatatacaatttcttcctcatttgaaaatcactgaaatttgaactgagagctggtaagatcactttagcatgtattagaaattacactgttggcattgtaagagttagatttgaaggaaggatagactggtagtaagatgaccaattgagaggctgttacaacagtccagacaaaaggtaatgagtgcctgaaatagggcagtgtcatttgaaacagagtaagagggccaactacatgttcaagatgtttaggaggcaatcttgtttggacaggctccaccaattcctctaaaactgaagcctgattactggagtgacaaactacagaaagaagcagaagcgtttgcttattatcgccggacacacactgccaatgagcggcggcggcgtggtgaaatgagggatctctttgagaaattaaagatcacattgggattacttcattcttccaaggtttccaaaagtctcattcttactcgagtaagtgttctgtgtaaatgacagtaagagcttgactaagagattcttaccgatgatatgagaaagataatccactgacatataagggagattgaaatagagctgcttaaatgtaacagatgaatatggactagtgaatgcccagtaaatcccttagggggaaaatcattatgctaagtcacagtaggttttcattgaaagtcagatttttttttttttcttttgagacggagttttgctcttgttgcccaggctggagtacaatggcacgatcttggctcaccgcaacctttgcctcatgggttcaagcgattctcttgcctcagcctcctgagtagttgggatttcaggcttgcgccaccacacctggctaattttgtatttttagtagattagtagtaattttgtattttgtatttttagtagagacggggtttctctatgttggtcaggctagtcttgaactcccgacctccagtgatccgcccacctcagcctcccaaagtgctgggattactggcatgagccactgcacccgggcaaaagtcaggttctttattggcacagctatcctttcttcagatagagtcagaaactctggttagccatgttgaccacattctcgttacattggtgttcttgatagcacttagtacaggttatcacagcataaagcacagcataagtgatattttaatatgcttaacagttgacagtcattttaaaagaaaacctgaaatattcaagggagcagaagttttaattttgcatgtagaatatctaaagtaatttcgtttaaacagtttttaagtagaaggtggaggagtacaggataagcattcatatccctctagagcagttatttcaaccagattttggttagactaggagttgatcttaaagttgattattaaaatctaagcagagcacaggtgttttgtatctcctcgcagtggtggaatacctactaccattcagtgatgctctttggaaataatcatggtcacattccttaaaagtgtaagccagaaatcctcttacagtttaacaaaaaataatttctgaaacatcaacaattgttaatggaatttaaaaattctcttaagatgtcagattaagttttttttcattagagaaattgtataggccttagctgtgtttaaagaaagagtggatcaattttcaataataccactatttgtattctaggccttcagtgaaattcagggactaacagatcaggcagacaaattgataggacagaaaaatctcctgactcgaaaacggaatattctgatacggaaagtatcgtctctttcaggtgagataagtaaataatctctggtaaagagcataattatagctttatcaagaagaaatcctcagtagatctttcagatacttaattgaaagcttggctcccacagtttacagcacagttatcctttgactgggtggtgggttgtttcttgtgaattgtaatcaccttactttccatagtttttgggaatatagttaaagcaactagatttctgttgactctgtttctcattatgtggcgtaatgctgaaagtgctaatgtattctgttaacttacaggtaagacagaagaagtggtcctgaagaagctagagtatatttatgcaaaacagcaagcactagaggcacaaaaaagaaaaaagaagatgggatcagatgagtttgacatatctcccagaattagcaaacagcaggaaggatcttctgcatcatctgtagatcttggacagatgtttataaataacaggagggggaaacctttgattctttccagaaaaaaagaccaggccacaggtaggagggacattcttcgctttccttaatgtagatatacatcagttgactttagtggactgaccaccttctcttgtccacatttttagttttgtgtggttttttttttttttttttttttttttttttggagacagctctgtcgcccaggctgcagttgcagtgatgtgatctcagctcattgcaacctccacctcccaggttcaagcgattatctgcttcagcctcctgagtagctgggactacagcgagcaccaccatgcccaatttgtttttttaattttttagtagagatgggattttgccctgttggccaggctagtctcaaactcttgacctcaagtgatccacccgccttggcctcccaaagtgctgggattacaggtgtgagcaaccacacccagcccacagttttagttttaattaaatgaattaaagatgggttgtataaaaagtaga

SEQ ID NO: 78919 - DNA, 5577 bp, Homo sapiens
ccttttatctataactaatttctgatctttcttacagaaaatacctcacccttgaacactccacacacctctgccaaccttgtgatgactccgcaagggcaattgctcaccctaaaaggtcccctattctcaggaccagtggtagctgtttctcctgatctcttagaatctgatcttaagcctcaagttgccggtagtgctgtggctctaccaggtatgttgtaagtgttgtcctctatgggaagtgataaagttatccctaacatctcacggtgaccaaggaaggctttggatgtgttctgtaatgataaagagctattctgttggcatttgccttggtaagaggtggccctatttttagaacacatttggcttgagctgtggtactgtttggtgtgttttacacctggtattgggaaccattttgtgaacactagtaatttctaagaggaagaataaaaaagatatcagagggaaaggaagatgttaaatgatcatggtcttaggtcttggtgttgataaatatttgtcactttttgtggtactcagagatgataacagtcctgcattattagccccattcactttgagcactactctgttttggggcaaagggtaaagttgaaagagaagcctcacttgggtgattaggttccaggcaactaaatttctattaagatgaaagggtctctttagtaatattaggatcctggttactttattgccattgccagccaaaattccttgtctctacctgttgccaaactcactctggaggactcatctttcctggttcccatgctgcctttagggcttcattttctgcgctaagtagcagttaattaggtgaacagaatcaagatgcatttctgccttaggagaagaattaacttggggagcatttctataaaataattaaatggaactttaaaaaatggtggaaagagccttttggttggattttagttgagatttttcttgttgggttaggtcaataatttgaagaactgatatttctttcatctttttgataaaagtagagtgctgaatttagactacaaatccctaagatggttatatgatatgacagagagaaagagaggtgttaacactagatctaaatgaatttttctttttttaatttttgtttttcagaaaatgacgacttatttatgatgccacgaattgttaatgtgacatcattggccacagagggaggtttggtagatatgggtggcagcaaatatcctcatgaagttcctgatagcaagccatctgaccatctgaaagacaccgtcaggaatgaagataattccttagaggataagggtagaatctcttccagaggaaacagagatggcagagtgacgttgggtccaacgcaggtttttctggcaaacaaagattctggttatccacaaatagttgacgtttccaatatgcagaaagcacaagagttcttacctaaaaagatttctggtgatatgagagggattcagtataaatggaaagagagtgaatcaagaggggagagagtgaagtcaaaggattcttcatttcataaattaaagatgaaagatctcaaggactcaagcatagagatggaactgaggaaagtaacatcagctatagaggaagcagctcttgattccagtgaactgctgactaacatggaagatgaggatgatactgatgagacactgacttcactgctcaatgaaattgcctttcttaatcaacaactaaatgatgactctgttggcctggctgaactacccagctctatggatacagagttcccaggggatgctcggcgggcttttattagtaaggttcctcctggaagcagagcaactttccaggttgagcacttgggaactggtttgaaagagttgcctgatgttcaaggggagagtgactctatcagtcccctcctcttgcacttggaagacgatgacttttctgagaatgaaaaacaacttgcagaaccagcctctgagccagatgtccttaagattgttattgactctgaaataaaggattccctcctttccaacaagaaagctattgatggagggaagaatacttctggcctccctgcagagcccgaaagtgtgtcctcaccccccaccctacacatgaagactggcttggagaacagcaacagcacagacactttgtggaggcctatgccaaagttggcccctctaggtttaaaagtagctaatccttccagtgatgcagatggtcagagtctcaaggtgatgccttgtttggcacctatagctgccaaagttgggtcagttggacacaaaatgaacttaacagggaatgaccaggaaggccgggaaagcaaggtgatgcctacattggcacctgttgtggctaaattgggcaactcgggggcctcaccaagttctgcagggaaatgaacttacttgtccttaagcagaagccaggctgtgaggggaaatagatctcacctcctttctctgcaggcatctgtttgtttgtgtcttagaacttggatccttgacttcaatgatgcagtggataatgatgggagaaagggggtagggtgctgaccctggtataagaagtactctgaaattctgatcatgttaaaatgtgttacctcacttgtggtgctgggtcccctcatcctctctaagaagatgtgatccattactgaacatgaggtgcccctcttacccaaggaatttataacatgactctggctccacagtggtttctagttcttcccccacaagcgaaagagctgtttgcaactttggagttgctgtagactgaactgtagcttgtagctgttgaattaagtccaaaatctaaggaatgcgatggacttgtgcaaagggatccagaagagacactttttagttgatgtttcaagaatagggagagagaggatgggtaccatggaataccaaagtgaaggactttgtgtcattcagtaaaattttcttttttcatatcctaagtagctcccattccctcaccttttcaatcagaattaacaaattcaagccttcagtaaagtagggatgcttttaacttttattattaattattttgagatcttaaaaaaatagtagttctcccttattatttttgtgggcattgaaaagctcatttcacagtaccagagatttttactgggagtatatattttggaggtaggcatagagggagccctaccccttccacaaattacgttactcaagagacagctaaaataaaatgcattatctccccagaccagagacagtggccaaaataaaaaatcatggggctggaaatttcccaaatcaaaccagcctcctggtgcttgaaggtttcattcactattacctgcacaggatgtaaagaaaagtcacagtaggcactctttaccagggaaataaggcagtatttgaatcacaagatatattttttatctgcaaccatggatccaatgatctgtagagctttttcactcattaactgtcaggatatgaaggactgacagtctgtaaagatatttatatttttgtatagttgttttcatagatttctcaaaggctgaagttttcaacctagaagatgagatttgtattgagtatagaaatgatgtttcctatctagtttgtaaataatcatggtgcacttgaggggtctcttggaaactcctagggggtcaagaatcactattctgaaactgtatagactgggatttagctgctgcattttgcctttcttaaataattatattttggaatgtaacccctgttctgtcttcattgacaggatttgcttgtgttgttaaaacactaacacaagagcttccagtgcctgggccgtgcctaggtgatgctatttcttctatatctcctgtcttctttatcccaaatcccactcagcatatcttcagacctaggttgtaagaccaactttggattggatctagccagtgaattattatttccatggttggttccctttctgttaactctggtaatcaacagattgaaaacggtggaagaacttctgaaaattgcagtgggagcaaattcttgttggttttgtgctgcttgcctttctagatctgctcatcagcacttaaccttccctcctctaaaggttactaaagaagcctgaagtaggtaaagagtgctcctcagcttcttatccttccactctttacccagcagatttcattcaatgccttagccaaggagtccagcacctgtctcccctgctaataattgtccttagagatgctagtactttaatccaggtatagcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttccttttttttttttttttttttaagaagaatataggtaaacaggtaatgattcttgattggagataccatttgactcttgatgagagttgtacgaagatggaaatgagggatgattccaggcgttttagggggaaggctgcagataccattctaacccccaagatactgtgttctcaagacctcttagaactaggtgttgtcagggataatttgaggagggcttagtcttcagaacaatcctgcagtcttgacagaaatctaaaatctccaaaaactcctaccctttaaccttaccctagggggaactgatctatgaatattacatgtgtgattatgaaaggtgaagttgagtgagaggagttgaggaacgtggaagacagtgagctctcaccctaacactataagaagcatgatctcaatagaccaataattcacctttttatacatctgtaaataaatggaatgtttttaagaatataattatgtcagatttagcattttcttttatatattaaatatatatatctttccttttctgctttcgaaaagtgactatttttttagaaatctaagaacagaagtttggtgattgaaaggtagaatatataaacctgaaataaagcagttaaaacaattaaagcagaacttggtgttgggaggtttgtgccaacttggagtggagaattctaattccctaagacatatttgagagaggtgccactgaagtggttttatcataggaatcctttccttttctctaagtttctgatatgccatttgggggaggttttcgatgttctaatccttgtagcatgttttacatggaggcttcaaaattgtgtgcaacctgatggcaagtatttgttttagaagtcattctaaaatcattctggtgtcagtatgagcaaggcagttcacctgttaaccttggggagtaaaggtacacaaacacagtcttttagtggtaaaggacagtaggtgttcttaagggaagatatgttaaagagtttgacagttaacaaaaacgtttaaaggaatcctttagacatccaactactcctatctattaaggtcactaacagatcaagtccagttatataagcttcatacaaattgttcactttgtg

SEQ ID NO: 78920 - DNA, 1144 bp, Homo sapiens
cgtgccggactggctgcgagcagaaactacttcagtcgctttaaatctcaacacttgtggtcgctgggagcagagcttttaggctgtagctcagtcttgtaattctgagctaggagtttcagctacggtccctcgggcctatcagatgacaaccttaacaccctggaggcgtggttatcgtcttggggctctgggaagtgcagttccatgggggaccaggcctgataataccataaaaggcttggttctctcaattctgaagccatgttctgttgaccttcctctaaaagcggtacccgcaattgtgcggattccgtggttccctagtcccaagccgtctgcttcctgggccctttcattggctccgcccccgtaaaccttgctcgtccactctggaagcgctctcctgactacaggccgcgcccctcgcgtcggctccgcccacccagcccgcggcttggcccaggcggtagttcgcgttttgagccgatcgtgccaccatagctcctgctgctgcctctaccgctgcggctaccgcggcggagctgaaattgccgaacgcgatgcccgagggcgctgtgagcggggtggccttagctcgccgaggctggtgaggctgggcccgaacgggggcgctgacgagtagcaggggcctcagaggcgggtgaaagataaaggtccagagccgctgtggagggcggagagcgagctctggaggatagggagtgggggagggaggctcccgtggcagaacgagttgtgggctacggcgagccccgccgcgtccccgccggcgctagcgcaggtgtccaggcctgcggaaatccctggtggtctcggcggcctcctcccttggacactacagttgccatgggaacagttgggcattaacgggaaccagatcgtccacgagaccaactggggcccatcccatccatctcgccagttaaacgcctctggcgggcgtgggcctggcatttcttcgtggcttaggattttccccccctttttcgtgagcctttccttccgacgttgtaagaaactgtgcagggctagaaggtggggatgagggaaatggtgagagcaatacccagaggtaaaagctgcagacttcgctaggcagaaggtaagacactgtgatact

SEQ ID NO: 78921 - DNA, 1033 bp, Homo sapiens
gtggaggtggagatttaagttacatcaaagagtagatgagtgctgagatttttattaagctttttcagagggaggggagtctcttcagtggagtacattggaaaagactgatttaaagttttatgctaaatcagcttagtcttggtgaagtgtgacttgaagttatcagtaaatacccaagttcaaatcctgtagacttgtcatttcctgcctctcatctctaagttgggctgtgttttccttaagaagcaaatgtatgtgttcttgatagctaaccctcctcctctgaaagtttctgaaagatttttatgtggagggagctgggcttgttttcaaggacaaaggatagaaatggaccaaagcccagcaggcaagatttaagttagggttacaaaaggattgtctgtgctggagggttgctagatttttaaaaagtaactgaaggaggtattgagatcgtcctcctccttaagagccattaatctgatctaggttatattattccttctggaaacaatgggtaagatgactttcttctagttgtgtttttttaattgtaaatctaattcttctttctctatttgtttccccaagtttttttcctgtatagttgtgtggtggtacttcgagccttttgagaagtgactctaagaagagtttggttgggtgggtttcatgaaggagaaaaagtggcaatactctaatttcagcttttgctcagtgtttgaacgcatatatgatttggtattggggaaacatactcatttttttcgagacggagtcttgctctgttgcccaggctggagtacagtggcgtgatctcggctcactgcaaactctgcctcccgggttcaagcgattctcctgcctcagcctcctgagtagctgggattacaggcgcgtgccaccacgccgggctaatttttttatttttagtagaaacggtgtttcaccatgttggtcaggctggtctcaaactcctgacctcgtgatctgcctgcctcagcctcccaaagtgctgggattacaggta

SEQ ID NO: 78922 - DNA, 1036 bp, Homo sapiens
aaaaaaaaaaaaaaaaaaaaagaaaaggaaaaaaacagtggagcccttctgagctctttctacccagctccctctgccgggtgactggaagtcctgggtggcctggagggctcctgggggagctgtggtttgctgctgagcctgttgtctgctcatctcctcaggtgtgtggttgtgttgttcaatccccggaaacacaaacagcaccacatcctcaacagttccaggtaaatgggctggggtcctcaggatacctcttccttctgggagctatgagaagggcactgtctagagtctctatggctctgggggctgggacctggttgggtcctaaagccagatggggaagtgccacatgtgccattggtgtctgctggtctcaccttttgagaggctgggagggggctaggcttaggccaggctgccagtgcccctctgagcctgccccatctcttgcaggaaaaccatcactgcccttgccttctcccctgatggcaagtacttggtcactggagaggtgagtgaggaagagggctggcagtactgtaaagagggcaggtgtcctggcctccgcagagagctgcggtcctaggcctgctgtcactttggcttctgaaacagacaccaaatcctggttttcgctataccttaaaatagtggttctcaagctttagtgtacatcagaatcacttggagggcttgtgaaagcacacatcactagcctggtcctcagagtttctgattctgtaggtctgggatgggagtctgaaatgtgcatttgtaacaagttcccagagagtgctgatcctgctggtgaaggaagcgtgctttggaaaccactgccttaactattccttacccccgggggccccctgctgggctcaggaggaacgcttctgtcctggcggcgtagtcttactaggggcagaaatagacctgagtggtagtggctctcaatgccggctgcccatcagaaccattcagggagctttgaacaacctgaagtacagacggccacccagagatgctgactaaa

SEQ ID NO: 78923 - DNA, 1029 bp, Homo sapiens
ggcggcaagcagcaaggaccatcctctccccaaagggcttctggacccaaccggtgagaacagaatgtgggcaagtgatgggtgggtgtgcagatggcttgctgggacctcactgcacttcctccatgctttgggcctgccattcagcaactctgtctcccaagaccttacctctcacacaaggatccatgatgtcagcctcttccccctgttgagtctcctctccccctattgagtctcatcttcccctcattgagtctcctcttccttcttcccccactgagcctcctctccccctattgagtctcctctccccatgcccttccttgtctcggactcaggcaccaggccccatcaatgctgtctcctggaccggctctctcatcagacagtgacaaggagggagaagatgaggggactgaagaagaacttccagcactgcccgtccttgccaagagtaccaagaaggcactgggtctgtggcagttgggtgtgggggcagacaggccctagttggtataatggctagatatggtttttctgagactgtggggtgagagcagtgtgagctgaggaaactgaggcatcactgtggccacacagggtatgggctgatggggccagggctccagggttgggtggcggggggggggcaggagacacttcctctgactgcctgtttctgtctagcctcggtccccagcccagctttgccccgaagcctgtcccactgggagatgagtcgggtgagtcgccattgttaaaatgttcttccaaggttagaggaggcaaagggagctgtgagaacagggctctctgggcctggtagggtactggggcatggggtctgcccacatgctgcactcgtgtgtccaaggaaggccttgtcggggaagttgaagcagctgggctggtcctgggtgcgggggtgaagaaagcccaggtatttccttcctgtggaccagttggggtggatggagcacagggttagtcagcactggggaggtggggcacttgttcagctgcctg

SEQ ID NO: 78924 - DNA, 1054 bp, Homo sapiens
ccccagagtctgcctgcatcccatgttccctggccatacatgctgatcttggcgggtagagttcccagctagtcccttctgaggcaggctggacccaggtggggcccctcccttttatatgtctgttgacaggctcctccacctcacttctgggggtgctatttcaggtggctggctgcaagatgccctcagcagagcaaagtcggattgcccagctcctcagagacaccttctcttcagtgcgacaggagctggaagctgtggctggggcagtgctgtccagcccaggcagcagccctggggctgtgggagccgagcagacacaggccctgctggagcaatactcagaactgttgcttcgagccgtggaacggcgtatggaacgcaaactctgagttctggaagcctgtcccaagtgaatgaatgctccagcgattccaaactgcagcccctctgcccctcaccaaaacctgcggggctgcttggagtggaaagcagggagcagtgttcagaggcaaagcagccttcccagccgctcctcgtggggggcctgtatttattaatttatttccctgactgttgcctcacttccttggaactcctgcctccacagcccctccagtggcagggacaggtcttgggtctttgtcatcttggtgctgtgagaggtaggagggcagcctgccccatctaggaatctgggaagggctggccctctcttagaagccatttgaaattactgcagggattagctccctgtggtggagcatacacagggtactctggggtcgaggtgagaggtgatgtggtattcagtgcccgtcagccaactgtgggccttcacctctacctgcacttcccctctcacaccagctgcactcccgtggctgccagagcagggtggttttccccaatacctggagctcagaaaggcagagccatctggccctccagggtgtccccagccatcaggagacttgagttggtatttggacctgagcccgcacattccactcccattctccctccaagaggggcccagcattgtatttcc

SEQ ID NO: 78925 - DNA, 2782 bp, Homo sapiens
gccctgtggacggtcagggcccatgctggtgtgtgtgcgtgatgctttctgctttcatttttccgtcctcatctttctattactggttgtccagggtcctttggtcaccaacgagcatttcccagtgacacagcgcggcctttccagggagggcatctcttgggcagggactgggtgctgcagacatcagcccttccatcccctgtcttcttctttctctcagagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcaggtgggagctgccctggggtcaggtgtgagcagtgattactggcatctgggcatgggctgagtgtccattcctctagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggtgagtggaggtggggtggtcgtggccctggacagggaagatatgggaaggaggggggtcagcctgtttgcccttaggtgatgacctggcctatgggcttggtcctgtcagcatctggtgcagctcactaaatacattcccaggccttgacttaatcatagatgaattgccaaagattgttgtccttccttctgccccagggagggaggaccccttccccaagatttcccaacctctgcctcttctccctgacccctttcttgggattcttctgtgctcacccaggttttggctctggcatcactggatggcagctttccccagcctggccttcctaacttgctctctgccttctgccctgcaggaaagatgcccgatgctgtgaacttctggctgggggaggcggctgcagtgacttcttgtaggtgtaaggggaatacaaaggtggggaaggagcaggttggggcagagggagggaagacgaggccaggagtggagggatggccctgggtggaggttgggctgttctctaagatttcttttggcttctaggactcgggcaccacagagggtttcccctgacagctgaggtcggggaatggacccatggcattgggggcgggtgcattgtttcttctagacccaaagaaacctccctgaaggcccgctgggccagggggtaagtgtaggagaacttcccctcttgttgaagaggagtccagggcctggtgagcatcaggtccctggtaggcagagttccagaatgcccatcagagcccctggcatctccagcccactggctctgtgcgtgcttctcttttgtcataggacgtcttggggtgcagggctctcagcatgatggtttgcctcctcccgtgcccctgccctccataccctgcccccgggccttctttctgttggcagtgcacaaggaccactatgagaacctctactgcgtggtctcaggagagaagcatttcctgttccatccgcccagcgaccggcccttcatcccctatggtaggggatgtggcctgcagggaggggctggggaacagctggcccaagggggagggaggcagcaagagcctgggaggccagttcccaggcctgaggtgtggctgtggcatccccagtgcaccagggcccctgatccccttgcccctgcccagggctggctggggtggaggagggtctggcaagttccaggctgtttgcaattcccccacacccttctcccttgggctccagagctgtacacgccggcaacctaccagctaactgaagagggcacctttaaggtggtggatgaagaggccatggagaaggtgtctgtcctgttcttgggctctagggagggagaagggcagaagcctggctctgaagaacaggcacaaaagatctggggaggtggcaccttgctctgaaaagtctctaagtctgaggcctttcactgctgagccaagcagggcctgtggtgttgacctttggaagggacagagcctgaagtcctggggggtctggggggctgctccctggcatctgatgtgttcccaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcaggtgaagagttgcccaggccgcctggggagaggccctgtcaaggtccagcagggcctctggggggaggcttgggaggctctaggtcagaagagggatcttcatgctcagatccccgttcttcccacagtgaatttctggtatgacatggaatacgacctcaagtatagttacttccagctgctcgactccctcaccaaggcttcaggccttgactgatggagcactggtgaacaccaccaagcacgcctcgggggacggagccagcccctccctggccaggtcaattctcgagagagcctggagtgtgcatgctggctgctggccccgggtccagcatggcttgagatcagctttggag

SEQ ID NO: 78926 - DNA, 1367 bp, Homo sapiens
atgccctggaggcagaagaaccccctgcccctgagtgccaacccacaggcctcatccctggccactcagcacctagctttgaagggctgttttatgtgacagccactcccctgcctgtcgtgagggggcccgggtgttcatctcagattgatggatccctgccatcaagactgggcattcctgtccaacaggtgccagagttgcgaaaggcctgtgacagggaactccactcttcccttggctgctgttctgggactcacccctgctttccttctgctcagcccctggcagcaagctctccaggctgggattgcagggctgggtggggcaggcccagctggtaaaggctggcgagtgccacagaggtatcaggagctctagtataggcttagggtgcctcatttcctggacaggtggctggttcaggagtgggtgtggagcttaggtggagcagaggcggcgggtaggagggacttgggaccaattgggacatcacatccctggctctgggttagaaagctgacagtccttgatcctgtggccactgccccatcattcctgctcctgaggactcagtctcatggctgtggtaaggcctggcagggccctgggtccctactgggacccctggtctctacctggggcctagttaatatgtttcttatgggagctgtggtcttctccaggggtagggaggggagtttattgaccacaagaccagggtagcgggcagaagccaggggaggaggaggcttggggatgagggatccgtcctgagtgttttctgtcctgggaacgggctcctggcagagctccctggcaccacagatttgggccctggagactcagaggctcccagctgccgccctgaggccctggaagcaagtggctcctccatgctcctctgactcagttgcctggagtgtgagggccctgggctgaccctggtggatgaggccctccagcactgccctggacctggttgctccctggacttgacctgttagggtccttgtggaggcaggtggaaggccgaaaggaagcagttggcacaggcttccctggtcccggtgcgcctgccaggctgcattcccagaaccaggggcatgggtttggagggagctaccgggggaccatcttcagcctgacctggcaggacctggaggacatgacagcctgtgaggggtctgagctaggagccgcctcccctgcccaggagagagcccatttccaggatgctcttctgaccagggtggagggagggtacgagagcagctcagcctggggcccaaggccctgatgtgctacttcccctccctcgatagcttatgtcccctgccacccaagaccagccggaaagctgctta

SEQ ID NO: 78927 - DNA, 1216 bp, Homo sapiens
gaagcccaggccacaaggcctgggcctcctggtcctcagctgccctaaagcaaaaccctgggtcggggtgggggtgtgggtgcctaagggctctgcaccatgaggctgaggcgtggactcctcacagagtggtgcgagttctctccctacgaggtcggcttccccaagtacggggccttcatcccctctgagctctttggctccgagttctttatggggcagctgatgaagaggcttcctgagtcccgcatctgcttcttagaaggtgaggggcactggcaggctggggaagctgggccgagcagggaaaatgggtcctgggtgagagggcagcctcggtcagaagagtttcctgggccaggactggccatggggaagggtaggattgggacaagagtcgggggccctcttccctcacggccgctctttcaggtatctggagcaacctgtatgcagccaacctccaggacagcttatactgggcctcagagcccagccagttctgggaccgctgggtcaggaaccaggccaacctgggtaagtgctccgggcccttcataagggtgccaaggggcagccagctggggctgcaccagggggcggggggttcacacctcttccccctccagggtcaccaccaaggtggggataaaggtgcaggagtccccatttcccccaccttgcctgtgtagacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaaggtacctgcttctctccaaagtcctcctgtggccacctgagccttgagtccccagtccagatacccctcacagtccactcccattctcctgctttgagcttgattccctggactacttggaacaggggtctttttctccttgtcttggggacccagggcccacctgcagggctgtgggggtgttggttcagcaggagagcagggaccagaggccagagtctctccttccagcaggaatctggtacccttggtatctgtgacaattgctgctctccccaaccttccagctaccactctggatgggctccccaaccagctgacaccctcggagccccacctgtgcct

SEQ ID NO: 78928 - DNA, 1071 bp, Homo sapiens
ggtggtgacattcaaagttgtctgaggactagaaggttagagaagcacccagatcagacagaacagagcctggaaagcccttggaggaacacagtccatgaggattctggcaggaagggcttggggcagtctgagtggcagactccaaaaggggcagaacaggaccaggacacagctgggggttcaaaactggccccatctctgctaattagctgtgtgatcttgggcaagttgcgtaacctctccaggacctaaattctttgaggaaaaacagtaagtcccacttcttggaggttagagatgctaactgtgaaacctccctaggatgcataaaacactaggggcccaggagcttggggcccagggagtcggccgccctccccgcatccttcccctgaagcccacctgcagtgctgcccagggctcgccaccagctctcagcctgctcttcggacggtgctgcaaacaggatctctgccccactggtcagcctggcacccacagtcacaggtcaaactccactgtccctttggggacccccacgcctccagcccccgctgagccaggtggctgctgggggtgatgccggagtccatgtctctccgctcaccttaaggagaatgtgtgtttcctgccgtggcggccccgcagcctctcacaccgggctcccgtgaggtcaaggagggctatggaagctactttctgaggagagatgagaggcaggggtcactgcggccatctcagcttttccctgtggggtccctctgtcctggggcccctctgccttgcttcccagcaccctgatgtctgcatctcccctaccccgcctggtacctccgctgccatcctctcatccaggaacaggctcagagagctgccctgcaagttcccgcggcagctgtcccaggagctcgagctaggctgtggagaggaggcgggaaggtcgcatgagccacacgcaggaagccagagctagggcctgtccacgcctcaccatgtgtgtggagcttcccaggaaaagcggtggattggaccaaagtcccaatggggaaagggaagccacagaggggc

SEQ ID NO: 78929 - DNA, 1071 bp, Homo sapiens; identical to SEQ ID NO: 78928

SEQ ID NO: 78930 - DNA, 2929 bp, Homo sapiens
gtgcaatgccaagatgtttgaaaagaggaacagggcagggcgaggggtggggtcttcaggtcagaagttgctttctagccctttatgaccccagttgtcatcccgttggtttaacatttctctttagaaaactgtagcctgaagaaacattacctttgcccttctgaaccacagaatgacaagatgcattgtcacggtcaaagccttgcttataaatgtttgacctcatcacatttgggtggagtctgttggcattttgcctcaagaaaattcagtgcaagtaatgtttgccacgccaactccgtctgatttatagacatattgtatgagactttctagcctgacttatacacaaagcccacttgaaaaatgaggaatggacaatttccatgtgcgtgacacgggattcctggatctgttcatcctaatatataataatatcagaaggttagatggggtgacttcttaagcatccttggaagtcatacattccacaacccttcctcagatagtttctttcagtatagagttgtttggaattggatgacaataagttaaactttggggcaactaattacacctatagaaacattcaaggaccttcaaattggcccaaatgctatatagcacatgaatccagtagaagggatgtaataaaatgaaacttactgtttgataattgtgtcatttagagttgttcattcagtattcctgtagccatctgaagggtctactgtagccatctgaagggtcatcttaggctggcactgtaactagttcgtgtctgtactatacagacgctgagctaaatcgattttcctgggaatctggctttttatttcaaagaagcttactgtttggaaccaccctatatagctaaaatttaagatctagaaagaatcctttttgatcatctgactcacaggtatagaaactgaggcccagcagaatgaaattgttaagccaggctccaggacttacaggattttcttggtaggtttttttaccaacttccctctccagcaaagagcctaaaatgactgataataccatgttgctgtctttctccagggctcagccttctttaaatgggcctgcttcttcatctggtatttaatctgagatggaaagtgagatgcgaaacccaattttccctttcacttggtcacatgcccagaagcagcagcgttcagtgggccgagtactggcgtggaaccttcctctgttcccatgtctgtggcgtggcacgaacctgtgatgtggggctctcccgcccttgccctggaggggccttcagggacatgtggctcacccatctgttattgtcacatatcccccagaggaaggagggacaggctgtgaggttagcttgtttattttatgaggaaacaggcacagaaaaattaatttacagagtcttggacaaaatcccaaaggaaggaggagtgggaagagcagagagcggataaacagcacaacgccatccctggacacgcctagttcttgcttttatttaaattttggtaggttctgtggccacacccactttaggctaggtactgggagacaacctctggggttttctggtaaccagttacattctccaagaggtggccattaccagctgaaaggttcgaggtgaactcacatccagcctctccaaaaggagcttgggaacctgtgttccctccgggcagtctcccagaccgggtttggtatcagcccctccctgccactgccctgcatctggtcagctggggaaaagggggcagggaggagagaaggccagtggagcagagccattcattctgtggcttattttgtcatcagcaggtcccattgctcccgctgattggggactgcctcttcctcgggggtgtagttgctgagatactgcttccccctcagggtggtgctcggcacacccaccatagcctctggcagggaaatgctggaatccagaccttcaccagaagcaccattgtagaagaaaaagaacaacctcctcaataataatgcaagtgggccaataatttttacaatatgcatatttgttttcttgatataaaaataatatatattcattgtagaacacttaggaaaccacaaatcaaaaaggagaaaataaagtacactcacctctgattctaccatcctggtacacatatggtgcagcgcagcgggtgaaagcacaggctctaggatccgagtccctgggtttgaatccgggctcccctgagaaacagctgtgtgccttgggtcggatacttaacctctctgagtcttttttcctcccctgtaaaatgggggtaataaaagtacctacttcatgggattgttgcaaggattacaagattgtagtgatatggagctcacagggcagtgcaggaatgtagtaagagctaagtaaatatttgctgcagttgttgatttatagctatcattttgctctctgccacaatgacattttcagaagacattttcagaagcagacttttctagttgcgaagtaaactcagccaggaaacaatgcagagactccttgccctgaagtggctgttattattaactaaagggactcttttcgaagtgtatttataatacctgagcgatcccagatagttgatgtttactttgagatgatttacacttcccctagttagtaacaacccttttttagaaacgcataccactatttaagcaactaaacttgccagattgctaaaaatcagttacatttcttgttcaagtgaattcacttgattaaaccaattttactgtattttactgtgataagaacacttaacgaaatctaccctctttacgcatttttaagtatccattacaagcacaatgtggctataggcacagtgtggttccgcaaatctctagaacttattcatcttgcctaactgaaattttatgctgg

SEQ ID NO: 78931 - DNA, 1047 bp, Homo sapiens
caaaagaatcgacagagctaggaaatggggcctggacatccaagctgtgactaagaggggtgcagaaaaaaatgaaaaaggcaccagcagaccacaatcagggaagtacaaatgcatccacttttgaactttgaagacaaaagaccggattttgaagcttgctcgggaaaggagagagaacacttagagatgtccagataagaatgacttcccctctcaggctttggtaacaagaaggatttgagaggaaaacacacacatatgcaaaaaagaaatgagtcttttttcctaaaagaccaagaaccctcagttcccttccattgctctatgtgtctatccttctgaaaggctgttgatcagagcctggctggagagatgggtgagctctctagccagccaaggcagggcgctgtaggccagcgtgcagacaaactgagacgaagacatgacactcttaccacagcctctgcctagcaccgagtcgagggagagagaactgtggctgcccttcctgttgatatctcttctagacaacagaaagagtgtatgaaagaacagagagagatatgtgagctcagggcccttggaggaacggaagctgtgcatgtggctggaacatgggtccatggcaggtgggcgcatgtggcaggagactcgaatttgtcctgaaggccacatggaatactgaggggtaggaggtatgggaggacgtggtggagaattctgtagaatagaacatgcagccacaggcgtggatcatgaagccatttttttatttagagtttgcattcagtgacctgactctgagctttgtctggatttggcagtgacagaaaagtgtccatccctggaggctggggcccagccctgatgatttgttggcagatcctgttttccagccagggctaaggccagtctgaggttgggttgtgaggtcctggacatcactagccacttgggcctctagcaggaaatcctgatttctttttgtttcggggaagttttgacaaacgcatccagactccttttccgctggtgccacgggaa

SEQ ID NO: 78932 - DNA, 1017 bp, Homo sapiens
ttttttttttttttttttttgagacggagtcttgctgtgtcaccaaagctggagtgcaatggagtgctcactgcagcctctgcctcgcaggatcaagtgattctcctgcctcagcctcctgagtagctgggactacaggtgcctgccaccatgcctggctaatttttgtatttttagaagtgacggggtttcaccatattgattcttgagggctttccttaacatttccttaacattgtctaggaagacttaaagatgtttgtatataaatgttaaaatgataatcagtatggtaaccatattggccaaactggtctcaaactcctgacctcaggtgtgatccacccgcctcggcctcccaaagtgctgggattacaggtgtgagccaccatgcctggccattggcagaaaatctttagggacaacagactaggttagtttagttactaacctgtagctttcctggctgacgtgaagtgttgaattcccatcaagcaaggataaaagtgttctgatatatttataataataatattctgatcaagtaatagcttcctaaaagtcctacaaacttttcttgatttcttttcttgtattttagtagccaatgaaagaatgtttggattcctgcggttttctaaattgctttcttgaagtgtgtgggtaaatctgagttggttcactcttcagaacatcctttgtccttggtgatagcagccaggtgtttgactctgcgatgagaagaaagagcacctttatccacacgcatagcattttccttcccactcgacctcttatcatgctggccgctgaaatactgtttcctagaatactattgagtccatgctgaacctaaacataatctaggatatatttctagagttagcatgaacacaagtgtgttcccagctacttagtacaaacctccggattctgactccaatcataacatcctttgaaaaattataatgtagcaactggtattcttatcaatctatttagcatttggcattttca

SEQ ID NO: 78933 - DNA, 1037 bp, Homo sapiens
tggaaatagtcacagattgtgggcttacattagaatcagtcaaaactttttagaaacaaagaagtagtttaggaccaaatagattgttagttgcaggaatggggagctgcagaaggctgtgcaggttttttcccttgagccccttcaaggcttataagacgaagatcatcctcctggcatggttgggacatgagtctgccctcatcagctcagacaccttgcagggcccataaacaagtaattgtagtacacatgctgagcaccacgctggcagcaggcacagggtgcccagggaccacaaaagaggtgtccccacatgcaggtcagggaggctcccctaagggagctgagcctgagcagagcttccaggatgcccaggagccagcacggtacacttcccttggggtagcgtctgttgcatcaacagaaatgcagaggaggattgcgtgcttttcttgggggttatgtttctacgtttttaaatgattatgtaaaaaaattggtaatcccaggcagctttctggcctcttactttgtgataagatgctaagctttctcttcttcttccctctcccagatacctactggagcaggatttcccaggcatgaggattggtccggagcccaccacagactccttcatcgccgtgatgtatggagagactgagggcagcaccccagggaatgctttagtcgtggaccccaaaaagccgtttagaaagctcagtcgctttggaaacgctttcctgaatcggtaaggaccagcaagctgccatcttcggtcaggctgtttaaaccttttctttgaattactgccagttacatataaaggttcaaaaacagaagaacaaagaatctctgctctagaagtcatacaaaatatgtttatcatattaagatatttgaaagactatcataggaaataatcatttatgcctattctgggtaacttgagagggcagagctaaggcccagaactggacattataaggctgcacagggccaggtgtgtggctcgtgcttgtaatccagcactt

SEQ ID NO: 78934 - DNA, 1033 bp, Homo sapiens
aactttttaacccacctggaagtaaaatctgtctcaattatattgttgtgggtttttttttttttgtcttttgtcattttctaacactattattaaatctacctttttctgctgtcacatgaggcttcctcatacgctaagttattaaatactatattgagtctgttaggacctttgtctcgtgttattctgtttgtaaattcttatgccaacaccataccatcttaaatattgtcactttgaaatactttttaataattttagctcaagactcttctgcgtgcattactctttatttttcaaatgctatcaattctcattttctgtcattctttgagaagaactttcttagttaggttcttcaaaacaaacaaaaaaaaatcccactgggatccatttgtcctggaactgcattctgtctctaagttacatttttgtatttgctcttcccaagcagcagctcaccattgctttaacgcagaccttcttggaaaagtgattgatttactcatacaggtcctatggagctcttattaatgtattaggtattttatgccctgttgctcttatgaatgggctttttatttctcttattttttttggcagggtattgctgatatgtaaggaagctactgagttgtacatttttgttttatatctggtcatttgactcaagaagttattctgacagcttgtcagtagattctcttaggttttctagatagataactgtatcagttaccttcatgattactttgtctccccttctgttccatatttcataataccaggaagtaggcattcatatcaagcttctaatcttaatggtattgcctatgttatttcaccttaagagattatgtcagctggtggcttcttatctataaattaattgcattaagaaattatctattactagttttaaaaggatttcatttaaatgattctatttggagaaaaaaacaaaatggatatggagtttgttagatgccttttagccttttcctttaacctatgttctgtggaatgcagt

SEQ ID NO: 78935 - DNA, 1042 bp, Homo sapiens
ttcttcagatatatgatgactctaagttgagttcacatctcccatgggataattatcctttgagcatcctgagttgtgacagcctcagcagagatcccttacaacaaatttggcctcatcatagtggcatcagccccagtctggaggtgcttgaggcttgacagctccaccttactgcctccatgttttagggatacttatttatttttgttacgtgacgtatcttttcaagaagggctttatacttattatttttaaaataccttttctatcatacatgtgagtttggtaagggaggagaattttgatgtgggttcagtctgccatcttgaaatcagaatttgagcttcctttggattgtggagctgctgggttggttctgggacatacctgtgtttctagtaattacaaggtcaacaatcacatcccgttgggaacctccagaaccaccttatgtccactagatgtatttaagaggcagcctcaacccacatcccccaggatccttggaacaagaggcctcagagattagtccatgtcacctgagaacactgacctcagagttcagccagatgacaaggtagctgctttgggaccatccatgagaacttactaggggctgatgagtcaaaggatagagttcatataccccaccaattatcagaacccctacaagctttgccacatcactccctggagtgttagatgttcgattccctaatctggattttctagcaccaaaggggctgtcttcagtgcccaggggcccagtgctgaccacattctatatcctggcaggggtcttgcttgctctttcccatccatccttcccctcaggtgaaactaaatccttccatacttcacaggtctctaccaagcttgtaaaagaggcaaaattctctagcaggaaagtgagaacagaaggccaagaaggcttcagggagttggaaaggagggaatagacacttgccttccttaattcgtttccctacaaatgtctgtcacatctgagcagggacttctgggctgtctcccatccccc

SEQ ID NO: 78936 - DNA, 1077 bp, Homo sapiens
ttattttctttcttcaccctctagctttgggagcactgaccctggtctctttgggagttgtggccagggaccccatgaaggtccctggccacagctcctggggtaccaagccatgaaactgaagtggagttgggagcgacggtcgcatcctcctagaggggcatctatgagccatgacctctataagctgaagagatagagctttcccaaattatggcgggctagtcctacagtcatgtgggtccagtgtcctcttcttgccacccactgtgcccttgaaggcctggtcattctgagtggctgggggctacagactgctgaccccaaagaccagagccctgcgggtccctgtatttctatgacctgaagacctgtgatttctttgatatgaagagatctaggcccatgcaccctatctgtctacccactcaaaccactcccagagcaatcccagctactgccaagctgtggccaggaaggtggagctctgagtcagagtataagttcctgatcttgccacccagctggagagctgccgtgatgctcctgaggcagatgcacgccagggtctcccactccctgccagacccatgccaagcagaagacagcaggccctcggccacctgtgccttgaaggtgagggaggggtgctcagtggctggggccagaggctgagggccagggaggcatggccaggaagtgaggggcaggggcagggagctgagagcaggagacgggcctcagggagggctggtaggcattggacatcccaaggacctgggctcaggcagcctcatcttaaaacctgggggaggtggtttatcccagttggggccagggctcctgcttgggtggccctgctgagagtaccctcaagattttcaaggcatcatgaagtggcgtggggccatcctggggccaggctagcacccaagatagagagtatgccagggggatccacatttggcctgccctaatggcaagcaggatttaaccctgcaaacatcctaagcttctatgctgtgcaagagtatggtgtagtgtatggtgagaattggtggcattgtcaatctgttg

SEQ ID NO: 78937 - DNA, 1617 bp, Homo sapiens
tataaagtatggccttttagggtcatgattatttggaccctaatctagtatggaatgaagggtgacctctgaacacagggcagactgggtccaaatgcagggccagaaccaagttggtggtatctgtgggacctcttcatgtgcctggccctccagagagcagaggggccttacctgggtgttttccagatttgttctttcacaaagcctccttctttctgcccaatttctaccacccctgtgttccactctctacccccagtatctcttcccacacaactcactgcacagacaccagaccacctgcatacataagcgtgccctgctttctggcctccctgcctgtgttcatgctgtttcttcctcctaggatgcctctctcttcctcctagtggtgcctaggctcactagctgttgaaatcccattcctcgtctaaagcccaattcagatgccacctcctctgtaaggccttttcagatccattctttccctctccagctggaatccattttccatcttctgtgttccctagccagttcttagttgtgtggcagagctctgtaaaccaggggcccccaaccccctggccacagaccagtaccagtccgtggcctgtttggaaccaggccacacagcaggtggtgaacagtgggcgagtgagtgaagcttcatctgtatttagagccactccccatcacttgtattaccacctgaaacccacctcctgtcagatcagcagtggcattagattctcataggagcacaaaccctattgttaactgtatactcgagggatctaggttgcacattccttatgaaaatctaatgcctgatgatctgtcactctctcccataacccccagatggaaccatctagttgcaggaaaacaagctcagggttcccactgattctacattatggtgaattgtataattatttcattatatatgacaatatgataataatagaaataaagtgcacaataaatgtaaggcacttgtatcatcccaaaaccatctcccgcccacccgcggaaaaattaacctcggtgaaaccagtccctggcactaaaaaaggatggggactactgctgtaaaccatggatcttcacaaatgtgaaggaaggattgttatcgatccttctaagatgccccctctcaccacagggaaacttggatccctgagcctctgaggggttggatgcatctggctctccagccagactgtcagcaacttcaagcttaggatttcctctctcagtaggatgtatacagcagatgcttactaggtacatgaactaaattgaatttgtggagtttactgagggatgtggtgctgagtccccatccttggcagaggaggggagggcagggcaaggaaggaagccaggagagcagcaggctaaggcccctccactttctggaaggccaggcacgtgaagagttcccacaggtacctccaaccaggttccatccctgcattcaggcccagtctgtcccatgttcagatctcatcctcaatttcaaaaaagcacttctatctatggtccagaaaagccggttgtggggccccaggcaatagctcaggcaggaaactcccagtgtacagagtcagg

SEQ ID NO: 78938 - DNA, 1098 bp, Homo sapiens
ctcagaaagcacaagctctgcagctgcttgttcatgccttttcatcccccggcactgccgtggagtgccggtgctgcctgggtggctggctgctggcctgggaacctaacagctccctactatctcttgcatctcatgagaggcagaggcctccgcccactccaggggccccaccccaccccatcctcccggtttcacactcttggcccccagctcatgcccttccctctcagcagggcttgccctactctgtgccacccacgtggagtgaggcaagctcattcctacttctttccccagttctgctacctcccatcgtagagggtctcccttccccagctgccacctttccaaaccttgcccctaactcaaggctcagccccctgagactccccaccggcctccacgtgggatcttgacagcctccccttcaagaccagccctgtgtaccttcacctgctgggtcactggagcccactggatgccctcatatctaatctatcctgccgggtcactgaagcccactggatgccctcatatctaatctatcaccatgccgtgtaggttctgctcagaaatacctctcgagtccaccactgcttccatctctgccccctacccgggcccaagtgaccatttgcttcccatctgagccactacaacacatcttcctgtccctgtcctgcccaattctgtccccacccagcagccagatgatctcattcacatcacttcctttcttttttttttattatactttaagttttagggtacatgtgcacaacatgcaggtttgttacatatgtatacacgtgccacgttggtgtgctgcactcattaactcatcatttagcattaggtatatctcctaatgctatccctcccccctccccccatcccacaacaggccccagtgtgtgatgttccccaccctgtgtccaagtgttctcattgttcagttctcacctgtgagtgagaacatgcggtgtttggttttttgtccttgcttaatacccttcggtggcatccagtttcttaagataaaatcccaaatcttgaccatggcttccaaggcctctctgacctcatcactccttc

SEQ ID NO: 78939 - DNA, 1088 bp, Homo sapiens
aggctgctgccctcatggatgaattcatgtcgttttcatgggagtcactgagagtgggattgttataaaagtgagttctgcaccctgttgctctctcttgtgctctcttgcccttctgccctccaccatggaatgacacagcaagaaggcccttgccagatgtggaccccttgaccttagacttcccagcctctggagctataagaaataatctctgttcttggtcaggtgctgtgggtcacacccattatcccagcattttgagaggccaagacaggatcatcacttgaggtcaggagttcagcctggtcaacatagtgacaccccacctctacctgccaaaaacatattttaaagaaatagatttctgttctttataaattacccagtctcagatattctgttatagtagcataaaatggactgagacactcaccagtcttcaaatagctcctcatctgccctccattttggtccttgaaggattccctccaggaccacccctatggatcaggccttcctcttttctggggccagttggaggctcccattactgagtagcatattgtcatccagtaaccctaaagcaaatatcagcttatcagattacctttgaatcaccgcatctcctgccctgtggaggagttaccatctcctgccctgtgttcttagataacttctcatgtggcttgtcacactccctcaagaagacctgggaccacatccaaagcattttttcattcattgaacaaatatttactgagctcccactatgcacctagtattgttctaggagtgggagagagagcactgagcaggtcagacaagatccagctctcacgaaacttacatttcaatgtgggagacagtaaataaatatctgactatttctgatattggtgctattaggacaaaatgtgacagcgagtgacaggcagcagggaggggacatcagaagagggtgacatttgaactaagatccgaatgatgagaagattgatggcaagtattccagaaagagcacattctaagtgcaaaggccctgaggtggacacaaggttgaccttttgtagaaacagggagaaaac

SEQ ID NO: 78940 - DNA, 1036 bp, Homo sapiens
caaaggccccttccagtgctgacagcctgagcctgcaggatgagtcctgcccagggaaccctgagtgctcactctgaggcaggccctgggctaagcattttaatgtgccttataatcctcctaacaaccctgtaaagcaggcacaatcagtatcctctaattcatgagactgaggcccaaagaaaacacttgctcacgggcacacagccagtaagtagtagagccagggtcaaacccaggtcggtgacactccgcttctctcaaccacggattatatggtttcttcttatgaatagcacgtctccatctcagtccataggccttggcatgaataaaatatcactttccttattttcttgaattccctccccacacttggtcatgtcgagtctccgggcctcatctagtgcaaggaggggctgtagggcagggactcctctggacctctcatccctcagtgtctgctgtcctcgcatactttgggtctctgttgcttccatgttgtgttaggggctgggactcctgggaggctgtctgcggccccctctgcccggatgtcatgtgcagccatttctccctggggtctggcctcctccccagaaagctgctgggaagctgggcagggagctccggagcccacaagcccaccccctcactcctcccagcctgggcctcatcttccagtctgggctagccctccgccgcttctccaggacgtgcatctctctgtacccacgcatcccattcttcctcctcccgcctctacaaaccttcctctcccaacgttctacacttggaaacaaaggccagaacaacttgcagcctactggttttctcttgggccacaaacctccaacacaatgagtaaagaggctgaagtggggcaagcgggaaaccactgcctgaaaactgctcattcttatgataaacatagaatcatctcaaatcatcagccccacaggctctgggcagggcccctctccctccccgctccctgccttcccctccaggcatttgtgtgcttcccacccttccc

SEQ ID NO: 78941 - DNA, 1782 bp, Homo sapiens
gagctccttgagggctgtgtgttccctcagtcacagctgaattatcaatgtctagaacagcacctgacacatattttggaataaatgaggttctccatggagataccactgcccctcctatgtccatgacaagccacaatgccagtctccccttctagcccctggagccaagcagggctggcaggcaggaacagctctggaggcttttggagccttgaaaaaattggtgctccctccccctccatgtaggattcacaagagctgcaggtggaatttgttctggagaagaggtgagttctggtagagccaacgccctcagagactcagagatttgagtcagggcagctcctaggtgccagtcaccatgtcctgcactggccttggaggcctggcctggaggcaatggcctggtcttgacacccatctgcatgttgggcggcaggctcgccccactccaaaccctgctgtgttcctcatgctctgcccgctgcttcagtcacattatgattgtagaggccatcatgatggggccagatgtattctccatgtattcctcatcctttgcagccaggtgcctgcatctgaagtcatcaccaacggggttctggtggtgagtggggaaggcaagcttggcgctgttctgggctggggggcagtgaggaacccgtgacagggcccatcaggcccagttgcctctgaaggacacccaagccctcctcggaggggagatgtgctagggaggcacctccagagggaaaggacaagaagctgccaggcacttggtggacagcccaggacctcagcctcctactcccacacagcacgttactcacttgggcctctggctgctgagaccaccggagcagccactgtcatggcccctcaactcctccccctttcccaccagcacccacttcctctgagtctggggagaggggctaggtatgaccttgggctgctgtaaaagattcttacccgtgaggcccaggtcctgggagggctgtttcctagaccctgccccaggaactcctccctccctccatcctggatggggccatggctgtttcccagaccctgccctaggcactcctccctctctccatcctggctggggccgtgggctgtctggctcctacaggcctctgctttcctcaggctcacccctgtctgagaatccagggcacgctccggggagatgggacagccccacgggaagagtacggtgagtctgctcagcggccttgggtcttttgccttctctcccggggttggaactactgatgtcaaggaggtgggtctggggcaggaagttcttaaagttttcattgctcaaagccgactaacgatgggatggattgttcactggaggcagtgaacaacctgtccctggaagtgttcgagcaaagaggttgtatccgcccaactattgctctacaacaaacactcacatgatctcagtggcatacaagcagcatttatttggctcacacaactggcagtcagctgggctgggcttggcgggggtggcccagccctgtgccatgcgtctctcctctgcctcctgtgacaagcccattagcctgggcatgttctcaaggcatcagcagaggaacaagagagcaagcccaactgagtaagcgcttgttaagcctggtcacagcctggccactacctaacatgttattggccaaaacagggttgaactcaaagctggagggcagggtatatagttggcctctttagcgggaggagctgaagtcacatggcagaatgagaatacag

SEQ ID NO: 78942 - DNA, 1671 bp, Homo sapiens
tggccttaggaatcctggctgccaccaccacaaggctccccatttggacattactggctatcttgtgccctggaacaactctgaattaattagactcatggtctggcattgccagctttttaatgggaaaagagattagttataccttataccattatgttgtgggcaattccagagaattcagtacctgcttggtcaggaggatgtgcaccatcttgcctttgcacaccagtcacctgaacaaggaaacttgtcacaagtgtttgtaaccatggggttgttcatcaagggcttttctattaagtacatgacttcacaaggaccgctcagcatggctcactggagagttccatgagagaacagcactcaagcttctggccgcatggacccgatggctcgcattctgtgtagtgttttacgtctccatggtaactgtgccctgcacccctcggtagccgccctgttagttttcagtctccttttctttctcaccatttatcacttccctcactgccctacccaggctttctctcccacttccctgactctgggaataactaatatttaagcaaggtaagatgagaagcaaggggtctcagttctaggaatacagtgctagttgattgtcaggtatgttgtaaatagaccctctttggccatacactccatgcctagatgcctcggagagcatcattctctgcctaggcaaggccctgcatcccttgcctcaggccgggctgagtgtgactgcagctcctgaggatgggcctgccctgtctggggtatgcgtgatccctagatacatgttcccacagaggtgcctgctccgtcttcgctcaccagacactcaggcaggctggcttagtctttgtgcgtggcgattttgtgctctgggccctttctctttttccagccagtttccattcacttgccttacagcctgccctggccgtcactccccagctttgttcagcaatggtgtggttggagagttgtgctgggatagcgcaggaaggtgggtcccggcaacacgcaggggatgagtggacctggaactgacaatggcgtgctgccaagtgttcctgagaggtgtttaggcacagcagaggggacgcggggggcaagaacagcaggacgctggtttaaaaataactcaccgccaaacctgtggagcagtgtggggcatcctgccagaggtgcacaggctggagtttcaggcactgcaggctgatgacacacagggagagtggccctgcctcctgtcctccccggggtttttgcagactcgaagtctcactgcaccagtgtctttgatggtggtgagggtgggtgatggtgcccagcaccaacagttttagtggcctgtccttgacctgccgtggtcctttgtaaactatggctccatgctgtgtgacagatcaacgtgctgatggtaagtagactaggcttccccaggcatgccgtccgtgggggcctgaagagacagtgagtgccattggccccattcgcagatgtgggagactctgctcaggcctgtgaggctgggcagcccttcaccagagttcggaggagcagtgtgtggcgccacgtcccgactggccatacccacacagaagcagtgctgcccggggcctcatctgggccagcttggactctgcttcctccaggagc

SEQ ID NO: 78943 - DNA, 1028 bp, Homo sapiens
aaaatgaattctggggcaacctgcccacctgccttcccagtgccacaggcaagatgggcctcaactgctgacaagtcctgcttttccttctaggcacagaaaacctgcatttgattttctcctactcagtgtgggtgctgagagacttcccagaagatggcctgaaggtgagccacaggagtcccttggatttatctggtaaacacttggttctgattgcacttgagacagcagtggatggagaggagggtggattcatgcatctgtcttcattggtgcatgaagaaagggtggactgggaagcgcgagccagcactgtagttggtagagagagccttacacaggcatgaggaggcctgtgcctcgtctgacatgctgactgcctacagatgccttctcgtacccttgccctcctaaagtctgtttgatccctgcgctcacatgcgtgtgtgtttgctggaactgcagtcagatggttctgctgctggaactcgggttcattctaacagatatttactgaagatctcccggaagtggagtctctgccacgtgatcgagtcctcggcttcttaatagagaattttaagggtctggctattccttatctggtaaggtattttttggtctgcactaaaaagctttaaacccaggatccaggactgcgtggttctgttatcgggctgttcagatttgggatttatgtcacttggggattggaaggatgagggttatttcagcttcctctgaagaaaaagatcccagtagaccaagctggaaatgctacctaccaaatctaggtaaactacagagggataaaagaataatgttttagaaaaaaaaattccaaagccacatttggaaaaaaaattccaaagcgaaactcaaaagtgaccacaggacaatcaaataggcttaagtaccaggatgcagatatttaaccacaattacatgagtcgctatgagagtttggaggattatgggacaaaattagtaaaatggagtttagtaattgagaagatggctcctca

SEQ ID NO: 78944 - DNA, 1101 bp, Homo sapiens
gcagccctcctgcctcagcctcccaaagtgctgagattacagccaccatgcctggccccattgttatcttgttaatatatttgttccatctttgtgtcatttgaatatcctgattttatcagcatcagagttgcagactcctggaggagtcactgctgtgccactgactcaatagcaagtaggcctacagatggtgagagagcgcacaaggaataagggaactgagcaaaagctggacttaaggctctcagttctctgactgccttggatgctgacatcaccttcagggtgggaaaccttgctttaggaccaggctattcagaaattacttatttacatacagtaaaatttattctttttggtgtacagttctgtgttttgacaaatgcttagatttatgtgactaatgccacaatcgagattcacaacactaccatcaccccccaaaattccctcatattgaagtcagcctctccttctgttcctagacctctggtaaccactcatctgttcttcatctcctatagctttgccttttccagaatgtcatataaattgaatgacacaatatgtaggcttttgagtctggcttctttcacttagcagaatgcactggagatttatccatgttgttgtgtgtgttaatagtttattctttctcatggctgaatagtagtctatggcaaggtgtttgtttatccattcatcagttgatggacaaagttgattttggccaggcgcggtggctcacacctttaatcccagcactttgggaggccgtggcgggtggatcacgaggtcaggagattgagaccatcctggctaacacggtgaaaccccatctctactaaaaatacaaaaaaaaaaattagcctggcgtggtggcacacgcctgtagttccagctactcaggaggctgaggcaggaggattgtttgaacccaggaggcggaggttgcagtgagctgagattgtgccactgcactccagcctgggcgacagagcaagactgtctccaaaaaaaaaaaaaaaaaaagttgttttcaatttttagcaattttgaataagcatctaagacatttgcatacaagcgtttgtgtaa

SEQ ID NO: 78945 - DNA, 1782 bp, Homo sapiens
ctttgtcattagggacttttcattgttcagaaaagatatcgctctttatttttgccaatttatcattcttttattcttcagaatctgcctcacccctctctctactcaacttaccattttttagcatttatgttctacattgacactgcatcattttatgcttaggaatactcttttccttgctctttaaaggcttaaaagtgggcttgatgtcactggcacatggtcacccttaacccagcatgcattgacagccaggagcaagaaacatttaagagcaaaaaggagggaggagttatataggggaaggactgccccaggattttctcctctgaattgtgaatgtccatgtgatttgctggtgctgtggtctttggctggcaacccttcgggaggaagtgttcctcagtcacttgtttcttagcgcatcttagagaatggtgttctgctcagctttcctggcaggatgactgtgttacagggaattttcagagtagtagcaatttcaaggtagacaatctctaatttagttatcactcagttagagagagtcattgtattttcatttgctctgcatgtctcctcccagcacacagagaccggtgaggaggtgttacggatgtgtgtggcagtaaaaaagaagctgcagctctatttctggaaggacagggaatttcatgaattgcaggtaagtccactgttccttggtccatggttgggtgggagctgctgcagtggctcggttctagtgaagttcaggactccagtcttgtcattctacgcaaatgaatactctggtatgaagtgcatgagagcttgttgatgcctacttgtaatatgattctacagtgtttttatagattggtttatttcaaagtgggttttcaccttttccaaatgtactttgtccagttcatggacttgtatttttattaagggtagtttcctggccttgtgcctgtagaattgtgcccgatgagggtgagggttgttttgcagaatggaggttgcagaataacaggaaagtcatgattttttaaaaaaatatttatttcattcagatccttgctctcttttttcagggggactttagtgtgccagatgtgcccaagtccatggcgtggtgtgaaaattctatctgtgtgggtttcaagagagactactacctaataagggtaaaatcttattattttgcaaatatcattagtttatcttggggaagatgattatctgctccaaactccaggtcaagcgaccactttaagtagagcttttggcataacaggatttgttatttgtatgtgtagttatcattcatgctcagcatttttcacaaataggatatctttgtaacttaagtcagtccaagagtcaacgctcagttctttacgtaatgatgatccacagtgtgtattttactattgggacagataatgaaggctgtttgcctctgtccagtggatcatcatggactgctatcctaaggcttcagtgcttaggaattttaaactaattttagtataaacttaagtatttttaagactttgagtttcctctcctgccgtcaaatctttttgtatgtttgtactaaaagtgattctcactatttttttaaatttcaaaagccacgtgtttttacacgtgtttattacagaaaatatagataaggagataaaggaagtgcaaatcaaccatagtccccccactcagaaatagtcactgccaacttcttggtatatgaacttccatcctattggtaaaaatactatgctatacaattgt

SEQ ID NO: 78946 - DNA, 1773 bp, Homo sapiens
atttaattaacataaagtactcgtggaagatgtttgcttggatagtctgtatagaagatatttggaatatagatcattttaacctaatatacttcaacctttttttttttccctaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaattaatgtatttttctcatttttttcaaactttttctaaagactctttctgtcaaactcatgaaaaatttctttctatggcttttattctagattgtcttattttctgttaaaaccaatgaccacatgaccacaatcttcactaactcatactgcagtgaaagtgttaacccttaggtagtttctctacaactctttgctatggtgatttttaaaaaagtttcctaggaagtatctctgaggaacagcaatctgaagaactgactatattctcatgctaagtcattagccaaaagctggtggtattgttgcatgctgctattgcatattaaaacgtagcagatgaataatagttgtaatgcagcaggatagttggtcaaattatttttttaggctgctttgatgttgacttgagactaggaaaaaaaaaagcccattgtg

SEQ ID NO: 78947 - DNA, 1481 bp, Homo sapiens
agggaaatgcaaatgaaaaccacagtgagataacacctcacacctgtttgaatggcatttatcaaaatgaagaaataacaagtgttggcaaggacatggaaaaaagggaacccttgtactctgttgataggaatgtgagttagtatagccattatggaaaatagtatggagcttcctcaaaattaaaaatagaactaccttatgatccaggattcatgtcactgggtatatacctaaaggaaatgaaatcagtatgttaaagagatacttgcactgtcatgttcattgcagcattaatcacagtagccaagatacagaatcaacctgcatgtccatcagtagatgaatggataaggaaaatgtgtattttgatatacaatggaatactatttagattcagaagagaaggaaatcttgtcattcgcaacagcgtgaagaagcctggaagatactatgttaagcaaaataagccaggcacagaaagacaaataccacatgatctcacttacgtcgaatctaaaaaagttgaattcctagaagcagagggttgagtgctggttaccaggggctatgggagaactggggagatgttggtcaaagggatttttaaaaatgtttttaaaaattaaaatatttgacttttctgtcagcagtcccatttgtgaatgtatgactacagaattatgaaagacaagttttaagaccttcatgtccttacttgagatgtattatgtggtgcattttagtaatgagtggtatttgtatgttcccagcaggaagatgatttgaagtgggtagaagagaatgttccttcttctgtgacagatgtgtaagtttttgaatgattaccacaagaatcctatttcaaagttagtactactttgttattattttaaatgagcaagttatactcatgaaaatacaagatactgaaaaataattaaaagaataggaataatccgcaaacaaaattaattgggtttattcattcagatgacatttctgcttagaaagatttagctatgtagtatatcttaaaatgaatgggatactccttttgaaatttttagttcctttccagggctataattttaatgaaacattggtcctgttgcattgcaaaatacgttttttttctatacaatttctgtaactgttgcttattgtatttgctgtttatttttcctaaaagggccattaataaaatgcaaatcttagataattataaagcttttaattgcattattccattgtcttttatgaaccatttatggctttattttacattgttcaatttagtatttctctctctttgcagagcacttccagcccttctggattcagatgaggttggtactcaattcacgtgcataaattatgtatatggtgactaaatagaaagtcatgaatcgtctgttcatggagattctctttatttgactcagtagtggcctgaaaactatagtttatatagttgaaaa

SEQ ID NO: 78948 - DNA, 1174 bp, Homo sapiens
ggcagatcacatgaatccaggagtttgagccaacatggtttcggccaacatggcaaaaccccacctctactaaaaatacaaaaattaaccgagcatggcagtgcacacctctaatcccagctactcgggaggctgaggcacaagaatcgcttgaacccggagacagaggttgcagtgaggcgagatggcgccactgcactccatcctgggtgacagagtgagactgtctcaaagaaaacagaagatataattgtatcacttacactgagtctctcctgtctagtgtctagaaggaaagaaaatttctgtaaccagcagcccagctcactttgtaatgatagaaagggtaaaattaaaacttacataaccaactttgaaattaaaaatgtatgtgtaaatctgatttgtccaactataggcaaatttcagtcatttaggaactgcctagctttattttgtgattatgccttccccccccccccatttgcatttagacggttaagagcttatattaaacacccataccaccaaagaaggaaaagggtagcatgatataaatgactaattttataaccagacccaatgaaagattgaaatagaaaataggtgaaatccttttactccatgaaaatggccttgctgtcatttcaaactatgcactttatatgtgtttatcaaaaaaagtcagaatagagaaaagtaatgaaagaaaataaaggagatctgaaatcacactattgagaaagaacttttacattctggagacccttcttttatatccgtctgttgatctactggttactcactagctatatttgtatttaaatattttcccttcctcagtcattaaaaaatttttgcgttaccttccctcttctttttttcccccttttcttttaaaacattgccccctttctctgtgacttcagtgttaactgcatattataatgtgtcttttccctgttcatgtatggaatcttacattactcttgtgacagtacattgtggagattccttccagtgtaacaggtttaactgaactcattcattttcatggatagcataaatatgggacatgtgtagtacagttaaattaacatattctcttattaatgggcatttgggatatttccagtttgaggtgtgtcagggtcctcaagaccatcctgatgtt

SEQ ID NO: 78949 - DNA, 2053 bp, Homo sapiens
cagcactttgggaggccaaggcaggaggatcagttgaggtcaggagtttaagaccagcctgagcaacatagcgagaccttatctctacaaaaaaatttaaaaattagccaggcatggtggcacatgcctgtagtcccagctgcttgggaggctgaggtgggaggatcgcttgagcttcagtggtcaaggctgcagtgagccgtgattgtgccactgcactctagcctgggctagaccttgcctcacaaaaaaaaaaggaaaagaaaataaaatgatgactttcttattcatcttgaggtgtttgtgagattaagtgagaataagagagctataaggcctctgagagatctataagtttattggcatgaccccagatccttaaagaaacctgaaaactaattggctagcttactgttttttcctgaatgttgaattccttgacctgcaaacacatatttattagcctgactcaaacaatgaagctattaaaacttcggaggaacattgtaaaactctctttgtatcggcatttcaccaacacgcttattttggcagtggcaggtaagtctgggactttcttcttggagttcaaatgtgatctgtttagaatggacattcttaacctgaaaggccatgggtggacatagaaagttttgtatatttcacttggaaaagggttcttagctcttgtcaaattctcagaaggatctgtggtttttaaaaagttgagaaccatttattttatgtacagtagctggaaatcaacctcatatttcagctcttcatttatccctcttctatttgcattctttcttgaggcattctttttcttgaggttagttagcttaagtgccagagagtactccttttagaagacattaccacatgtttgtttagttttattaaatagttgtagaattttagggtgcattgctattatagtggttttacatatgtcagcaagcatatgtaaaaaattgacattaggtggactgtaaccaaactaggctaatttgcctacctcctgacccttgtaccaggaatagtgaggtctgatttatgattggaactagctcttctgtttgtgttacagtcgttttatcagccattttttttcatctgaccagccaaagaaaaattagcattactatactaaggataaaaggagaaaaaaattatattgataatgctggaaagagctatatttccaataccttattttccaaccacactggttactgatgtagccagatggcaaataacattattaccaaattattctttaaatagagaaaggattggccagagtatgtatcatgagccttgctgatagcaggtatacagtccttttgtattgaatacatttgttaaaataactgatagagttgtgatgtatttgggggttcggggtgtgtgggattccacttaaccggaaatgggggaatgtaattggggatgtaaaccagcattcatactctgacctggtttttcatttactgttagcatccattgtgtttatcatctggacaaccatgaagttcagaatagtgacatgtcagtcggtgagttataagcacatttatgaataatgtactgtcttataaacaactgatggtgttgatgacagtggtaaggttcttctaagttatataccttataaaaaattagagctaggtctctactctgagggttgtgatacttccctcctcctaagtattctgtactatcatggtgcttggtatagtagttttttgtttgttttttctgactgtattctcccagttttgggagagaattttgtaagttataactacagtgtgctataacccagtcttattttaactaaaaatcttaagaagtccagagtactaaatattaagtaccatatgtgtaaataatactaatctgaatagaagccacatccttaagatctgagctcaacgactgtgacagtaggatttcttcagaagcagctaaggctcttattttgttcaataaataatgaaaatgaaaattataaagtataccaacctaatgtaactttctcttacac

SEQ ID NO: 78950 - DNA, 1048 bp, Homo sapiens
gtcctggctacttgggaggctgaggtggaaggactgattgagttcaggctgcggtgagccatgatcatgccattacactccagcaacagagtgatacctcttccttaaaaaagaggagaaaagaaatttatgttaccactggattaatacgaagaagtataaggttctctaggccatttcaattaattttcttattttttaaaaaaagactccacagcaacctattagattcaatattgtaaaaactataaacttggctttgcccacaagaaaacggctcaatatgttttgcaataaattgcctcttaaatcaaacactttgtggatgcacatttgcttttcaaatcacactgtcctctgtatgtaattctcttagacttctagcaactttaaccctctgtcaatttcattttctttcttctgctgttgctatagtatttttcttatcccttgactctgatagtaaacctggccctctcagcaattgacgcctgtgttattttatggatatcctttcagtaatgcctgttgattgggtaattagggttatataaaaaacatactctatataaactcctggaaacatgcagcatagtttttcagacagataattgccttacattttattttggggtgagctcttatttgtaaaatattataattttagaaattaataattctttgtatatgatgcagtaattttttttaaatacgagaaaagtcttttcagacttgtagccaaaattgcaataataggaaatgatagattaaggatggggcttataaacattagaacttttttggaatatggtcacttgttaacatggatctttatatatgaaaaactcgtacttagcagtatgtttcgagattgtaaatgacaatttatgtgaaatgcttatagctgtatattctatgtgatggtttataagaagggaagaatgattaggtgtcaaatgttctttttattttctttcagttcaatgcaaaaactttccagtgattatgtaaatgcagaatcatgtggtggtttcttctctgtgcctct

SEQ ID NO: 78951 - DNA, 1011 bp, Homo sapiens
agaccctgtttctttaggggaaaaaaagaaaggcccttttgtagccattgaaataccaaagaaaaataaggtcctcatttattaaaaacacatactgaaatatatcaaagatatactgtctaggatttgcatcaagagaatatgaaagggtggaaaggggatggggtatgcatgggacaaaactgaccataggttagtggttgttgggccttggtgaagggtttataagggtgcattatactacttgtgaatatgtttcaaaactctctgaggaaacattttttaaaatgtggtaaccagacacaagatctcaagttgtagtgttccctatcttgttttaagaccataaggtcttagtttttttctcttaggtgaatcaagtgtatattatttattgctttaaattgttggcctatattaattaacacaagttcctgttacttagcttgtttcggcatttgtcccatatgtactcaaatatctccttgcttcctctttaggccacgccttggagtcactcttcataaggttgtagtagcaggagccctctatcttttgttctctggcatggaaggggtcctcagagttactggggttagtactgcttaatctcattttctgtggtcagttcaattatattgtttacatcttgacagtgtggattggaaatgtctgtgggcttctttctgtttgctttaagtcacttttgggctctgattttcaaaatatatgtatagttcatgttctcttttaaatctattagagctttgtaaatttagtgtgtgcccgaatgaatgcttttccacctgtctccaaattgctaattgttttagttcctcctcccaagcagtagacttgcatttttttttctttttctaatcaatggaatccagactgaaatccagactgaaattcttgtgtaaatggcagactttggagtcatacacttactagttaatctaatctaaagtaactgttgtttcttaacatttcagtttcaaaaacttcctt

SEQ ID NO: 78952 - DNA, 1062 bp, Homo sapiens
tgtgagataaactgataagattttccctggtctttgaaaggtcttgaaaatagtagatctgaaaaaagttaagctgtacatgccaacaagcgtgtacacgagtgtgttttgtgcttttctatgtgtagctgtatttcacagtttttaaaaatgggggaaattgtctcgatgctacaaactgtccatatagggtgaggtattctgttaaagttttagtgaatttggggccaggtcggggagggagctgagttgagcgcacccagattgccatacatagacatgagtaagattgtgagtggcatcagcttgtatcctgtaaaaactgtggaagaggtattctattttagcaggactaatatcaatgcttattctgaagagtgtagaaagcagcagtctagtattggcatctggcctgttgccaaacctagattatggtgccatttcttcccttctttttcatagtccagggtgctttgatccttgcagagctgctttcagcagtgaaacgctcactggctcgaaccctggtcatcatagtcagtctgggatatggcatcgtcaagtaagtattaacttcctgtatggaagagcaaattaaaatgctgattaaattaaaacagtattgcatgttcccaatgtagtagttctgaaatagttgataaaagaaataattctgaaacaagaaaggtatttgaaattttgtagcattgtaaatgttgggaaaatgtgtttcattttccatacttccaaatatattccatacttccaaatatattccatacttccaagtccaaatgtattccatacttccaaatccaaatgtattccatacttccgaatatatttccatacttccaaaatattttttgcaaattagattttttatgggaaacgcattcttgctgtaactgtctgaaaatatttttctatccaaaaaattttatttttattgaggagtgtcttctataggcattctttgaggcattgttctaggccctggggatatggcaagtaaacagaagattttgagcttacatttgtggagggaggggacaaagacaa

SEQ ID NO: 78953 - DNA, 1514 bp, Homo sapiens
actcaagtcagatttttatttattaattatgcctagaatttatccaaattattttatcaatacaataataaaatagtccatcttgaaatagtttttaaaattacagataatcttaaaattagtcaatgtttgctttactaaggcaaatatgtctttcagatatatgttattactgttactttatctgtctcattaaacactttgttattaacaaattctttgaaaaatgttaactagcaggttttggggaagttcaattctatgtttattggatggagctttgccttgaagcatctgaacttttgagttatttttattttggagtgagcatctagggtacctgattgtgaagctagatttcaatcttgtatgagggatggtatatttttttgtgtgagttaatttaaatttttaagtttttttccaatgccttcattccgaaaatgatacatgaatgtagcaataaaagaaaattggagtccatgaaaaaatagtaaagcaataggaaaatacaggtgaggaaagatagaaaacaaagaagatggcaatatgtaaaaaggaagtcctgtaaggcatattttactgatgtgttgtaaggaaaagtatatatgaagtatgtttagaatttagagtatgtgtagagttgttccagatgggcagccagagaaggctgtgtggaggaaatattcaatctagtcttttttaagatgtgagtatggaaacaaaagagccttcccacttcagactatggtggaggcatggaaacctgtgcaggacacagcatgaactatgaggacacttaatgactttccaagtgctgtacaaatataatgtaatattgaccaggattgaagtgcctaaaagtaaatgacccaatgaaattcttactaagttcattaaacaaatattaggcaatatttttgtttaatttctgcatcctgtaaattaattctgaggactctgttttggcagtgactgttgaagtgaagggtccctatgaatacctcacacttgaagactatcccttgatgattgtaagtgactttatattatttaacctcagtattggatggttttgggttcaaagattgtcccatgttttgtggcagtattctttttaatgaattgttcctgtgcaattcagaaaatgttgcttgtagtcctggatttatttcttattagactgggactttgagagagtcagtatacccttgtgtgcctcattttcttatccatataatgaaggggtcagtgacctgtggaaatacctcaaagatcatctcacattctctctaggatgcatagtggggcactttttactacaactctattgtttctgatcccacttacattaactaaatgaggctgggtgccctggctcatgcctgtaatcccaacattttgggaagctgaggcgggcagatcacttgaggtcaggagtttgagaccagcctggccaacatggtgaaaccccatctctactaaaaatacaaaaattagctgggcgtggtggt

SEQ ID NO: 78954 - DNA, 1881 bp, Homo sapiens
gaggcggacgtcacagtgagccaagattgcactgctgtactcctgcctgggcgatggagcgagactctgcctcaaaaaaaaaaaaaaaaaaaaaagtaataaatgtcatatgcttaacagagttatctggcatataaatgttatttttacagggtcagaatctctgcattccagagttaagtataaactttctcaaatcctggaatatgagaattgatcaatttattttagaatttgtaagaggtggttttaagacatatatgattaatagagcaggttattacaccagcattttataggttgatgagtaagtaagttcaggaaaggttctgtaattatggctaagcagacatgtattacccataactttgaagctgcaaagttttctcacaaattggttgtgagtctcgtcagagactattaggtggagataaatcaatgtatgattaggaagacatttatattcttaaattttactaagataacctagtaaatggatatctggagaattgtttagtctgctttgtttgacatggatttttatcatggaatataatttttgaactaagccttttcttggttgtaggatattttaaccatttgaggagaactatggctccacaggaaaatgcataaacataaaaaatcagctattcattttggggggttcacagaacctagaagcttacccagagatctctggataaacgtttctccttttaagaacagatggtagtaaattgcaattccaaggaagaagaaaccagttattttctgtgttcctctttatcattgtgtcttagtcttctgtttgtgaagactctagtctatgtgaaaagcaagagtcactacccctcaaagtcaaggacttggagactgttaatttgtcttccttgactttgaggggtagtgactcttgcttaccacatagactagctcaaggttaaatttttgatataaatgtgagaccatgtcagcagaaattctgatattcttgggaagcatgttgaacaaagggattagatttaggaattggtgattagaattcattttactgataccatcattaagttttgtttaaggtgatttaaataatcatttaaattcctttgtaatgtctgcataaaacacaaactagtatcctagtatggcttagttaaacagagattaaattagtgattttagttgggggtttcctcattaaaaaaatatgttaaatgtgatttttgtgtacaagacatggtatcttgcctttcagtaattcataatctagcctactttatgcactaggcttgtttggtttgttgtgcctaatgtttcaatgaatgaaagagaaggactttaccatatttctgggcacattctggagcaaaatttgcatattgtattattaatttgtgctcttaattcttaagatttatagatgtgatgcccttttccctttctaggcaatgcatgaaccattgcaaacttggcaagatgcaccatacatttttattgtacatattggcatttcatcctcaaaggaatcatcaaaagaaaattcactgagtaatctttttaccagtaagttcagttttttttttaatggttatgttattatctggttatgtcattcatgtactttacatatgcttttttattaggtattacaggtatcagatttctatttccttcatttgacactcctgctgttaaaatttttagttagtaacatgttttcagtattctgaactagaattgtcaaaacttggtcaccaagccagagataaggaaattttaaattaattaacattggccgggcgcggtggctcatgcctgtaatcctagcactttgggaggccgtggcaggcagatcacatgaggtcgggagttttaaga

SEQ ID NO: 78955 - DNA, 1059 bp, Homo sapiens
taccaagaattgtggagtagtgaggtccaggtctccatgcctccacaaaagcaactagtaagctgatgaaagctatcacattcagctttcacagaactttgaaatctaaccaaaacttaataaggaaaaagttcaacaaagaaagaagctgctacattacattaagaaagtgcagtgatattgtaatttgtttaccataccctccttcccagttcagaggcaggaagatggcaactcgcagtcgtggtgcaggttgctggtgccaggggaactaatacagacctttttcttaaagacttgccattgtgtgttttcacctgcctggaggctccctgaaggaaccttgccaggacttaactttgttttccccaacttagagtgttcccagggctggagtggcttcctgggttgtgtttgccaaaagcatttgaatgcagaagtattatgtgcatagggaaggggataacagtggggataagcaatagagagactgtcaagcatgagaaggaaagggtccagaaaggagatttgtgggagaacaaggctttttaaggcttctgtgtatattgagctatgaagaaagccatatatattctcaagactggacatacgatcagaaaagaccttagatgaccctaagctttcattctggctctgtacaagcaaaaagtgaagaataaggaatggctttaattggcccagctaagcattgaaggattgcgccagggtgcaaagactgggaggatattctgttcttttttgtctttggctcctggtgtttaagaaatctttgtcaaaacactagctgaccactaagctaaaggaatatagattccagtagccacacaggtctaagaatgcagactttacaaaaatggtttagaaaacttactaagcaaaagagacataacccatattattattaccagctaacaaaccccaaggagggggcagattgtggtttccagagttgccactttataacattcagttttcagtggaaaattatgaggcatgcacagaaacaacgtatggcatatttacaggattaaaaaaaat

SEQ ID NO: 78956 - DNA, 1050 bp, Homo sapiens
gttgaatttttcagaccttttccattctgtttctatctctcaatttgcatttttaagaagattatcctagttctgtgcttgcaacaattttctgctctatcttagcttatgagcatgaatatttttttgttgatgttgttaatttggtcaagtaaatcttttaagtatattttaatgtgacaaaaccctctacactctggcagtttcccagtctactcagaattgttagtagaactatgccttgtgagccaaagactagagtctaatagtccttgagtctgatagtgtttgattcttagatatttttatatagagcctttatctgatgctgttcatttttaaaatagcaaactcaaaattgtatctgtactgcaggtgaactgtttgttgtgctgtgctcttagtatcttattttttggaaggtgagttaactactctgtattatctctttttccaggcagaagaagtagagttgtatttggaaaaacttaaggaaaaaagaggcttgtctgggaaatatcaaacatcatcaaaattgttccagaactgcagtgaactctttaaaacacaggtaatctttgaaagtgattggagataaatagaataggcaaaaattggaatgtatatatttttggctgtatccacttccgacttctcaagtatttcttttggcagaagtaagtggaagcatgttctgataggtacatagtcagccacttatacatactcatcaaagagaggttgtactttgctttgtgtgtaaaaagcaaacccccatttttttattgtggtaaaatatacactacataaaatttaccattttaaccatttctaagtgtataatacagtggcattaaatatattcacattgctgtgcagccatcgacccatctccagtactttttttttccccaaggcagattcttgctctgtccgccaggctggagtgcagtggcacaatctcggctcactgcagtctccatcacccggatctaagcaattctttcacctcagcctcccaagtggctagggctacagattcacaccatt

SEQ ID NO: 78957 - DNA, 1510 bp, Homo sapiens
tatttttgtcatgtttattattacatttatataaagtagggagtctttagtatatttttcctttcatagctagaatcaaagataaaagcgaatactgacttcctccagctaatcagtcatatagtcagatttaccctcccaagtcttcagaataatgtcttgatccattagaatactgtgttccaaactgtgtttaatgagctttatgaagcttccatgataacatgagcttccttgaggcctcttttaaggtaggctttgaaaaaaaaaatctgatactcttatctttgcttttgctatttctaccttccacagccatgtttgcttttcgttcattgctctttctgttctatcttgatatctttcaaggtctgagatagcaattttgctctcagtggaactattatgtatatcatcatttaacaccatttaacagttgttaatattgccttgtgacatgcattcctaattttattattgcttgtctcttcaactagccttttgaagggtcttaataatttgtttccactcgtttccctctttagcctaacagtgtgccattatacctttgtaatacttgtgctatttatttatttatttatttatttatgttttttgagacagggtctcgctctgtcgcccaggctggagtgcagtggtaccatcatggctcactgcagacttgacctcctgggctcaagtgatcctcctgcctcccttgcctgagtagctgggactacaagcatgtaccaccacgcctagctttttaatcattttttgtagagatgagttctcactatgttgcctagggtggtcttgagctcctgggctcaagcgatccccctgccttggcctcccaaacttctggggttataggtgtgagctaccgcacctagcctgctcaataaatacttaaataatagaagactggcttgaatttagagtgctttatcactcccaggtttttctcaatagagatccagaagttaggactttatggcataaaaatagatccacagtttccagaggttaaaaactgcttacctgctatttttctatgaacaacaatacttttatcttaatatccagctctttttgcatgtattatttcaataccttatgtttggagaaaggatggtctttgagtatctcagtttagggtacgaaatgaataggatataggttaacagcttaggaaaaatgctttgttggggaattatcttttgttaacaaagatttcttcttttgtagttgatggagaaccttgtgacctgtctttgaatataacctggtatctgaaaagcgctgattgttacaatgaaatctataacttcaaggtaaggaacataaaattacagagtttttttggaccttagtgattatctggttccagtctcttaatttcatagaggaaagagtatcatgtagctatggaggaggagagctgaaactagaatgcatgcttcccaatttgcagaccaccaattctcaaactttttggtttcagaac

SEQ ID NO: 78958 - DNA, 1094 bp, Homo sapiens
aatatatatgctgtatatactacattgaatattcagtcacatctcagtcgaattacatttacagttgatactttctgagaaaagcatccttaggtgattttgtcattatgcaaacatcatagagtatacttaaaactggatggcactacacgcctagtttgtatggtacagcctattgctcctaggctataaacctgtataacatgttactgtactgaatgctataggtggttgtaacacaatggtaagtttttgtatatctaaacataggaaagtagagtacaaatacgatattacaattttatgggacccccgttgtatatgtagtctttcatttactgaaatgttatgtagtgaatgactgtgattatgttggggttgattccctgcatggtggttttaatctgttctgtgtagattaaagaggttttactcttgtgtgcttgttaaatgtttactgcaaacatgacctaggtttgtcaggccgttggctgtgaaggaatatatttagtagatcctttatttacaaaaggagtattttactgctttggaagaggaagctcagatattatcaagaaatagggattatgtagaacaaaactagtttgtctagtggaaaaatgactgtatctgaatctaaagtatcccattgtgtgttcagtaaaagcttccttttagttctgaaaccggctttaatttagagaacgattgatcgtgggcagctttatttctagatgagggataaaaatcctgatgatagatgtgtgattctatgcatactgtcttcacggaagtgcaaaattttaagtcatagttggataattttattcttttcaattgtttagtgagtaattattacttattgcatagactgtggggaagtaatagaaaaatgttcttccctcatcgagcttacattctagtgggagtgaaaacagcaggtagaatttctctgaagaatatatactgtatccatgaatatgtaatcagtctcctgaccagtgacttatatttgatttagatcaaatctactctgacactggccttgtgagattggtttactgggtaacctagtaacccttgtcttttggaat

SEQ ID NO: 78959 - DNA, 1048 bp, Homo sapiens
acccagtctaggaatcgcgtgtactccaccaccgccgaattccagcctttgcttaaataccacccaaaccggagaactcactactagacgccacttgggcagccaggcttagggcttttccagactttctggccccaaagtctgacattgacttagaagggatgaagggctggggcgagcggaagtagagagccaaatcctgcacggggtgcctgcctggtcctaaaacctttaacggctgggagacagaaaagactcaggccaggctggcatgtagcgatctctctaacccagctgaccaggttccaacaggatgacgcctgcgcagtaggtccaaagtctcacggcgcacagacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggtgagtattcacttcactaacgtctgaacctagaggagcaaggggtggggctacggcggcccaaggggtccatgaaggttccgcaaaagtctcttcaaaaggggtggggttgctgggatggtctgtgtggctagccaactgggacccacctccctggagtggaaagccgcgcacttctgtgattaggctagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaagatatgtaaataggagtcttcatttctttct

SEQ ID NO: 78960 - DNA, 1040 bp, Homo sapiens
ttgttccctggaactctgtgaccccaaattggtcttcatcctctctctaaggctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatgtaagtctggggtgtggggcacagggtggggagctccaagtgtcaggaagccttttacccaatgaagggcagcatagagcttttgtgtgggacagagcgaatgttttgtttgaggaagcaggaactggctctcaactttgaggactgggaatttctcaagggagaacagttcttccggattttcaataaagacactggtcaaggacatttcaagccctggaatgtcagtggaaatcagtccagaggcctgtgtcagtggaggcctcccttgctggtgctcctcagtctcagcacgctcccattaagctggccacgtacttggctgtggacctgagcccaccatttccctaagaaagcctcccagtcactgggctttcaccacacctccccgcttgagacgtgggctttgtgttgttacctgggagaagctaagcctgcagcacctttcagtgcaaagaaatgctgtgaactgagacaggagccaagggtagggagatggccgcccatggccaggcctccttcagggggcatgccttccctgagggctgctcagtatattgatatgataatcttagtggtttccattggggaggatggggctgaagctgaattcctgccccttcttctcccaacacgcccaatggacagcttggaaggtcagttagcacacaacaccatggatgaactttttttctgtatcacttttctccgtctttcctccattcgtgctctgttgatctctcctctctccctttgtctgtcccatctctttctcctctctccttccctttccacccttctgtgtttgttctctccctcc

SEQ ID NO: 78961 - DNA, 6021 bp, Homo sapiens
agggggcagaggttgcagtgagccgagatcgtgccactgcactccagcctgggcaacaggagtgaaactccatctcaaaaaaaaaaaaaaaaaagccctttcgatattataggaaaggtatttgccttttgtattgaataaactaagatagaaactcaattttatgatggcaacatcaaaaaatacagtttaaacagaatttcatggtaatttacccataaacatttgctggccttttcctgatttaagaagttgtaattgctacgttagtgctgtgccctctcaaaatatcaaaagatttttccagtattttcaaggttcctcattatactgatattttggttgccttggctttgttgtcttttctagccaagaataaatttgaaataaggggctggctttttgcttccatagtgcttatgggatccagctgggggctgttctgattcacgttcactgcaccctttttcaccgagtctcctcattttctttctctccagtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggtacattagtgggacttgaggtttgcctgggattcagtagactgctcagagcaggggctagcaaaccttttttattattgagaattgccatatatagggagggcctagggttttttatttttatgattcagagatttggggggtagcttaatgaagttgcaaatgaagaattaggtcatttttgagaaagggcctaaagagaatgttttcagatgtttcaaatccagtaactgaacctggagatttattacagtgctcttgtgctgagacaacagctcacctttaagtacatggtttcacgtaagttagcaaagtgctggctcctaactgcctttcctgtctggatcctaggtggaatggacccacatggctttccttggctttgactttctcctgtcttactatcgacttctctctcatgggcccttttcccttcattcctaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattgacggtttactttcgttaccttgtctgcatattcacggccagccctttccacgttggcttagcgaggaagaaggaaactgggtggaaaacacaggatgcctatagatatgccgcaggccatggtccagagaagtttagcaaacaaacagctgcgttcagggttttgtccacggtcatgcgacaggtcagttagtgagcagaggagctaggatagctcaatctccactccattattcaggtaaccggcccctcccgttgtacatgacccatttattcttgatgtcttttacagcaacaactattcctctgccttccttttatgtcttggaaagtatctgagccattcttatgctcaagaaatagcaataggcatgattacaaaattcaagatttt

SEQ ID NO: 78962 - DNA, 2507 bp, Homo sapiens
taaaaaaatgaacaacagaaacagctgagagactgttctcaggtcatagaggcagctttttgaagctcagttcctggttcataacctcagaataattcccacctgatagacttgtggtctagatccagtgaaatgaaaaaagtgaaagtacttggaaagctataaatacagatagagttttggccgctttctttccatgactaatattagagtctttccatcaggatacaatccatatattttgtatatgtaataaatgattgtgggatacttctgctattaaagttaatacagttgtattaactgtatttgtacagttaatacaattaattgtattaattatatgtgtacagtatcctcagaattatgcctcttagaattatagaattataaccaggaaggagtctcgaaagtcagtctggtgactcttacttctcttctgacatagactggtgagctcgtgcggatctataaaggtcacaatcatgcagtgactgtggtgaatatcctaggaaaagtgatggtgactgcttgcctggataaatttgttcgtgtctatgaattacaggtagaatttagattcagtattttgcttgaatgatttggggagattgtctatttgggtttagtgttgatttttgatacagtaaggtgggatggaacccaggaatctgtattttcacaagcattctagataattatgaaacagctggcctgtggactgcagctttcagaaaccactctaagatacttgatctgggtcatgggtgtcaaaacttaatttctggagagcaactccagtctcttaaaacctgtctagttctccttgtgtgcagtttcaagtttgaaactctgattctaacaaaattgattttattacttctaattaccagctccctccttgagtagtagaatgtaaaagaaaaattgccattagattatatttctgttagaatgctactggtgcttccacttggcgcctcaggtgtggttttaaacctgccaaaggcctttagggactgtacttattaaacgcaaggtataaataacttcaattctctttttttttttctgcctaagtctcatgatcgattacaagtttatggaggacacaaagacatgattatgtgtatgaccatccataaaagcatggtgagtgttatttgtcatgtaagatatttgcttttgaatgtgtttgctaaaaaattcttgtcacttccaaaagtgacatctgcttctgatatgcctcattgttaagtaccttcccatctcttggcataatagggaagtaaccaggggacagtgttgaatattccattgtctattaatagccaaaattattacaataaaaatggtagtatcaactacagtttaatagaaggtaaatttaagatgcttcaaaaaattgagtggtgccttttccagagacatgatctgaatggaacactggaatggagtcaggagatttggccagtgtggcatggttacagcagacctaaaagtagaaaccaactcacgtaaccctgctaagccttgttttttttatttttaagttatggagttgaaccagaatggatgtttttcagactctgagtagtagaatcctttcttttccagggaaatacaggtgcctaacatagagcacccgatagaaaccagggctaccccagttaaagtataaaggacaagtgggtgcctctgagccctgccactcctctctgccctggtcccaagtggctttctaaggagcacagctgcaaaatacctagactagaagatctggaaaatactttcccattctcctgctctggagctggttttgatttaggtgtttgttttcttgtagctgctgcaaggagcttgtgactcttgttttgagggtgttttgtagtttgtatgtattttggtctgatattataaacctctctttctccagatttacactggctgttatgatggcagtattcaggccgtgaggcttaatctgatgcagaattaccgctgttgggtaaggagtgaaactcttcctgtcactggacttctataggttgcttcaccctaggctaattgatagatcttcattatcatcagtgtagcatttttatattttagcatctactttatgccttacactgtagatcacaggttgtctcctcggtggtggttttgttttattataaaatcaatacatgcttagaaaacaacagtacagaaatatatgaaataaaaagcggaagtgcttattttggtaatggcactgccccctctactcccgctcatcagagattactagtgttaatggtttggtttgtgtcctcattggtttttgaggaataggcaaataaaaaaaatttaaggtcttgtaagttctaaaccttagttcatcaggctgaattgtgtggtttttattttggggttaggactgatgattaacccttaaaattttcacactatttcttataagccttaatttttttttcgtcagttctaacaatggtagcttttcc

SEQ ID NO: 78963 - DNA, 2813 bp, Homo sapiens
ggcaaaatgatgagatgatgacaagaaattcaaatggaaaagttctttaaaggattgaaaagccctggagaagatggtcctagagacagacatttgagaatctctgcatagatgtgaattttgaagatgagggctgggctttttcctaggttgcccatactcttagaatgtagtgcttctggagtcacaacagagagccaggactgtttaccagggccggtccacctttgggtcctgacctcctttcagtctgtctccctagcacttcaacactgttgaaatcattgctcagcaatgtaggctcccagctgtcgctttctgcttagttttaggagccttactccaggcatgcacctaaaaaacttctgtggaagtgggaggcttaatgaacagggttggctgggggatgaaggaaagaagtctaaaatctgagataaaagaatgttttgggattcaggatgtgaccctaccactctgatataattaggcttctatagtctactaaatgatgttgtgagagatgacatggaaccaggtgccagaagaacatcataataaggtggagaatttaggccaggtgtggtggctcacgcctgtaatgggaggctgaggcaggcagatcacctgaggttaggagttcaagaccatcctggccaacatggtgaaaccctgtctttacaaaaatacaaaaattagccaggtgtgatggcgggcgcctgtaatcccagctactcaggaggctgcggcaggagactcacttgaacccaggaagcggaggttggagtgagctgagatggcgccattgcactccagcctgggcgacagagcgagactccgtctcaaaaaaaaaaagtggagaatttgagacttactgaaattacctaggaaggtaattctaaatagagatttttggaaacagcatgacacatagattgcctaaattttggatgacagaaatagttcctgggtcggtgtcagggaatatgcactagagtttgaaaaaaaaaggttcacccttcattattattaacttacaggtggtgaaagaaagcataaaaagagaaccagtttctaattaggatggagatggtgtgggttgaagttataaatgagtttataatgtaagcgtttgccctcctcagatcaggggatgggggaggttcagtaaaaagggttggagtgggaaatagcggagatggataagttaaggctgcagagtgggtatgaaaatttgagtacaggtgacagaaatgagtttgtaccaaggtaatgatgttggttagttgaattttccagctaagttggttttagctgtaatcttggcttattttccagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggcaagtacagtgcaagagaatcggagttgtctggcacaaatagaagggttttgaggccaggcgaggtggctcacgtctgtagtcccagcactttgggagggtgaggcagggggatcgcttgagctcagaagttcgagaccagccagggcaacatggcaaaactcgatctctacaaaaaaatacaaaaattagcgggatgttgtggtgtgcacctgtactacttatgaggctgaggtgggagaatcacttgagcaccaaagatcgaggctgcagtgagccatgattgtgccactgtactctagcatgggcaacagagtgagaccttgactcaagcaaagcaaaacaaaacaaagaagggttttaaatggcatttcccgtgttgtctcatgcatcatttagaagcaccaccttggaaagagcaaggagattgcaaaccttttctttacaccaacatcaccaagtgatgcactttcatttgagaaacaatgagtgtattttgttatactgtgggtatactcgaatgcccttctaggctgcttcataatcattctggaaaggtaacaaacgtaataatacattgtcagttcattagcatgcttggtaggggggtgtaagtttcagctgagaaaattcatctgagaaacttttatacctagttcatcgtgctcatctcaaaataggatggaaattagaatttgccaatgtgtattacaagttatagagaaaattaagaaccgtatacagaatctgacttgtttaattttttctttaaggtggtgaatgatctcgtgttcagtggctccagtgatcagtcagtccatgctcacaacattcacgtaagctgtgttggtgttgtgtaaagaaactgtgaataaaataatggttaaagcttgatggttttcttaaacctcttgcaatttaaattaagccctttatccaccgaagggattcgtaatcatccctgtgcatatgctcttggataatattgtgtaatttagaaattctacctcatcaaagtttttaatggtggacagacaggctttatgtaaggtttagtttgaatgcctcatttaaacttgaaataaactgagcagctgaggcttccagaaagtggatatgatatgtagttaaaatagaactagtaaaaacagctgagagctgggcccaatggctgtcacctgtaatgccagctactcagaaggctgaggtgggaagatcacttgaggccaggagtttgagaccagcctaggcaaaatagtggccccatctcttaaaaaaaatttttt

SEQ ID NO: 78964 - DNA, 2812 bp, Homo sapiens
gtatttttagtagagatggggtttcaccatgttggctaggctggtctccaactcctgacctcaggtgatccgtccattttggcctcccaaagtgctgggattacaggtgtgagtcaccacgcctggcccaaaagctcattatataattatctatctttttcctaagtgaaaggccttctctgcctttgcttatcatgcagtcttcatagtgaagatgggtattgaaaattgtagtagtctgataggggaactaagatttaagggatctacttttggtttaatctagggactactgtattgtataatagttctgatttttgagtatcttttcagactctagcagacatgtctctgaaacctattcttgttttccagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtggtaagttgatagaacatgtagaatgtttttggttgcaggttttggaaaatccagtttatacttttttaaacaataaagggaatttgttggctgtctgaaggaaggggtgggcctgagattgactttagatgcatttaatccagaagctcagcaaggtcactggggacttaatttctttttgtctccctactctgccttctctggtatcacctcttcctgaaagctagttcccctcctgcttacagggtaaatgtcaggagccactggagtctctttttccctcccaccagcacagaagggtcctgtgttttactccctgaacgatcacctttgcctgtggcaaagggggttgggattacaccagtggtcttggactgttcaggtcccaatgctggagttggtaatggggtcacttgcatagcagctacataatagaggagggatgaagtgaatatggggaagtactggaggaggtattttccctgacaagtgattgattacagagttcaagttattaaggagagcaacacttttccactgcctcacacttagtattatctgatgcttattactctcaaaagaatgaacttttgagttttgaatttgaatttgttaataaactaattatgtttatgaacaatgaaagcttaagaaatttgaagaacatgatgtctgaatgaataccatgaaaatatttaaaattgctagagtcagtgaaaattaaaaagttagatgatggaccaggaaaatgtgtttgctatataggcaacaggtgtgtagattcctttagcttaatgatatgaggattaacacgaatgactgaaaaaaggaagcagtgctaccaggatgtataagtgtaagatctaggggaacaggatatcaaaatatgtatgtgtatgtatatatgtacattctaaatagatctcagtatgtgcactgagataacatttggaatgtacccataagaaacaccaccagtggccgggcacagtggctcacacctataatcccagcagtttgggaggccaaggtgggtggatcatgaggtcaggagattgagaccatcctggctaacatggtgaaaccccatctctactaaaaatacaaaaaattagccgggggtggtggcgggcacctgtagtcccagctacttgggaggctgaggcaggagaatggtgtgaacccaggaggcagagcttgcagtgagctgagatcgcgccactgcactccagcctgggggacagagcgagactctgtcaaaaaaaaaaaaaaagaaacaacaccagaaccactagacctgtgatagcacctgacgtttttgaataccatggtgcattctcacaaactgcttatcaaatgctcatcttttgtgggaaattagctgcagtttggatttgctaggtccttggtccatatgtcagaaagctttgccctaaacgttaattaaaattctggctgtcttacagtgttgccataagtattttctggtatggctcaactaacatatactttcagatacctcattgcctgtgactgtttgctaggcacttggtgaacatacatttactgagcatcttttgtgtaccaggtgctgttttagacatgaggatacagcagtgaactgaatgttttagcatctttttgttgaggaaatatattatctaatcctcctatatctcataagtaataatctggtctgtgcttaaactttagagtcggaaatgtattggtgtctttgagggtcatacctccaaagttaactgcctcctggttactcagacctccgggaagaatgctgccctttacaccgggtccagtgaccataccatccgctgctataatgttaaggtaggtgggtccagagaaatccaaagtggttcatattgagtcgcctttgtatttactgtgtggagtggagacactgtggcagacgcttcattctacccaccatctcctttttgcttctaaacaatgtttagcacattgttgtagccctaggtagatatgagacttacacataaaccatattttctgtctctctccaccagtattttttcacttcctactattaataatataccttccttggtctttgccataaatgttatgcatatcatatgtcaaaactaatcctagatagaataaagagaaaaatgtaggccgggctcagtggctcacgcctctaatcccagcactttgggaggcagaggcgggtggattcacctgaggttgggagtttgagaccagcctgaccaacatggagaaaccctgtctctactaaaaatacaaaa

SEQ ID NO: 78965 - DNA, 1686 bp, Homo sapiens
agcaaatttttttaactactaagctgtagctaaattggatgggtgtggataatgaaaacttcaaagaaataaaagtaaaaggacttcagctaagtagacatttaagtgtctactaagaataaaccacaatgttaaatgtgtggacatttaaaacaagaaaaaagattgatagaaacaatccctccccacaaggagcttttgtagggaataagacacacagtgtttgtgagattcacgcaaggcagagggtagtaagtgttgtcataggagtgtatgtaggtgatgggaaactgaggggtgagataccagctgaaacagtcatggttttctgaacatatcattgaaatatttggtagagtttcagtcagtgataaattgcagcaaacacaaaaaaggatgcaataatttttttcctctcaattcaggagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaaggtaagaatattgtattggtccagtcagaacaactttcaccaactttatttttttaaatagaatttgaaattatgaatcagaatttctttaaaaaccaaactttatgtgaatgcagtagagattgtggatatggaaaaattaaagctcagcagtagagattttctgctttctcttttgactgtgttataaatattcactctgcttttatttcccttcattaagaaatttcagatggaaaatctaatctcttatatcattgctactttgcccattgtttagaaaaatcctttgagtcagaaatttttacttttactacctgccctgttcacacagatgctgagaacacttttgctattattttgtagtgtggcagaaactcagactgtgatctcctccataaaaggatcaaagaattcttcaggtatttgctgttcagttttatttaagttaaccacagaattaaaagccttgtaaatatta

SEQ ID NO: 78966 - DNA, 2758 bp, Homo sapiens
tttcttcaggaagtcttctctaataaaaacaatttttaagtcaactaacagactaaatatggattggaaagagagtgcaagcagtctaggtctagagtccaatctaagcaaaagtcctgtgtgaagacagtggtagataaaggaagaatgggaaacgagtcctagaacaggtggtttgcatgggacagatttcacctggaaaggtggtggtagaaggcggtgattagatgagacagaatgatgtgatggtacactggagcttatgagatacctccatcttagcagttctcacttttggttcctagctttgatatcattgtgcttgactaaatgttttatgaatttccaatgacctactgaggagaacataaagtcttatcctaaataatgggtatagtttagtcttctgagctgtgtgatgagagggaaatctctcgtattaacctgaaccttatgatttcttttggcagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcaggtaacagcatgtggaggatttaataaaaatggatcatctccgaaatcttgttttgtgctgccaaacccatgtctggagtcaccccaaaagcaatggcaggggagtttccacaagggaagtgccccagactgtgcctaatgggggacagttaggattccaaagaaagaagcactaaatgccagggtgatgagtccaaagcatttattaggagagcttacttacagagtaggctgcagcagtccccacaagggtgttctccctaggtatatccacagccagggggcgggatgtggagtttatatgagggtttaaggaatttggctcagggccagggccaatttctttcagtgttttgggcaacaacctagatacttttatcagtgcctgggaatcttcaaggccccaggtagggttcaagcctgctggagaaaacctgcggctggctgggtcacagagcagtcaagacactctgatttttggtcaggacatagaagaaaaatggggagacctagaggaccttacaagttggatttcaaaatgcttaataaaatactttatttttagataactatggagatgagtgcactgaggacccatagaatacagattctacagggattacaaggtattcagagggcatctgatggattgggccctctatagcgtgttacttttttgttttctctgcttttttttttttttttttttttttttggagacagagtcttgctctatttcccaggctggagtgcagtggtgcaatctctgctcactgcaacctctgcctcccaggttcaagtgatactcgtgcctcagcatttgattagctggaattacaggtgcccaccccacccccagctaatttttgtatttttagtagagacagggttacagggttcgccatgttggccagactggtctcgaactcctgacctcaggtgatccgcctgcctcagcctcccaaagttctgggattacaggcatgagccactgcaccaggcctttttgttctctttgaggggatgaaaagtagtcatgaaaaggtcatgttatttctctcctgtctccttggtttcatcctttttttttgtttttttgagacagggtcttgctctgtcactcaggctggagcgcagtggcacgatcatggctcactgcagccttgacctcctgggctcaagcaattttcccacctcactccccccagtagctgggactacagacgtgtgtcaccatgcctggttattaaaatttctaacttttaattttataaaattatgatttaaattgtaaaaatttaaaggttataaaaagttatataaaattataaaaagttataaaaattaaaaaatgcttttatagagatggaatctcccagtgtttcccaggatagtcccaaactcctgggctcaagcagtcctcctaacttgacctcccaaatggttgggattacaggcctgaaccaccacgcctggccagtttcttccttctatagaaaggtctgtaaactgtgcatcccaaaaatgtttagcaacagacaatatgttatggaaagagttttgattaggaatcaaaaggcctgggttcaaatcttctcccttccattagtagcctatataactttggataagtcatttaaaatttgaaaaattggaatgttgctaggcacagtgcctcatgcctgtaatcccagcactttgggagtctgaggcaggtggattccttgagcccagaagtttgagaccagcctgggcaatgtggtgaaaccctgtctctacaaataaatacaaaaattattgataattattattagtaataataataattccagcctgaccaacatggtgaaaccccatctctactaaaaatacaaaaattagctgggcatggtggcgtgctcctgtaatcccagctactcaggacgctgaggcaggagaatcgcttggacccgggaggtggaggttgcagtgagccgagattgcgccactgcactccagcctgggtgacagagtgagactctgtctcaaaaaaataataacaataatagctgggcatagtggcatgtgcctataatcccagctgcttgggaggctgaggcaggagaattgcttgagtccaggaggtcaaggctgc

SEQ ID NO: 78967 - DNA, 1256 bp, Homo sapiens
tagagatgaggtctcacaatgttgtccatactgctctggaactcctgaactcaagcagtcctcctgcctcagcctcccaagtagcggggactacaagcatgtgtcactgtgctgggcttctctcatttaatactgaggtgataagcatagtagttaaggtcatgaattttagacttgcttcaaattgcaattctgctcctttgagctagatgctatatgtagtggatgttactggatgacttaaaatacacttcaagctgagggattgtcctatgacaaagagcttgtctcatggactgttaagctttttgttgtaaaggttttcttgctgaaatttaaagtagaaactatgccaagttataaatcagatatatttattttactggctttgtctatacttctacttgtgccttactacaccaagatgaaatgctttccctgacctccatgggctttcctacctctaggatgctaggaggcacttcaccctggattctttttttttaaatcagatacgtttattcaactaaagtttgcgttggtaccacgtgcgtgagacttctacgatcatgttagagatggtagcaatagtgaagaacagtgtatggctatcttagaattgattcctttttctcctcttggataatggcttttacacattggattttattcagttttctttatccttccaggatggatcttctcctgaactcccaagtcttgagagaaaaaataaaagaaggaaaattaaaggaaaaaaaggtatggtgcagaatattttggaagaaagaagttggtgttttttggttttttttggggggtgcgggtttttggtaacctccaactcttgggctcaagcaatcctcttctctcagcctcccgagcagctaggactactggtatgtgacactacattaattcttttatttttttgtagagacagggtctagctatattgcccaggctggactcaaactcctggactccagtgatcctctcaccttggcctcccaaagtgttaggattatagatgtgagccaccgtgcccagccccaagaggttcttgtagcagttcagcgtttgtgcagcttgacacagagcatagcttgtcatttatcaaacactgattgtccatttactttttttggacatttttgttgccttgcttaagaggaaagaaaagtttgatttcctaatacatccagttaacaactgtagaagaaatatatgatgtcacatagacttgtaagccaagg

SEQ ID NO: 78968 - DNA, 5076 bp, Homo sapiens
ttcaagtgattctcattcctcagcctcccgagtagctggggttacaggcgtgctccactacgcctggctaatttttgtatttttagtagagatggggtttctccatgtcggccatgttggtcttgaattcctgacctaaagtgaactgcccgcctcggcctcccaaagtgctggaattatagatgtgagccaccacacctggccaaatgtgccaaatttttaatatttctgagtgatgggggagatggttgtaattacttgaaatttaagtaatttaaaatgttttatttttaaattaataagttgaggaatatacgtttaaatatatcatttaaagatatgaaaacaaccactattagatataaaaccagactcggttacatattctaagtaacgggaggaaagtacaagggaagtttggtgggttatgcctttcaaggtagcataggaattcctttaaatcgctaatgaaaaactgtttttcttccagacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtgtgtgctgcttttcggtgtcttttttttcctcactttcttttaaagtaaccctttgaccctgatcaagagaattctacgtgtttcatttaattaaatgtttgccaacaatatctgttgtagatgtcttgatttaatatcaaatagtgactgatactctatgacagatggaataaagtatttcctagcagagagtgcaggttaaaatggaagcacacctacttgagaaacaaggtggtgacgtaggaaaaaagtcatggctttacaggggtaaaatccgtcactttataggggtagaaaatgacagcataaaaatgtagagctatagatctctgtctttttctagatcttaattttggaatgcgtgctataacttttaaatacaactgttctcattaccttttacttagaacctacgaatagttaacttttctgtatgtactctgggcattatctttatgactacaacatgctttctcttaagcgcttgtgtaatattttggctcttcatcttatgttgaggtactagacttttctgaatgctaaaacagtgttcaacgtaagtttgctacttgaaagtcataactctgctgcatgatgatacagttctccaggcttcaggggcatttctgtacttgttgaaataatgggtttatttccccccactttcctttcccacaccttgtgagtagcatttgaaattgtaagtataaagcacttgtaagtgctcagtaaaagggtttttttttttgttttggtttgtttgcttttaaaaattatatgctgtatgtattattatagatttagcgctccatatgaaacaaaactcaatttttactccctcaaatatattattatagctgtatacaaacctctaatctggtacttgtgacaacgtaatatatttatatctgtaccactgactagactgtgagccccttgaaggcaagagccaccttactttttataacctcagtgcttgagagagcctggcacattaaaaaataatgcccctcccaacaaccatatccaatttatgttttcattttttctttcttccttaaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagtgagtataattccctctgctttttgtagaacatcgcatgtggcaagttggttgcttatgaaaaaaggttcaactgtttttcttgggtatctgggattgtgattctctcaacttctagaagaattgtgaggttcttactttcatcctactggtttcttacactgagtaattctgctaaattaaatgtaatctaatatgaatgtacagtaccaggaaaatatgaagtcatatctaaaaccagtgtccaagccaatgattctttgtatcacctgaccaaggataagtcacatattcagctgtaacccaatctgttttcatagatgcgttctgcactgctactgaagaaaggcgttctactgttgcacttgtagggcatggatgattgctggattcaggagtgataggcttaacactaagatggttttaatactattagagtgcatatatatgagcagagtatagaaatatttttagtctgtgtaactctgtccttcgtccttcagttacccaccctggcctttaagagtcttttatttcactgataccacttctgctcttccggcatttctgccgctaatattggcttaaccctctcagtatccctttctgaaaagaaagagttgctggtagtgatacagtctgggatctggcaatgtgaaaaaaaatgggttcttctcttcattatttatttatttattttata

SEQ ID NO: 78969 - DNA, 2454 bp, Homo sapiens
atatcagtaaagggtgagcatccctaatccaaagtctgaaaatgcaccaaaatccaaaacatttgagtgccaacatgaggccaccagtggaaaattccacacctcatttcattttacaaaattattcaaaatattacctaaaattatcatcagactgtgtataaaaggtgtatatgaaacataaatgaattttatgtttagacttgggtcccattcccgtaatatcccattatgtatatgcaaaaatattccaaaatccaaagcagtttgaaatgcaaaacctttctggtcccaagcatttcagatacgggacactcaaaccacatggttcttaaatcatttagtagcttagtccttcaaatgacattttcattacttttaatatagttgcagtttactttatcctgctttaggcagttggagcctctgggagacttctattttgttcttacatactagtgccattattagctttatctgtgtaaataattaaacattaagtcagaatagattagacatttgtatcatagttactattttttgagtcttttgatgtgcctccttgatgacctatttataaaatcatctacttcttttttttttttgagacagggtgtcggtctgtcacccaggcttgagtgcagtggcacgatgacacctcactgcagcctcaacttcctaggctccaacagtcctcccacctcaacctcccgagaagctggaactacaggcatgcatcgccaccatgcgtggctaatttttttttttttatttttatttttggtagagatggggtttagccatgtcacccaggctggcctcgaacttctgggctcaagtgatccacccaccttggcctcccaaagtgctgagattacaggcatgagccaccacacctggacaaaatcatctacttcttcaggagtatttttttttttcttttttccttcatgaatttttaacttagattattctttctggtctatgggtttagctgaatgctcctatcttctgaatctagccaattcatgatgatctaggaattctactttgtgatttatttatcccccagttctcccatttctgatcatatcagtatagctgagtcagtggtctccttggatgccagaagttgcatattgcatagaatcaaaagataaaggcaatttggttaatggttataaaaaaattctgctactgcatgtaataatacttgttactttctaaagagtctcctgtttagaaatgattgtaatttatataatatgagtggatgtttgaacttctaaatagacttttaaattccgtcttgtgaaaaaggaagaagttccaatttgtgtccaaaatatcatagacattgaaagcctttaaagccaattaaagtcagtattgagtttaagatttttaagtcaaggtcagaggaaggaacttaaatgtggaaactttgttttgagatgttgattctctgaaggcctgtggttaagagtatagactctggctggagtcagattgccaaggattaaatctctgctctactgctttctggctatcttattctaggcaagttatgtattctctctactgctcaatttctcatctataaagtaggaataataagaatacatgccatgcctgtaatcccagcactttgggaggctgaggtgggcggatcacgaggtcaggagttcaagaccagcctggccaacatggtggaaccccgtctctactaaaaatacaaaaattagccaggcgtggtggcgggagcctgtaatcccagctactcaggaggctgaggcaggagaatcgcttgaactcgagaggcagaggttgcagtgagccaagatcgtgccattgcactccagcctgggcgacaaagcgagactccatctccaaaaaaaaaaaaaaaatacttgcctcaggattataaaaactaagtgagataatctatataaggtgcttagcattaaatgcctgacactcaggtactcagtaaattttagctagcagtactcagtattttgagcacttaccacatgctaagcaccatgcccatgcacaccataggcagtttgtagaagaaaatggtttttacacctattgctgtgatgcttactgaagcttattcatgtttctgtggactcctcgtctgacatgaacatgaaacagctgtagtttctttttaaaaacctctggctcatgaagctccttatagcacatattatggttactacttgtttggtatatgctattttcctcctgtttgtgaccttactgtctcagctaggttctaaggccttcacaaactggaactgtacataaaagtcttcttataccactaacagttattgaatgggtactggacaaagtgtttattaataaaaataaccatgcaaagtatcatcttatttaaaataggttaagaaatggagtttttcagaaagaacctacaactgg

SEQ ID NO: 78970 - DNA, 1004 bp, Homo sapiens
actgcaatattcagtttagcattctatgagcttttaggtagaaaagtaggctaagatattttccatagttttagagagttttaagacaaaaatattttctttttttttttttttgaggccaagtctcactctgtcacccaggctggagtgcagtggagtgatcttggctcactgcaacctccacctcccaggttcaagcgattctcctgcctcagcctcctgagtagctgggattacaggcgtgtgccaccatgcctggctaatttttgtatttttttttagtagagatggggtttcaccgtattggccagcctggtctcgaactcctgacctcgtgatccacccacctcggcctcccaaagtgctgggattacaggcttgaaccactgcgcctggccaacaaaaagattttctaactggaaaattgagttgattggaatgtttatagtgtaaatgagatattgtagatttgttatagtcctcagactgttctgatgctgcccattgtgatagatttatataattaacttctttgtgtgttgctttgagaaacagcttgttattaacgttcagttggaatgagctaccatcaatttaattgcttgagagaaaagtatcggtatccctggtaaactggagaaagttgaggattattcttttttctttttttcttttctttttgagacggagtctcactctgttgcccaggctggagtgcagtggtgcgatctcagcttactacaacctctgcctcctgggttcaagcgattctcctgcctcagcctcttgagtagctgggattacaggtgcccgccaccatgcccgtctaatttttgtatttttagtagagacggggttttaccagtttggcccgggtggtctcaaactcctgacctcaggtgatccatccgcctcggcctcccaaagtgctggaattacaggtgtgagccaccacgcctggccgaagattattctttaagtgtataaatgtagtaagtgcagtt

SEQ ID NO: 78971 - DNA, 1137 bp, Homo sapiens
gtggatcacagtaaaataattaggaaaaaggcactaaaagcctccctgagctgccaatgggaatgtcaggtttcgcacccaaactcattttctttagaggatagcctttagtacttatttactcacatattggatatagtgttcctgacctgtaacaaatcatgttacatataagagagaagacaaacaggtagcaagaaaaaccagcttacaaaattatagaaaaccccataaaatctcaaaaattgtttacggacttggagcatttactgtaaggacggtcttcaccagcttgtaccatagggacaaataattatcagtcattatttctttaccctgttatcctgagtttgtgattatttcctctggatttcatttttaactactgggtttctgacactgagactttctttttctctttatagttgtgtctacagtttttggttgtgatctggttaagaattgcaaagtatgtgttacttaggctttgcagcaagcttgaataagcaataagtaactggtcttacttggttcatggctgtggacatgtgaaacatttccctattttttcctaatatacttcttcagatgtgtgggccgtaagtaacatctccagatagagactattaaaaaggcacaaacctttatttattcagcagctgttgtcgggtagttagagcaagcttaataaagaaaagcttatggagagagtatcttaagactttgtgtttcacacatgagaggaaattgtgtggtaacaggatgaagctaatttaggccctcctttaaatgccctaaggaaaattattgcctttgctagccaaggagcaaagctgtacatttcccccgtgattattttatttattcacacagtatagtaagtattttaactgattgttaataaataattatcaagtaacctcattaaaatattaacttgctattaggcttttaaaacatggtttcccaaacactatgttgaagcatgaatgcctgttgtgtagagaacagaggtaatagaggtaatatgcttactccacacacacttgaattttcagaagatgtggctacatagagaaagaacagggtagtataaccacatctcctgaaaacgcagatgtgtgtggaggtaaccat

SEQ ID NO: 78972 - DNA, 1370 bp, Homo sapiens
aaaaccatcagatctcctgagacttattcactaccatgagaacagtatgggggaaactgcccctatgattcagttatctccacctggccctacccttgagatgtgaggattattgcaattcaaggtgagatttgggtggggacacagccaaaccatatcacctgtctctatcccctgccccacaaaaaacccccaaaattagctgggcatagtggtatgtgcctgtagtcccagctactcatcagcctgaggtgggaggatgcttgagcctgggaggtggaggttgcagtgagccaagatcacaccaccacactccagcctggtgacagagccagaccctgtatcaaaaaaaaaaaaaaaaaaaaaaaagtagcatgtgtatattccatgtctttggtctatttgtgatttattttgatgtatttgacttctgtcaatttgaagtttggaaacaagatagatggaggaacattgggaacctaggaaataggaattatatcttatcccatgaataatagttacaagtttgtggttttttgtttttttttttttgagacggagtctcactctgttgcccaggttagagtgcagtggtgctatctcagctcactgcaacctccgcctcccgggttcaagcgattctcctgcttcaccctcctgagtagctgggattacaggcgtgcgtcaccacatccggctaattttagtaattttagtagagacgggttttcaccatgttggtcagactgatcttgaactcctgaccttgtgatctgcccgcctcggcctcccaaagtgctgggattacaggcgtgagccaccatgcctagccagtagttacaagttttgatcaggatgtcaacctaggtcatttgaaatttatttttttgtgacctacagtttaaaattctgtgggcaaattaatgtgttattaaactttcagcatctctttagcctattagtggaatttttccctgcccccagtctcttattatgtgaaggttaggtcttagcagcaatataaaggagactgtcactcactcaattttagtatggggagcccttattatttttaatatatacttttttgagacagggtctcactcactctgtcaccaggctggggtgccgtggcacgatcacagctgactgcaacctcgaactcctgggctcaaacaatcctcccacctcagcttactgtgtagctgggactacaggcgtgtgccaccacacccttttggcttttatttttggcttttattttttgtaaagacagggttcctctctgtctttcatttggcctttattttttgtaaagacagagttccactctgtctttcatttggcctttattatttgtaaagacaggg

SEQ ID NO: 78973 - DNA, 1075 bp, Homo sapiens
attgatgtatccatctatattcattcaacaaatgcttattgatgactatatgctaggccctgtccaagacatgggtaaagtaagagttgtagcttactcttgagaaactgtggataaaagaagccaaatagttgaaaagttgagtgatttgaaaggttttttttttaaatgaactttagtaaattctttataatgggatagaatttaacttacttagtttactcttaagtgttttgcttcctaaagataatactttctaatctttttggaaagccacttaaatatgtctttttaagaattctttttatttaaacatgaaatatattaaaaaacacagttaattattaaggaactgatttcagtattaaattgagaataaccaaaaacacattttgacataaggagtttgagccccaatttttgattgaggaggaacagaggagtttttttttttcaaagcaatcctgcttagttttaatctactttcttttattttgaaggagatggacgaacacatgcggagcatgttgcatcacagggaacttgagaacctcaagggcaggtatgggaacggctctcttccataagtttgtgaatgtgggtggatctgagtgatgatggtgcctgtcagtttgttttgcagtaatccgtcaaaagcaaatgttgtcttatggcgtagaacaaccttttagaattaataccaagtgtagtagatttttggcattcaaaagggataaactctgatacctttgggcatctcaaatgtgtgaattcacagcagccctatcaagtagattgcaacaaaggtgagttgggatgagctaactctctcattagtaagctttctcattcctacgtgctagccttgcaactaggacattttgtatttttacttcagcagtgttacaaattattgcatgccataaacgtttagtattgctggaattgtctgagacatccaaagtctgctaaatagcactgaatctcattggtataaacagaattgaaatataaaccttaaatgtatttaagaatgctggccaggtgcagtggctcacgcttgtaatcccaacac

SEQ ID NO: 78974 - DNA, 1361 bp, Homo sapiens
acttaaatttagctcaagtaaaggggattaggcatattggtaagcatctaaatcaaggaggaattgaataacaggaagcattgaataacaggacttgagaagtttttttttttagacggcgttttgctcttgtcgcccaggctggagtgcaatggtgtgacctcggctcactgcaacctccacctcctgggttcaagtgatcctcctgcttcagcctcctgagtagctgggattacaggcatgcgccaccacgcccagctaatttgtatttttagtagagacggggtttcaccatgttggtcaggctggtctcgaactcctaacctcaggtgatccacccgcctccgtctcccaaagtgctgggattataggcgtgagccaccgtgccccaccgaagatgtgtatattaatcgatttttcattctattctgtcactaacttgtcttagttttcaggtccacaagtgttaattttagttagcggccagtcagttgtggctagaagaggtcatgtgtaaagctactctctccttatttttttattttttattttttttgagacggagtcttgctctgtctccaggctggagtgcaatggcgcgatcttggctcactgcaacctccgcctcctgggttcaagcgattctcctgcctcagccttctgagtagctgggattacaggcacgcgctgccatgcctggctaatttttgtacttttagtagagacggggtatcaccatgttggtcaggctggtctcgaactcctgaccttttgatccgcccacctcagcctcccaaagtgctgggattataggcgtgagccaccgcacctggcctactctctccttatgaagcatctgtagagctaggaaggaaacgatggtaatcttcagtaaaattgccatttaaaagaagtgttttggctgggcacagtggctcatgcctgtaatcccagaactttgggaggctgaggtgggtggatcacctgaggtcaggagtttgagaccagcctggccaacatggtgaaaccccatctctactaaaaatacaaaaaattagctgggcatagtggcgcatgcctgtaatcgaggctactcaggaggctgaggcaggagaaactcttgaaaccctggaggcagaggttgtcgtgagccgagatcgagccgctgctctccaggctgggcgatagagcgagactccgtctcaaaaaaaaaaaaaaaaaaaaaaaaaggcgttttgaatcacaaccctgtttatcacactatagtagataactttaagtaacagtgggttgtgttgtattgtttttgacaaatgaactgtatataatgaaaaatttcaatgcaccaaatgcttacagtg

SEQ ID NO: 78975 - DNA, 1385 bp, Homo sapiens
ttgacacccaaaaagtttccggttttggatcatttcagatttcagatttcagatttttagatttggaattttcaacctgtatatgttctaacttaaacttgttttttttttttttttcaaagttggagtcttgctctgtcgcccaggctggagtgccgtggtgcaatctcagctcactgcaacctccgctcttgggttcaagcaattctgccttagcctcctgagtagctggtattacaggcacctgccaccacacccagctaatttatgtattttgagtagagacggggtttcaccatgttggccaggctggtctctaactcctgacctcgtgatctgcccgcgtcggcctcccaaaatgctgggattacaggcgtgagcccctgcacctgtccattctgaattaaactttaaaagaatcttattctaagaatctttggctactctcaaaacactgttttgagaatcagctgtgagaggacaagagcagaaggaaggagtcgtttcagtagtagggtaatgccgtgtgggatgagagatgtgctgggtggtgagaagtgttggaatttggctatatagcaaggtaggtctgacaatttcctaatgagggtggatatggggtgaaaaagaaggatcaaggatggctcccaaaatgtttaccctatgcacctggaaacggaaagatctgggggaggagcaaggtggaggtgaggaagataagacttgtaattttggttatgtgaagatgaatgtaagaaggtactgaggagaaaaggttactaaatgttacttcctcattgcagctgtgacgttgagtgcttcagatctggtcactatggtacgagaacgaaaatgcatattatgccacatcgtgtacagctcaaaaaaggtaataatggaagagggagaatctgaggctttatgactattttttaaagagacatgttattaatagatgttattaatattaatagacatatgttattaataggaaaagctttgacaatgtcttatttatgcttcttttctttcctaaaccatagtctcattccactggtttctttctcgttactgcctcctaaagccagtacctgtattattaaacttctgtccatccagaatttgagcgtattcaaaactagatgacacagaaatttagtaaccagttatagggaagataccttaaaattccaaggttatttgaagtcatactgctttctgtaattttaaaatcatgtactttttgattagctaaggatatagcatctattatatgtacctacaatctgtttatgcctatgcttgtgaaaaatgcagcacagcagaaatggtattaacaatatcctagatgtccacaaggtggggatgttgctcaaagtaaaact

SEQ ID NO: 78976 - DNA, 1067 bp, Homo sapiens
gtagctagtccaagatctgaaactcaggtctggctgttctaaagctcttgcaccttccattcaacttcagaaagttttacaaggaaggagtgttttcaaaatgtagcccgaacagttgccactgactaaaggaaatggcgggacaccaaggaagagagtaggagctacagggaggccgggaaagaacaaggagaaacaaggagaatgaaaaagggaccagggaggctgttcatagcgtccaacgctgcgtactgactctcccgcaagcgggcctgcctttgttcttcctccattctttttgagaaaaacctcttcctgtgtgtccgttgttcactctcttgtgttcaaataaagctagattattgagaactgcggacggcaaaggaaaaaaaagcgagcgtgacggcttcggtgtgcgcctgcgcgttggcggcggctgtggcggggcccggcggggagcgggtccggagcaggctcccggacccaaaactgaagggggcgtctgaggcgtcagggagctccctcgcctggctctcggcggcctgatggagtaagaggggttggctgtgaatgtgagtatcgacgggccggcctgcgttgagcgtatcggagcccaagggtcctggtcgtctgccccttagggaggttgtggggctgcaagacaccaccgggtttctactcctgcaggctgcggctcaggggcaacctggtggtccactctcccagagccggcgcgggtttatgggcaggcggtgctgctggcttcggggtacggattttcgcgggggcgttccagctctgctcccagccccagaaggaaacgtggctccaaagccttgacctttaggggaagccactgacctccttcgtccccagttgggcagggagtccaaagaccctggtccttaaagcccgtaggtctcaggccagggacacatttcaacctctcgcgactgacaacctccgttctttttcctcctttcgtttctctccttgtgggatgcgtcttgataataacaactaataacaaatagtaacaacagcttactgtgtccgtttaatattta

SEQ ID NO: 78977 - DNA, 1056 bp, Homo sapiens
gtaccagcatttcccttttcttgttaagagtgaaagtattttctccagtgagtgtcctggacaactggcatatttagaaatgtttcctgtgttcttcaggcacataacttcaaattttgttactttactaaattggacttttcttcacctactgcttttccatgttcagacaacacatgaagaacattgaacaaccaaaaattcactttaatagtcttttaatgcttgtcttccagtaatgccttgcttctctaagtagaggatccactttcctgttggaaagagtacttccctagaagtcctaaaacctgtattttaggttcacccttggcactcttattaaacattcatttagcctctctcggtcttgatttctttacttgtggtagactaatagatatagaaagaggttcttttatcctgttttcctgataagttcctaaattccataaatctacactttttgctcacacaaacttttatatatccttattcttatacaatatccacatttccatttctgtgcctaatagagttttgattcatcatggataatctgtcatcagaagaaattcaacagagagctcaccagattactgatgaggtaaatgttttacctaaaataagtaaataattctatttcagttttcatattggaggagtgagagagccttcttagggacattttggcctcttcctagtccattaatatcaaagaacacatttgctccttagtgccattgctggtttttattttctttttaactcaccagaaaactaaagtgaaaacaatttgtatgatttttattttttaggtaattattaatattacttaagtgtaacaaagatactctactatgtatttgagaaatgctagacttctatttaacaatttcctaatatctgtaatttacttagatttctacctacattaaatttttattcccatgaacttcaccatccaaatattctcttttttaaaaaaactttttctttcaacatcacactggaagtccttacacattttctcttaaggagcgcctgaaaataactaaa

SEQ ID NO: 78978 - DNA, 1514 bp, Homo sapiens
tttttccacagcaagaggctaggtgcctccggatcagtacgtgaaagattgttatcatgttgaatcgcttctaataccttttgacactgacatactcactgtggggagttattggtagattcaaggttgaagtttgctgttccataataatagcattttctggttgacactgtgaatggaacacaaagtgttaacttcacaacttattcttagaacaactaaaccgcatagaagaaggcttggaccaaataaataaggacatgagagagacagagaagactttaacagaactcaacaaatgctgtggcctttgtgtctgcccatgtaataggtgagttgataaattaagatggtttcaaaataagtaatgagagtaccccaccttctcccaccagctaaggtcagaagtatgactgggcttaatgaggaactctattagataaatctaagttgtctctccttcaggcagattaagctttttgtgtaaatactgcgtgttcactgaaaactgtgacttacatttgaccaatcctgggatcaagtccaatttcaatttgtagtaatacatgaaaaggttaggaagtatagggaaatgtatatctggatgatggaaagcaggatggagttattttcttttcctttcaaaggaggagtattaacaaaatatatattttgtggtaggcacatgagggatggccaaaagagtagaagagttgggaaagaatggcaaaacataaaaaatacataaatctaatgttagattatatgatagtgagcaaggctaaatctaatgttagattatatgatagtgaccaaggctaggtatacagaactgataaaggttgggttggagagcatcttatagaagaggtaggatgtggattgggctttgagtgataagaaggatttggatgaacagggaggaacagtgagggcatttcctatgaaaggttcaaaataaagattaacaaggagcttgacttaactgagctgtgtgactcatgtagatgagaagtggaaagtaagatataagtaggtagtagaggaacttgaatgccaaactaaggagttgacagattggagtggagtataaaaagaaacgacagtatctggagattgaatgactgtactcactgctgaaagttttgttttgttttttttctgagacagggtctctgttactgaggctggaatgcagtggcgtgatcacagctcactgcagcctctctttcctgggcacaagagatcctcccaccttggcctcccaaagtgctaggattacaggcatgagccactgcacacagccaaagtatccttttttttttgagacggagtctcactctgttaccaggctggaatgcagtggcgcagtctcagctcactgcaacctccgtctcctgggttcaagtgatttctcctgcctcagcctcccgagtagctgggactacaggcgcatgccaccacacccagctaatttttgtatttttagtagagacggggtttcactatgttgg

SEQ ID NO: 78979 - DNA, 1158 bp, Homo sapiens
cctcagcctcccaagtagctgggattacaaatatgtgccaccatactcagctaatttttatatttttagtagagacagggtttcgccgtgttggccaggctggtctcaaactcctaacctcaggtgatctgcccgcctctgcctcccaaagtgcggggattacatgcgtgagccactgctcccggccaaaagttcatattttaataactatgacttgtcaatcagagtttagcagattactttaagcaaacaagttaaaatgtacagattatttgatacaaactcttagctatgttttacaaacataattgtacctttctcttgtgttccatgtaccttcttggaagagtacagaagagaggaagtagatgaattttcttgagatcagatgttaggagaacaaggagaaagaagtctcccctaaaatcttagaggaagatcagctctaagtcacgtgttgataaataggaagagcactgaattagacctaagatggtctaatatcatagaaagtgggaaatgcagctacagagtattaattttatgtctctttgtgtatcccagccaagcataggcaagcttttcttgaagactggtgggaaacaaggtagggtatggtcctgaatcagcattcttcagcctctaacctcagtagaaccctttctcagtggatcaagagaaggcattacttttttagagatggcctctccctctgtctcccgggcttgaatgcagtggtgccaccatagctcactgtagcctcaaacatctgggctcaagcaatccacccacatcagcctcccaagtagctaggattacaggtgtgtgccaccatgcccagctaatttttgaaattttttgtagagacaggggtcttgctatgttgcccaggcttgtatcaaactcctggcctcaagaaatcctcccacttcagcctcccaaagcactgggattacaggcttaagccactgcacccaactggcacttctttctttttttttttctggcacttcttgagagatggaatcaaggggctgctgtaacaaaacagttcccttaagagaagaaagtattatctcagttaaagatgtctgattgtaattgtctttcttccacctatttctttcttacaccattgagaccttggccagtatgata

SEQ ID NO: 78980 - DNA, 1209 bp, Homo sapiens
tccgatcttaagtcataccaaggtgtaaaaattcagctccgactaattaaaatgaatattgaattatatttcattcagtggtttagtgcttcttccatcctgctcactggagacacaaatatgagtaaggcatacctctggccctgcctgttttatttatcatgacatgattttttatacctcacatagtattggatatacagtagttactcaataaacacttgttgatttgagtgtccttgagaaacttgttggctggtgggagagtttgacgtgtaaaaagattttttaaaattacaatgaaaaaatatataagaaaataaaatacataatagaagtcattaagagaaatcttaatcactaagaggaaggagtctcaaagcactccattggtttttgccttctctcatattgtctaattttaggaaagaatatcatcacccaaaattctgaggaaaaatgaaatgtgctctggtttaaatagttttcttatttttctttttatctagattctcagatgttggttgtttctatgaaaccaggcaggaaattgaatgcattatgtttttaaaactttaaacctgcttctgttctgtttgactggcatttactattttctgcatttcattctctcacctaatctcttcctttctaatctgcttactaaaaatgaagatttaacatcagaagccgggctcagtaactgatcaaagggaactttaagatgcagtcttgtggcgcagtttgggctgctaacctgctatctaaaggtgatgcttcaaatggcttttctgtgcatgtgcatggattttgtgaatggtgaaaactgtctctaaactgtgtggtggtgtgtagtgtaaagtgaatttgttcttgatgggtgctatctcacaaaagatggacttgacaaaaggaccttaatttataataccatcctttgacaaatgtctctgataactaagtttttgctaaataacatttaagattaccaaaataacaatactcctggagtttcttaagaaatttaaaataggttgatctttgagacagctgctgcagtctagttctgataaaaggtaagggaagtcatgctaaatgcttctctgtcttcatagactttgattttagcatcctgtcttccattaagtttccctacttttttctggttcttgagtcaagatttcctctattaaagttttgcttctaatg

SEQ ID NO: 78981 - DNA, 1082 bp, Homo sapiens
gaaattctaataaaagccccacttctgttacttctgttaatatttgtggttattaactttctgataaactaatatattgcttttgttttatttactagcacttactctgctctagaattttgcctgggacctttcttattattaacaaagaatacatgtgaatatttattttaaaaatatatatcctaccttgttccaagaaaaatttaacatggcttcttaataaataaatgggttaattaataaaaacagcatagaaacataattatgataacttaaagtggtaccatgaaacacacttggagaactagctcttcagtgttcataaatttgcctttgcaatgcctctcacaaaaaaaaattagtagtatcctttctgtaatgttaatgataaagtctaagattcaattctaggtttgccgaaaatgaatcctcacatgcctattaaggaagaagtcacttttttcataaaatctcttccctacctttttaatttttgcaattttaaaacttccttattaatgtaaaatgtagaataaatcagagatcaatatttgagcaacatactatttcgtttttgtttatagaaaagtgaaaactaaaattgaatgaaagcttgactttagccaaataatcaagaaaagttttgtgtcacttttccgtaacagccatttttttttccctgtaatagccactttttctttctttttaagacacttagacttatgatttttttttttttttgagatggagtgtctcgctctgttgcccaggctggagtgcagtggtgtgatcttggctccttgcaacctccgcctcctgggttcaagcgattctcctgcctcagcctccccagtagctgggattataggcacgtggtgccacacccagctaatttttgtatttttagtagagatggggtttcaccatgttgcccaggctggtcttgaactcctgacctcaggtgatccacccaccttggcctcccaaagtgctgggattaccggtgtgagctactgtgcccggccttgatcgtttttttaaagaggaaactcttaaatgaaaaactcctacactacagg

SEQ ID NO: 78982 - DNA, 1047 bp, Homo sapiens
acttgatttacaaaatcatatggtggccagatttggtccttgggccgtagttttccaacctctctcttagggcagtgcttctttagatagacttaactgtgcattagaaccacttgaggggcttattaaaccgtaggtttctgggatgcacttacagtttctgattgagtaggtctggaatggagtgtgagaattagcattctcatgtctaacagcttcccaggtgatgctgggaattaagctttgagaaacactgtttcagagtttctttcttttcttacatggctttaagatactgtgctctctttgatgagtctcccagtttttattatagaatgtttcccaggaatggtaacctatattcttttggatcttatacttgctgagagtcattttggttacttacttttgtgaaaagtaaatccagacttttatttaaattcaacaaaacctatggaattaactgtcttcttgtgatagcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggtaaaagctttttattgccacaagaaaatgagacacccagttcagtgtttcagtaatagacatctgtgctagatactgtgggggacacggtagaataagctcctgtcctcataggtcttaattctgatgaggtggtggttctaacacataaaacaagagccaagtcctccctgtcatggtagttggtgcattttgaaaccagagttttggaatatagtagttttacttaaaccttcacacatgaagcttagtatctactttagcttttgagcgtgtttttttctctcccaaatgagttttattttgttaactaattttttaattgagaatggggtcttgctctgtcgcctagggtagtgtggtggtacaatcacagctcactgcagcctgcctcctaggctaaagcgttcctcccacatcag

SEQ ID NO: 78983 - DNA, 1303 bp, Homo sapiens
ctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaactaatggtattgttctttcaaataggtaacatgtttctatgactgttatttgggggaaaatagtttcatcagctctcatttaacaaattaataaagcaaagatccatacatcaagaaacactacagcaggaagctgcctttagcatctttccagtatttattgaaaatattgatgggacttaaacttaccttgctaaaaatttattgtgaggttcattttaatcattactagtcttactcacttgagcttaaatacactagtgactggaagggtaatggttctgtgtgagaactacaactcactggagaagatacagttaatgtgggagctttcaaaggctaaagaggaaaatatttaaataaagtgagatgcaactacaccctctgtaatagaaatgctccatgtcaaaatgagtggtttggcagggatggtaaatatgtaaagtaaggtgtaaaacggaggattg

SEQ ID NO: 78984 - DNA, 1038 bp, Homo sapiens
caaatgcaaatcatgcataagtgaggtccataaatggaggtcttgaaagcccgtccatggaacccaggttgaaactttcccacagcttctgctattgagaaaaaagagaggtgaggccatcaaaattagactccatcatgcattagaaatggctgttcacttaaagccctttctgattttctcccataacattgtctggaaacttgattcacttttgaaaggtagtaaatggttaacacaagctctggagtctgaccacctgggatcaaattttggttcattcatttacttctagttgtgtggccttgagcataatactgacctataactaaagaggtaaaaaattatatcccccactgagcttgttttttaacactaagctccctcttcaagtttccagtcttataaccataatgatctgtgtcccctatagccatgcctatttctttgcttcagttttaattcatcttttgtttctatactctaaacctttccatttcatgtgtggattatgagtctgtccttaacttaaacatctatggcccagacatcctgaactcagttgcacttagaattagctttttaaagacatacactgtagtcccagctacttgggaggctgaggcgggaggatcacttgggctcaggtgttcaggaccagcctgggcagcatagtgagatcccatctctctgtctctctctctctctctcacacacacacacacacacacacacacacacgcacgcacacatggccaagaggtatgtgaaaaaaatctcaacactgctaatcatcatggaaatgcaaataaaacctacaatgagatgatctcattccagttatcatggctattatcaaaagtgagaaaatgctggcaaggatgctgagaaaagagaactaattcccacttggtggcaatgtgaatgagtgcagccactatggaaaacaaatatggagatctctcagaaaactaaaaatggaattaccatactatccagcaatcatactactgggtatttattgaaaggaaaggaaat

SEQ ID NO: 78985 - DNA, 1048 bp, Homo sapiens
gtaattacatctaaaataagccttataatgattgggtgttataatgattgttactgggttaatttggacttgaaagagaagaacattttggggatgtaatgtaaacaaagctacctaacttggaatgggggatggatgagaaggggaggatcttccaaatatcacaaaattgctgtcggattgtgccttgggcccctttacaaaaggagcccattatacacacaaatgctctccggcattttgatggcaccctcaccttctaaagactatgttggtaaaatgcaatatctaaaaatggcacatgtgggagttttacatatattaacaagaggcgaagcaggctgccatatagtctttataaacttcatcaaagttgttttcagctctatcacattcaggttttaaaaaaatttttctttgccagctgttctgcctgatgagatatgcaatctgaaaaaactagagacgctaagcctaaacaacaatcaccttagagagctgccgtctacctttgggcaactctctgccctcaagaccctgagcctctctgggaaccaactgggagcattacctccccaactttgtagcctacggcacctggatgtgatggatctctctaagaaccagattcgaagtatacctgactcagtgggagagctgcaagtcatcgaactcaacctcaaccagaatcaggtctagagctttaaggttttttttcctacagcatatgtgtggctttaaggtctcctgatacctgttaacctcttgtttcctaaactgccatcatagagctaagtatcagaggctaaatgagaggtttcttctataggctgaactaatttcaaggcccaaagtgccatggaattagttgagacactggatgtgttagttgtgtaggtgttttggggagggtggggtaggtaacagggagagatcatttcaaaagttaaactactgtctcacaaatcttgaagacttcttcagatcctcctcaaatatatgcccctaaccagctagccaggagctatgtcagggatataatgtggaa

SEQ ID NO: 78986 - DNA, 1045 bp, Homo sapiens
atacacagtatgaatgacttgtaggcaactgaggtcatttaacgaatcagataaataattccatgaaggcgaaaatatttgatttcaaccccggaagctctgagagactgggcctgagtcatttggaaaggtagaggtgattctccaacaaatttagcctttgaatcctttgataaactatcagtaatacaaatctattttgtatggtaccttaggaaataatacaaagggagtgtgttgtttgtttctcttattttttttttaaatatttgagcaagtgatttgtgatggtgaaggttctaaaacaggaattacacattgctactattttactttgtacttcatgttcaaaggcagtgttgaacataatattttctcatattttagactatgggcatgctattccaatgtacctagaaactttttgtgacattctgctactttccttattcatttaccaataggagatgttaaacatgtctaagaaaacagtttcttgttttgtgaacttcaccagactacagcagatcacaaatattcaagctgaaatctaccaggtaaatcattttgttttcactttcttttttttttttttttttttttttgagacggagtcttgctctgtcacgcaggctggaggctggagtgcagtggcacaatctcggctcactgcaaactccgcctcccaggttcacgccgttcttctgcctcagcctcatgagtaggtgggactacaggcgcccgccaccatgcccggctaattttttgtacttttagtagagatggggtttcaccatgttagccaggatggtctcgatctcctgaccccatgatctgcccgcctcggcctcccaaagtgctgggattacaggtgtgagccactgcgcccggcctgaacttttcactttctactcctagtataggaaaacaaaaacaaaagttggccagatgtagtggctcacacctataatcctcgcactttgggaggccaaggtgggaggactgcttgagcccaggagtttgagaccagtgtgggcaacacagg

SEQ ID NO: 78987 - DNA, 1015 bp, Homo sapiens
attagccaggcgtggtggtgggcgcctgtaatcccagctacttgggaggctgaggcaagagaattgcttgaacccaggaggcagaggtttcagtgagccgagattgcaccactgtgctccagcctggtgacatagcaagactccatctcaaaaaaaaaaaaaaaaaaagaaaagaaaatggaatggggtttttttatctagggagaaaatgattaacattgaggtttctctaacattaagttggattccagataggattactgttgtctctttccatttttttatttggatgacaagttgcttaaagtgaaagagaaggacctttttttaatcactaatatttctatgaatgcaggaaggttgttattggctctctaggttgattgtaattcttatctcaaattaaaagtcctgattaaaggagaagaaaaggaacgtaaaacaattaaactttaaaaaatggttgacttttttctttctctttcagatatatggtacatttgctggagttggctgtgactttcattgagagattagaaacccaccttgaaacaattagaaatattcctcatttagctgcaaatctaaagaaaatggtgagtattaatatagcaatcttcagttattttttactagaaacttagaggtgtgctctcccagtttagctttttaatagctaatattacgagctagttaatttttaaatcaagaagtattttcttggcctggcatggtagttcacacctgtaatccctgcactttgggaggccacaacgggtggatcacttgaggtcaggagttggagaccagcctggccaacatggtgaaactccatctctactgaaaatacaaaaattagctgggcatggtggtgcgtgcctgtaattccagctacccgggaggctgaggcaggagaactgcttgaacctgggaggcagaagttgcagtgagctgagatcgtgccagtgcactccatcctgggcgacagcaagactccatctcccattaaaaaaaa

SEQ ID NO: 78988 - DNA, 1065 bp, Homo sapiens
cttaaatgtgggcctgaattttaggaaggaagttaggtttagcaatataaattgagggtcatctgcattgagtgattattgaagacaaaagagttgaactcacaaagagtaggtttgtactgtaagaagtgggaaagcacagttttaaggagcttttgaagtaaggggctggaaaaagatcatgtgttaacctttggtatcagttactgatgatataatgaattaataagagacataatttctcctgtttcccttttcaaatgttacagaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcaggttcattaagaccaaactgacttttcctttgtttttcatatatttttattctacctttcagtaaaactagagaagctaaaaaatagccatgacaatttattaatataagtgaattaaccatttctcaggtgggaaattctctttttttaaaaatgtgtgtttatcgtctggtgtggtggctcacacctgtaatcctaacacttggggaggctgaggcgggcagatcacttaaacccaggagttcaagaccagcctgggtaacatggtgaaatcccatatctacaaaataaacaaaaaattagccgaccatggtggtgcatgcctgtagtcccagctattcgggaggctgaggtaagaggatcacctaagcctgtgaggtcatggttgcaatgagtcatgatcacgccactgcgctacagcctgggcgacacagtaagaccctgtctcaa

SEQ ID NO: 78989 - DNA, 1024 bp, Homo sapiens
aaaattaggccgggcgcagtggctcacacctgtaatcccaacactttgggaggccgacccagatgggtggatcacctgaggtcaggagtttgagaccagccttgacaacatggtgaaaccccatctctggtagaaatataaaaaattaaccgggcatggtggtggacgcctgtaatcccagctacttgggaggctgaggcagaataatcgcttgaacccaggaggcagaggttgcagtaagccaagatcgtgcctctgcactccaacctgggtgatggagcaagactccatctccaaaaaaataaaaaatacaaaaattagccaggcatggtagcatgtgcctgtaatcccagctactcaggaggctgaggcaggagaatcacttgaacccaggaggcagaggttgcagtgagcccagatcgtgccaccgcactctagcctgggcaacagagcaagactctgtcttaaaaaaaaaaaaaaaaggtgtttctgaattagaagggtcttcttgaatctgaaaatgtctatgatgattattcctgtgggaatgtcactaagtatgcagaaaagagtaacacagccagcctgacttatcctttgaaaggcctgattataaggtttgtcctcagctgttgcatctgggaacttagatatcagaaggtatcttagtctgttctgctgtcataacagaattacacaaactaagtattttataatgaacagaagtttatttggttgacaggtgtggaggctaggcagtccaagaacatggtgccagcatctagtgagggtcttgccatggcagaaggcaccacatggcaagtgagcatgagaaagatatatgggtctaaacttagccttttatcatgagcccactcccaagatagcagcactaattcattaatgagggcaaagccctccttacctaattactttttaaaggtctcataacacttttacaatgtcaattaaatttccaacacttgaactttgggggacatatttaaaccttaacaggagggct

SEQ ID NO: 78990 - DNA, 1054 bp, Homo sapiens
cctggtaaacaacatttctcacatgttgtcacaattcagttgctggtggaatgaaacaacagatatgtgtgactccactgttagaggactctggaagcttatacctggtttcccccagactttgcctctgtaccttttctctttgctgttttgcttcatatgcttttgctgtaataaatcatagctgtgtgatgatatgctgagtcttgtgaattctcctagcaaatcatggaacctggaggtagtcttggagaccctggcatacaaagcagttcctaagtgtttactggtagctgtaggaataggcaaagaagaaacagcaaagaaaaaggcacactgtggtataactttggaggtttaccttgcaaaatgctcagatattttacctatcagaggttattgtgcatataatagagagtgatatactaacaactgcctcaggatatactctttttaatcagtattgtaactaaccttggcttattttacttttagacttggggttctattttgctttaaaacatgtacatcagttttgttttttgttttgttcttttctttcctttttttttttttttttttaaagacaggatctcactctgtcacccaggttgctgagagtgtggtgtggcccaatcttgacctcactgcagccttgacctctcaggctcaagtgatcctcccacctcagcctcccaagtagctgggactataggcacgcgccaccacgcctggctaatttttgtattttctgtagagacagagttttgccatgttgttgaggctggtcttgaactcctgggttcaaacgaccctcccgcctcagcctccgaaagtgctgggagtacaggtgttagccactgcgcctggcctcattgtactccttaacacaagaagacttcaacaatgataagtagttgtttataaggaagcaggatcattaccaaaataaatcctgctaaaacaacaggaatcatgttttaaagcctagtttgctaatttttgctagtaggataagagtgatcgtaatatctcgaacattacatagacactt

SEQ ID NO: 78991 - DNA, 1021 bp, Homo sapiens
taatatttaagatgtttattataaagatactttgcaaggttagtatagcacagttgtacagattggaagtactctaattggtactttaagaaaactttgaaataactaacagattttcaaaaagaagaaacttcaatacatcaagaaaccattggccttttcaagtaaccattttcatggtaggtaacaaaagaagcttatttcaaatgcggtaatatcgtgtatttcctcatttcttcataactggataatcattgggaaattaacatgaaatctgagtcctggctatttcttatgatacttttgtctgaaactaatgatgttttggtctgagaaatggtagtgagaggtatcacttccagaaagaacaaagaaggtgggaaaagactgcttgaacaagacatcaaagttggctagtgtccatttaggcttgagcctcctcatgattcaggtgggtataagttagctcaggtagtgttctgctcctatgataggtgaacagccatgtgcacaagggaattatagaggttagtatcttctttgaaccttaggcttgtacttgtcctcctaggtagagtggaaaagggctagacagctagtcagccagcctgcaaggtaggtaggaggcaggtgaatcttatcaatctgctgtttgagcagccaaggctttgccagctgagcctgttggtcacccgtcatgtgtcttgtggttctgcttagctctcggtcaagtttccaaggcagcaggaggtctggccagtgggtctacaggacttctctgtttctctgaagcagcagtgttgtcttggtttgagcactgttaaaggccatgtactcagaccccatcatggccagcaagccttgcctcattcacttctatggccacagacagtagcccttgccccagcagctatcagggtactttgcaaaagtccaaacctaaaattggaaaagccatttacttggcctttcatggttcattatcatcatatcacatatgaaagaaaagactatgggaata

SEQ ID NO: 78992 - DNA, 1079 bp, Homo sapiens
ttctcctcctgggttcaagcgattctcctgcctcagccttctgagtagctgggattacaggcatgtgccaccacgcctggctaattttgtatttttaatagagacgaggtttctccgtgttggtcaggctgatctcgaactcccgacctcaggtgatccgctcacctcagcctcctaaagtgctgggattacaggcatgagtcaccatgccagggtggcccttgattttttatcccagcactcaagtgtgtatgaggcatctggttactagtgtttgtaaccattcccttgagctcctccaagaagaaccagcaaagtaactaactttgagtaagaaagatgggactcctataacagtccacagttgtgactgtatttgtggcgtagaagacagtggcctttctgttagcggaaagtatgagcattctgatagctgtttgagacctgcctggccatggcatacgtgtggctgttctgtacataagaggaattaactattttgtataacatttgataaatcagtcatcttagagggggtgtgtgaatgtgttaaaattttatgtgtgtgtgtgtgtgtgtctgtgtgtgtgtattagtatcattaagcttgagtatgagtttggttgtgagtcccgtattttacatttatgtgtcttaactgtataaaaatctagtgaaagcccaaaaggccatagaggagggaaattcataaatatgattcttcttttgcctgatttgaaatttgatggaaagatcaaatgagatccagacaggaagcctgtgcagagagataaaccagtgtctcctgaggtttcttctggcttgtttattaattgtctgagtccctcattggtcccaggaggagttaggataggaaagagaaggaagggaacctctgtcacaagctggagtggagccagaggtcccagagtggtggcaggactcatatctacatgatacaatcagaggccctcattgctttaacacagaaattggagctcaggtttaaccctaatcactatggctctgaggccaccacggacgggtaagaaaggtggaatctatacaatcttaggact

SEQ ID NO: 78993 - DNA, 1115 bp, Homo sapiens
aaacctgggaggcagaggttgcaatgagtcgagattgcgcaactgcactccagcctgtgcgacagagcaagacgccatctcaaaaaaaaaaaaaaagtaatgtatattttatgttcctgtagcagtatgctagtttattttttatttttatttttttagccacaaggtcttattctgtcacccaagctggaatgcagtgatgcaaacatagctcactgcaacctgaactcctgggctcaagtgatccttccgccccagtctcccaggtagctagggctacaggtgtgcatctaggcagcggatttttaaatttgctgtagagatgggatctcactatgttgcccaggctggtcttgaactcctggcctcaagtgatcttcccacctcagcttcctaaagtactaggattatagatgtgagccagcgtgcttggctgtagtatgctaatttaaatcctgataaggagcgggacatgaacatcaagagccggtcttttctctggtcagggcatggcaaatggatgacgcaataggtatgctagtgactgattctgctacctatgtcttttcccaaatgtttaatcataaatagcagcctagaaacaacaacaaaaacaccatttcctttgctaggaaccagtttaagtttgctctgtaaaactctgtgggtatacatatctgtgtaaagcaatactttcaaggcagaccatgagttgatgcagcagtatcaaacttctcatcttaaaagtctgtgtgtgggccgggtgcagtggctcacgcctgtgatcccagctctttgggaggctgaggcgggcagaacatgaggtcaggagattgagaccatcctggccaacatagtgaaaccctgtctctactaaaaattcaaaaaaattagccgggcgtgtggcacacacctatagtcccagctactcgtgaggctgaggcgggagaatcgcttgaacctggaggtggaggttgcagtgagccaagatcgcgccactgcactccagcctggcaacagagcaagactccgtctcaaaaaaaaaaaaaaaaaaaaagtctgtgtgtgtatgtgtgggaggagtaaccataggagacctcagacatagttcagat

SEQ ID NO: 78994 - DNA, 1036 bp, Homo sapiens
ggattacaggagacgccaccatgcccggctaattattttttaatttttagtaaagacggggtttcaccatgttggccagactggtctcaaactcctgacctcagatgatccacctggctcggcctgcctaagtgctggcattacagatgggagccatcgttcccggccctgtttcttttcctttcctcctactctcatatttataggtcctctgatagaacctaatattgtaaaccggatttacacacaatccgttaagctatacacctagaatgggtagaagcattttataaagactaatcaaaatatcttctgcttatatttatttttaacattttaaaacgctttcacatcggtgtgatcagtatggacatttaaaacaaaaggttgaaaagaaaataagcattaaaatgaaatattagaagattcacttccattgtgatggattgaggaggtcaagtcatatccccaaaaagcaactataaagctggacaaaatcctttctgtggtctgaaaatagattaaaggaatgtaacaaagtgagaagtaccacacccaaaataaaatgatgactaaaaacttcctaaatttgttgaaaatcatttatagatctaagaagctcaaaggactccaagtaaaataaacacaaagagatccacacctagacacatcatagttaaactgttgaaagacaaagagaaaatcttaaaaacagctagagaaaagtgacttatacagtagaacaattacgtgatgaatggctgacttctcatcagaagcattgaacccttagaagtcagggggctgagataatataaaaaactggcaataagaacattcccagattggaaaaataaaaagtagaatttattgccagcagacttacctgacaagaaaactaaatgaaatcttctaggctgaaagaaagtgatattagaaagtatcttaaatctataggagacagtgaaatatctgggaatgataaatgtgtgagtaaatataaaaaaaacctacattctttctcgtttcttctcct

SEQ ID NO: 78995 - DNA, 1020 bp, Homo sapiens
atgttttcattttgtcgcaatagggtagacacagggttccttttgataaggttaccttctggtttggggcatgaaaagttgatatttgtccttggttttagagtagaatgctgtcctactaccatcatttctcaaagaggggagtctaaaaaattatgtgactcaaacattccatatcgtgagtctaaagtctttaggaatacctaaaatatcctattgtatgcagaagggattaggaaatatgatacttaagtctgtgttctccaaccattgttttgttttaatatatttgcttcataattccttctttcttccattttcttttttcatcttttaagcccagaactcccaagttttcagcagctgccagagcctcaacagctcagtcagcaatggtggtgacagtgggatccttagctctccttctgggaccagcagtggaggggcaccctcccgaaggcagtcttatatcccataccgagactctgtgttgacctggctgctgaaggacagccttggaggcaactctaaaaccatcatggttgccagtgagtgggatgccagagctggacctgtgttgggactggtactctatctcagagaaagggccatggccccagtgagtgggatgccagagctggatctgtgttgggactggtactctatctcagagaaagggccatggccccagtgagtgggatgccagagctggatctgtgttgggactggtactctatctcagagaaagggccatgaccacctaggtttctcatttcatcaggggtcttatacagcatgggcagtagtaacaaggcaagtgattaagagctgggatggatgggctggcatgtttttaaactttctccttctacctcagcggtgtctcctgcacacactagctacagtgagaccatgagcacactgagatatgcatccagtgccaaaaacattatcaacaagccacgagtaaatgaggtgagaccttttcagaagtcctggtctggtatagtttacacaaag

SEQ ID NO: 78996 - DNA, 1008 bp, Homo sapiens
attagagaactcagagaagagattgaaagactgaaagccctgctgctgagctttgaactggtatgcagacagtcagaacctttccgtacttaagtgaaattctccttctgagcctcttttcttctccatagagtctgggccctgctgcattctatgttctcaattgactctcttacggcagagacaggagcaaagacaaaacagagatttctctgatttctcagtgtagcttcagatggtgtgggcattttttcactttatcatctcttgtcttgtgcctggatggtccttgccctgtgtgggcaggtacggagaatggggccctccaggaaaatttctttgtattttccatctttgtaccaatatgagcccaaatacttaggctcctgatttcttattttaataataaagtttttcctttatctgcatcttatcctcctccacaagtgtaagggtgggacctacctgaagttcagaccaggaaaatatcaaagcacatctctatctttgtgcagagaaacttcagttcattgagtgatgaaaacctgaaggagctggttctccaaaatgaattgaaggtgggtgtgttgggtggactcagttgttctttacatcacctgggagctcctccattattccggagctaggtagggttgctcccttggcagggcagagaagagctgtctcatttaaatacaatgtttgtttcctttaagccttgaccgggggatgtgtttgcctagggggactgttaatggctttctgactttctgtattgttctctcagggattcgtaagtcctttggatagtgagagtagcctgggggcaaaagactgttttcttgtctaaatcagtcaaccaagatgtattcattgtttgaggatcaaataggtgctcagcatgatgctgcaagaggtacagagaggtccctgccctcatatggtttgcagtctagttggaaacacatttagagaatggtgtgtttcatgaaccatgtgatttagctg

SEQ ID NO: 78997 - DNA, 1084 bp, Homo sapiens
agagtacatcatggtgttgtgctcttctcttgcctttttaaagtcttctatggctctctagccccacaggcactgacatgagctttcagacacacaagaatgtgtcctttcattcagagaagacaggaatttcagaatcaaggcctctcccacccactgtctccactcttgagcaccagctctaggagcctgtaggctgggctggtcctgcccagctactgtagccagcatctgtaccaatccctggtggaggtggtgtggtgtggtgctcaagtccgtgattgggcaaagggaccagggagaggaacctgcacgactagagaaaaatataaattgtcagctgggctcccagtctggatttgtggttgtgtgtctacgagtctctccctctgctcttggatgtggttggctccaaagcctccctttattccaggtttcctttccctcatttatctctggagcagcattcatgaggagcctgcaaagctggagctagctccagagccaggggaaattggccagtctgccttccttttctccttgcagcagtaatctggaccagaggggaatttgtctttgaataccattgcctgtgttcttggcattttcccatttggaattgtagggggttaaccttaagtgcctagagcctgggagacactgttgctgcttccgctgccaccaccgctgccactgcggctttagtaagtagatgccactgcaatctgctgcagaagctgccagaccccgaggctgggggacagctgtgagagaagaagcaggagagtgcagtggagtcctcacaagcaggtgtctaggcagcagctgggggatactggagccatcagagatgaagggcaattacctgataaagacagaggtcccttggctggcaggtaaatgaagacttgccctttgtaatctagccagacatgtagtataaggttgctattttctttttcacctgctttctgggaacttgacaaaatgtgcttagcagagggaccattctgtgcggcctcttgggtgaatgtgctgcatctatacagatggcagcagacagcctctccttgcaggtcctatg

SEQ ID NO: 78998 - DNA, 1467 bp, Homo sapiens
cccttgggtaacctcagccgcttctgtgacaggagagcgcttgaagagcaatgtgacgaggaccatcagacaccgagggatggagagacatcccacagggcccagattcagcagcagcagagctacgtagaggatttgaggcatcaaatcctagcagaagagattcgagctgcgaaggaactggaatttgaccaagcttggattagccagcagattaaagaaagtaggtgtccaccacttaatgtgtctgcctcacctccttattctttcattttcatgcttcctcagccttctgtattctctcttttgttttctttgtgatatgatggaatctttggtattaggtgttctcttttcttttagacaccagagattcttataagaagagggctggaagcaagaataaggacgctaatttccttattgtcctcagaattacggacctcctacttactgctcctcatttggtcatgtatccataccctaccgcctgccctagcacgtgcccactgctgtgctgagtcctgagggtcttcattcccttaccttgtggtaagggagccctgtagccctgcagccctcaccctgccacatcaccttggccagctctttcactccacacaggtccagccatggctggaggtatctgagtccaggcagccacaagcagggaaggagatgctgaaattctctctgggtgtttttggttcccagaccagcagtgtctgctcagagaagagacctggctggccagcttgcaacagcagcagcaagaagaccaggtagcagagaaagaacttgaggcatctgtggcacttgatgcttggcttcagacagatcctgagattcagccatccccatttgtccaaagtcagaaaagggtggtgcacctgcagctcctgcggagacacactcttcgggcagcagagcggaatgtccggcggaaaaaggtctcattccagctagagagaatcatcaaaaagcagaggctgctggaggcccagaagagactggagaagctcacgacattgtgctggctccaggatgacagcacccaggagcccccataccaggtcctcagccctgatgccacagtcccacggcctccatgtagaagcaaattgacgagttgcagttctttgagcccccaaagactctgcagcaagcacatgccccagctacacaggtacagccagtagttgtcactgggaagcactcggttaaagtttacaaccttcttgcccaggtagttttctgtttttccccatgcctcatttcctcagtctgtgaaatggaagaatgtgtatatttctctcttcctcatgactttttccatcttctggttactcttctttctgtgtatatcgttttagattcaggcctttcccatcttccttaccccctgagtagcaattcttgcttctttggtaacatcttaggagtaaggatctcggcctcacttttcgt

SEQ ID NO: 78999 - DNA, 1061 bp, Homo sapiens
accaccttctccaagcagggcatcaaaaaggcatcagagggttctggcaactagggtcagaaatattaccaaaaagtcctctcacttgcctcttggcagtcctttgaagagacaacaaaatacaagggacccagacaccatggtcccactcacagatttcagcccagtaatggatcattcaagagaaaaagacaatgatttatctgacacagatagcaactactcattggattctctctcatgtgtctatgccaaagccctgatagagccactgaagccagaggagaggaaatgggatttcccagagccagagaactctgaaagtgatgacagccaactatctgaggactcactggctgagaagaggtaccaaagccccaaaaacaggctagggggcaatcgtcccaccaacaaccgtggccaacccaggaccagaactagagcttctgtgaggggcttcactgcagcctcagacagtgacctacttgctcaaactcataggagcttctccttggatagcctgattgatgcagaggaagaactgggggaagatcagcaagaagaacctttccctggttcagctgacgagatacccacagagactttttggcacctggaggactctagtctgcctgtaatggaccaagaggcaatatgcaggcttggtcccatcaactacagaacagcagctaggctggatgccgtcctgccaatgagcagttcgttttaccttgatcctcagttccaaccccattgtgagctccaaccccattgtgagctccaaccccattgtgagctccagccccattgtgagcaggctgaatcacaggtagagccaagctactctgaacaagccgactctctccaaggcatgcagctttcaagagagagcccactgatgtccatggattcctggttttcctgtgactctaagatcaaccccagcagccccccaggaatagtgggttctttatgtccaagtcctgatatgcaggaatttcactcctgtaagggggagaggcctggatactggccaaatactgaggaactaaagccatcag

SEQ ID NO: 79000 - DNA, 1024 bp, Homo sapiens
gccagggatatttgtgattctttagggaaacacacaacttgcagagagttcaccaacacttctcttcacccacagagaatgaaagcattggctagagctctgccattgcaacccaggctagagaggtcttctaagaataatggccagtttgtaaaagcatcagcaagtctcaaagggcagccttggggcttaggaagtcttgaggaattggagactgtgaaaggttttcaggaaagccaagtagctgaacacgtaagtagttccaaccaagaagagccaaaagctcaaggtaaagttgaagaaatgcctatgcaaaggggaggcagccttcaggaagaaaataaagtgactcagaaatttcctagtctcagccagctttgtagggacacgtttttcaggcaggaaactgtcagcccattactaagccggacagaattctgtacagctcctcttcaccaagacctgagtaataccttgcccttgaattctccaaggtggccaagaaggtgtcttcatgtacctgttgctctaggcatctcttcacttgactgtgtgctggatctcacaatgttgaaaattcataacagtcccttggtaactggagtagagcatcaggaccagagtacggagaccagaagccacagccccgaaggaaatgttagagggcgttcctctgaggcacacactgcctggtgtgggtctgtgcgatccatggccatgggatctcatagtcaatctggtgtaccagagagcattcctctggggacagaggacaggatctcagcaagcaccagcccccaagaccatggaaaggacctcagaatcaccttgctgggtttcagtaccagtgaagattttgcttctgaagccgaggtggctgtacaaaaagaaataagagtcagttcactgaacaaggtctctagccagcctgaaaagagggtcagcttctccttggaagaggatagtgaccaagccagcaagccaaggcagaaggcagagaaggagactgaggacgtcggactga

SEQ ID NO: 79001 - DNA, 1037 bp, Homo sapiens
agcagatccccctgcaagttggggcccagaacctctcactcagcgtggaactcacagaagcgaaactgcaccatggctttggggaggccgatgccctgctccaggtgctgcagagtgggacaggggaggcgcttgctgctgatgaacctgtgacatccacctggaaggagctctatgcacggtaaggacccccagcctggagtcgggaggggaaggggtgggctgtgaggaaagagaacccaagaaagctaatagcttgctgtttcctctgccctggttcatctctgggatcttccaggggtcagagatagatcttaaagtgaaggacattcagggccagcttcagcgaatcgtgttttgcctcaggcaaaaaaaggccattgagaccctcaggagagagcgggctgagcgacttgggaacttctgccggacgcgaagccttagccctcagaaacaactgagcctcctgcccaacaaagatctcttcatctgggatcttgacttgcccagcagacgccgagaatacctgcagcaactgaggaaggatgttgtggagaccaccaggtagtgtggaccgagaaccctgctgggagcaggctctgttgggggaggggagtatggggagcaggagctgaagttttagcatcctggagggttctctataggagacagggtaaatggaaagaggacatagaagggaatggaatgagggagggggtgggcagagagaaggcacaggaaatgatggacagaagggctctgacatgctatgcaagtctgcaggcctgggtctcaaggtggcttggttctctctgtccagcaacctctcctgaggctaaaaaatcatactttaaaaccctgtgggcaaatggaggttgggtcttttaagaaggtggtatcacccaagctagccttggatggacagaccaggactgtcacccacccaccatgttctttccaccccgtgatcttcctcaggagcccagagtcagtgtcaaggtcagctcacacaccctctgacatagagttgatgctgc

SEQ ID NO: 79002 - DNA, 1048 bp, Homo sapiens
cccgagaccaactgcgggagcggactgaacaagagaagctgagaatccaccagaagatcatttcccagctattgaaggtgtggagtggggcatgcctctgatttcaggataggcctggacctcagactggtacaccttcaccgtggccgcctctgagtcttgggacatacgtaacatttggaggaggctgtgggacccctgttgtcaactcaaagctgggctcactgtctttttacatcatcacaccagctcctttccccaggccacggcctgggaggaagaggctttggtgtgaggtgcagggtgtggggaaatacgagcagtggtggctttaaggaagccagggcatgtgaggctaagtcagggaggccctgggaggtgggtgaaggagcagtagaggtgagcagggaaggggtggctttgggtaggaaaaggcgtggcctggggaaagtgagggtgcatcagaagctggttaatggtgatttgtccttcccaggaagaggataaactacataccttggccaattccagctccctgtgcaccagctctaatggaagcctctcgtctggcatgacctctggctataatagcagcccagccttgtcaggccagctccagttcccagagaatatggtgagtaggcagatgttgggaatgagccaggggcctggactgccaaggcaagagtttgagcaggacgctgtgcctcctggagtttgggcaagacgccgtgcctcctggaggccactgctgacatgagcccttcttatgtgcaggcctttggttttccatttagttctgccccctgctccttctgttcattcattcaacaaatgtttattctgtgggtattattttaggatacagcggtgagcaaaactgttcttgtccttagactgtttgagggataaatattaaacaactgattttattgtttagttattgttgcagtaaattgtttgaaggcgggttgctaaaccagcataaaaccaggggtctgacttagtctagaaggtcatagagatactccgaacagaatgtgtttaa

SEQ ID NO: 79003 - DNA, 1080 bp, Homo sapiens
tgagaatttcttaaaccatttttgaggccaggtacagtggctcatgtttcaaactcctggactcaagggattctcccgcccagcctcccaggcaactgtactacaggcacagttatcttttgaattatattttcttgtaatacttttatactcctccatctcccagtatatctttgatccataaagcataaaggatccattttggtatgtctgtgaaatgggtctctgatgcaatctttttttttttcagatggctgcccatttgtctcagcagtacttattgattaatttatggatatttatttttggaagtcagtatccaataatttttggatatttatttttgtacagcactgggaacagattaggttacttaggaatatattatggagtgagaaaatagggcctaggcctgaattttgaaagaatcccaaaatgtcaacagttgaagaggatgtatcaacaaaaaaaaaaaaaccactcagagagatgagaagccggggcctctggaagtgattctgtcagtgaaagggagagactggctaagtcaaagcttgctgagagactcaggaaatgtaggacagaagttatttacatgatccagccacacggacaccgtggaccttggtgactgctgtttggaggagtgacgagggcaaatgttagattagggtgggttcagaagtcagtgagaagtgggagatggcaaacagcgagactggttgcaagaagcttatctgtgaagggcaggagagtgaagaggagggttttaaagatgagagaagccgggcacaggggctcacgcctgtaatcccaaaactttgggaggccgcagaggggaggatcacttgagcccaggagtctaagaccaacatgggcaacagggtgagatcctgtctttacaaattttttttttttttttgagatggagtctctctctgttgtgcccaggccggagtgcagtggcacaatctcggctcactgcaacctctgcgtcctgggctcaagcgattctctcaagtagctgggattacaggcgcccgccaccacgcccggctaattttttgtattgttagtaga

SEQ ID NO: 79004 - DNA, 1198 bp, Homo sapiens
aaagcagagagagaagaatttaaggtgcaaatagatttgagagaatgccaggcgtactccagtcccatggagtcccctcagcctgtggtgatgggagaagcacctcagattgtggtttggtgtttacaggcccctgggctctgccatccagatctaagtattggcgttcacctcctagtgacaaagtacaagtcaagggactgggacgggagaggtgaacccaacaggtcatcattccgctctgctgaggctgctgcttttgcctcacaatgactcatctatctcctaaggacactgggatcacccacaggatgcaggtcactaggttttcggtaacagcagcttcagaaaagattgataaactcctgtcgcattcccttctctccaattccccactgactccccttactgcaaaagcccaggaagccctcaagtctccaggtctcaggccaaagggcctgggcactggagggtgttcaaaagcgagacagaaaaatcccagggggctgtgggaccaagtcagcctgtgctgtgaggccagctgcaaaggatttatcacctgggccaagtagatgactctggtgacttccttcccttccacagtgatgggctgcaagatccaggcactgggcaggatctccccgcgaaccatttttctgctgggtcttggcatggatgtatcatacacagactgggctgccatgacagacaggtgaccctggggacagagggaaatgggagtcctgcctgtgtagtgtggacaaaacaggaacaggctcccgtgtagacagtatggtgaaaggcaacactgggccagccttcaagccacccctaccctggctccagccccaatttgccctccttcccctagaggacctgaggcccacatagattgtttctcacgacacttcagcccaagttcttcccacaacatctttaccaccaaggcaggcacctctttggcttccacgcagacacaacagaaatcccgtggctgcttcagtgcgcacagggtggtgttgcacaccaagtacactggagggacagggataaggaaggtcaggaggcccatggacagacctagtcctaaagccttcctggtcagggagccctccccccaacaccccatcacttgacacctagctcaacctaggctgagcaatcaaggtaacctgagtacctggcctccaaagagggc

SEQ ID NO: 79005 - DNA, 1036 bp, Homo sapiens
cctccatcagagttcgctccctgccataacttcagcctcccagagtactaacaaacagacaaggtttcatgtccatttcagtgtggagggcagttgagaaaaaataatatagccagccaggttgtggtctttagtgacaaaggatgagccattgagaattattacatgctgccttttccctcatctttctatgtattccaggactttgctgaagaattagcaacactgtctaatctgtttctagccgagccccacctgccagaaccccagctaagagcctgtgagttggtgcagccaaaccggggcactgtgctggcccagagctagggctgagaagtggccctgccttgggcattgcaccagaaccctggacccccgcctcacgaggaggcccaagtgcccaatgcagaccctcactggttggggtgtagctgggtctacagtcagacttcctgctctaagggtgtcactgcctggcatcccaccacgcgaatcctagaggaaggagagttggcctgatttgggattatggcagaaaagtccagagatgccagtcctggagtagaagaggtggtgtttgtttatctcttggatactaaatgaaatgaggtgtgtgggcttgtcaacacagaattcaagcctcatttgctatcccagcatctcttaaaactttgtagtcttggaattcatgacagaggcaaatgactcctgcttaacttatgaagaaagttaaaacatgaatcttgggagtctacattttcttatcaccaggagctggactgccatctccttataaatgcctaacacaggccgggtctggtggctcatgcctgtaatcccagcactttgagaggcctgaggtcggcggactgcctgaggtcaggaattcaagaccagcctggccaacatggcaaaaccccatctctactaaaaataaaaaaattattagctgggcatggtggtgtgtgcctgtaatcccagctactcaggaggatgaggcaggagacctgcttgaacctggaggtggaggttgcag

SEQ ID NO: 79006 - DNA, 1029 bp, Homo sapiens
gactctgtagttctgtttcgcaggttctgagcagtgcagagaacattgctgtggggcttgcaacagagaaagcctgtgcttggctgtcagccaacatcacaggtaaggtcctggatgggggagtggctgaatcaagtgtttaaaaagtggactggcagagagtcagaggcatcttgtgggcgatgggactgagagccagtaggaaacagcaaaaggcatgggttagcatggtgaacctgtgcagggccctcccgtgattcctttcccattctccctctgccccacagcactgatcaggagggaggtgaaagcagcagtgagtcgcacacttcgagcccagggtcctgaacctgctgcccggggggagcggaggggctgctcccgcgcctgtgagcaccatgctcccctcccctcccacctcatctccgagataaaagtacacggctaccctactccctttggcttccctgctcccacccccctgctctgttcctggtttttcctttctcacatcagctccaggatttttatgtagaagctgtctgtgctgtccagctagtccccgtttcactcattactgaatgggggttaggtagggcagagctgaattgaatggttttcctaattgtcactctgactttttaatcatccaaaaggggaaaagggcagctaggacatttttgactaaatgcttattatgcagatggtgatgagagtgcggtggtgaatggcttgatagcaaatgagtctctaggaggcagtcgccccagtatttggagacaatttcagaaatgttctatgtgggaggtgatgcttgtttagttacaggcagtaagaataaaccatcagttctcctaactttattttaaaactcaaagactctctagagcaggagtcaagaaacagcccatggactgaagcgagccagccccttgttttgtgagtgaagttttagtggaatgcagccatattaatttgtgtacgagctgcctatggctgcttttgtgcaactactgaacagcagagttg

SEQ ID NO: 79007 - DNA, 1062 bp, Homo sapiens
accatgctaacccatgccttttgctgtttcctactggctctcagtcccatcgcccacaagatgcctctgactctctgccagtccactttttaaacacttgattcagccactcccccatccaggaccttacctgtgatgttggctgacagccaagcacaggctttctctgttgcaagccccacagcaatgttctctgcactgctcagaacctgcgaaacagaactacagagtcaggggctaggggagggctgggtgcaacaaaggatgccagagtcgagcactgaccccgcccccacacaccctcccgcagcctcagactactccgtgcacctccccacaactgcctggcctgctagctgcaggcctccctcacacgtacggctgccggggtctcctctggaagcagcgcccgcacagccccagggctcttcctttgacagaacctaaaaggggacagatggggtcagtgatctctgggtatttcagcctggctgcagaagtaaatgccccgagtgcaccaagcccctgacctgggaggctgtaccttggaaggaggcaccgtttgccctcccgccccaccccaggtgccagagaaaagacaagcccaactgccagccccacagcatcacacacgctcccaaacctaggtttggcttttgtgccacagaaggcctacagccagtgcagggcttatagagaatgggcgcagggagaagaaaaaaggaggcatgaagagaagaaagggaaaaaagagtaagtgtgaaggaggaaagaaaggacagagaaagccaagaggagagtggatcaaatggaccagcgctgcttactcccgccccagggccaatgcctgggccccgtgagggcacagctgggaacacaagatctccaacagctgggctgggtctcccccttcctctccctgtgtcaccagctgctcttggagaagtgactctgcctggcgcaccagatctgccaccagtgtagccctgcagcagggacagcaaggttggggatggttggagggttaatcggaaagaggctgaaaatttatgggaatttggt

SEQ ID NO: 79008 - DNA, 1047 bp, Homo sapiens
tctacacctgctgcccctacatcggtgagcaccggtcttccctggacggtccttggtctgtccctccatgagtacccaaaaggcacccccttggcccagctcccttggatattgctccgttcatagtcattcctgggtatctgagcctcttgactccacaagtaaagtccatgatacttagggaggggagagggttctggaactgagaacttggacttcactgatacaggagagctccggaaactgctcgcttcgtgggtgtcaggcagtagtggacggagtgggggcttcatgaggaaaatcacccccaccactaccaccagcctgggagcccagccttcccagaccagccaggggctgcaggtaagggcagggcggagacagccgtggggaaaatgagggggggttgggggcggggacagggaggctggaggaagccttgctgcctctccctcctccccccaggcacagctcgcccaggcctttttccacaaccagccgccctccttgcgccggaccgtagagttcgtggcagaaagaattggatcaaactgtgtcaaacatatcaagtaagagtgggttaaggatcctggtctcatcgccctaccattttttcccctttttcctcagttgctaaactgagaaggtcagccagagggtgggtgtggggctgaaatggctgacacattttgaagcaaatttctgaccaaattcccataaattttcagcctctttccgattaaccctccaaccatccccaaccttgctgtccctgctgcagggctacactggtggcagatctggtgcgccaggcagagtcacttctccaagagcagctggtgacacagggagaggaagggggagacccagcccagctgttggagatcttgtgttcccagctgtgccctcacggggcccaggcattggccctggggcgggagtaagcagcgctggtccatttgatccactctcctcttggctttctctgtcctttctttcctccttcacacttactcttttttccctttcttctcttcatgcctcctt

SEQ ID NO: 79009 - DNA, 1050 bp, Homo sapiens
agataggctccttccagctccaacttgctggcttcattgcacttctcattctgtcacccacgtgggtgatttcattgctcctgggcctccctgtctgtcctgctgctcccttccctctggagtgccccttctcgattctggcttttcctgtacctcttccagtgcttatgccccacccaccccttcttctcagcttccagtttaaccagcatctcatggacagtctgagcttgaagatccaggagctcaatggtcttgccctgccccagcatgagcccaatgatgaagacggggagtcagacgtagactggcaggtccgaaaacagaacaagggaaataatggggtctgacccaggagggaagggagtatgttcaagaaaaactttataacagatcgggaattgttctggaagcctcatgcttggaccttttacttcccttgattccatgcagggtgagcggaagcaatttgctgtggtgcttcttagcctgagacttttggctaaattcctgggctttgtggctttcctgccataccgggggcctgaacctcccccgaccggtgagcttcaggactccattctggccctcaggagccaggtgaatgggcgggggattctggtgaggagggagcagggaggaccggccaggcactgaagctgactggtttccttggctattctggaaaccaggcaggttaaagggcatctcccagcccttcctagggacctgccccctgactgagctctggccctcccaggtccctccggtcctggatgtgcggactctgctgcagcgagggctgcaggcccgccgggcggtgctcaccgtgccctggctggtggagtttctctcctttgctgaccatgttgttcccttgctggaatattaccgggacatcttcactctcctgctgcgcctgcaccggtgagtggaacaaggctgaggcttgatgaaaggattcgggactcgggacattggtcaagcctgctattaataaagagggtcgagcagtctgcactgtgcgtgtggggccctggccataactga

SEQ ID NO: 79010 - DNA, 1032 bp, Homo sapiens
ttctcctacctataatctttctttaattttgtgttaaggctatgaatgtagtccctgaaagaattgagatcgggccaggtgtggtggctcacgcctgcattcccaccactttgagaggccgaggcaggacagtgacttaggcccaggagttttagaccagcctgggcaacatgacaaaatcccatctccaccaaaaaaaaaaaaaaaaaaaggccgggtgtgggggagtgcgcctataatcccagctacttaggaggctgaggtggaaggatctcctgagcctgggaggtccaggctgtagtgagatcacgccactgcagcctgggtgacgcccagcccagcctgggtgacagagacccccatctcaaaaaaaaagaaaaagaaatggacccctgtggtcttggcagctgagctttggtttctgggtaatgttcctgtcctgctgtcttggtccttgctctgtaaagtctcatatcctccccttgactttcattatctttgatccttggcccatgaccttgcagtacatatctgggcttgcatacctgcgccatgccttagagatcctctgtggtgtgcaggtgcttgcttcctacttgcagtctgtgttctggtctcagtcataggtgctcttgtccctgcagggttctttccaacctggacaaagggaccttgaagctgctggctgagaatgagcggctgctgtgcttctcaccagctctgcaaggccgccttcgagctgcctatgagggcagtgttgccaaggtagtaaccccagcttagttgcccactagcctggacctaacccttcctagctttcataaattcaggcaaccctgctgacgacacttcagtgtaatgtgagctaactctgggcaagaataagagggagaagttttctcagcatgaccctgcagttcctaacgttcctgctgtattttaggtctctctggtgatgcctccctctactcaagctgtctcctttcagccagagactgacaatcgtgccaacttctccagtgaccgagcctt

SEQ ID NO: 79011 - DNA, 1003 bp, Homo sapiens
cagggaggccgggaggcccgccgcggggtagccgcggggcgcgcagccagcttttccctccgaccgaggcccagagcaccgctgccgaggcccctctggcccgccgcgggggcaggaggcggggcccggggccggcccgcgagcgtggaggccgcggcctggaggagggggtcagcggggagagcctgcccggagccgggggccggaggcttaggggctctggcagccccagccgccccagcctcacgctgtctgatccgccaaacctcagcaacctggaggagttccctcccgtaggctcggttccccccggccctacagggtgagactcagctctcatgcaggagatgggtaccacgaaggctctggggagtcagtcattcgagctcggcgctccgcagtggagcgccaggatgggtagaaggctgggggtgatggtgagggtttttgtggggttttttggcaagaggtctagctgttgcggtggtggaggggagatgtttgaagataggaatttgagaaaaacctgtggctactctcagcaggacgaagccttctcgcaggatcaacccaactccggtgagcgaagagcggtcactctccaagcccaagacctgcttcacctcacccccaatcagctgtgtccccagttcccaaccctcagccctggacactagcccttggggccttggccttcccccagggtgcagaagtctgcaagaggagcgagagatgctcaggaaggagcggtatggcctggccgctcctggggatatcggtttcctcgctgtgggggatcttcaggggttttccctgaaattgatttccctcttggggactctgggtttgtctcctgggctgttggtatcttctctggagtgacctgagtgtggccgtagcagggaagccaagctgactgctcatgaaatttctttattccatagctctaagcagctgcagcagtcacctacccccacctgtcccaccccagaattggggtcgc

SEQ ID NO: 79012 - DNA, 1053 bp, Homo sapiens
tcctgaggaatcaatgcccagcatttcaccacatctgaactctgtgtgggcattcttcactcgcctacaaggggtaaacaaggctaccagaacttgaatttgacttatagggagctacccaggaaggggaaagcccttgggactttttccaaaacaatcttctatttgaactgttcatcagccaaagtagtccactgaggtgacaaagctttcagaaatacaaagatgggaagataaaggtaacactggcccacttggggctttgacattggattgggtggactgaataaacacagcctaggtggcctgggcttgagcctcacttacttctccttgatacatagttcctggtctaccttctgaccctttttctaaaatagccagtgtctatttcactaggccatttacttacaagttcccagcttttagggaaaaaagagggaggggggagcatctagttttgaattagatatacatcttagaagtaatgagctattggcagctgttaaatcagattcagccacaaaccagaattctttcttgttgaacaagaccaatgagttagatgactttaataattccacttttctctccctctcttctcctcttcctgaaatcagagagatgagaaactactctttgaaatacctccagaggcgttttattgtgttcctttcccctccaagcagctccctttatacaattttgctcaggcaaccaaggacagagtatcggcagaaacatggagtgcttttgtataggccacctgtacataaaagtgtaattatttatttaattttcccatttgtatcatattaaagctttgtacagtgttttaagttctgttttaaaattattttgtattttatttttataacctagtaataaaatattcattccgcatgcaaaatctagttctgtttgtgtgatggtctggatttcaaaagtggaaaatatttttctaatttaataaagttattgaatacaccagatgttacaagatcaacggggagcagatagtgttactgtaaatgcagtaccacatctagaagt

SEQ ID NO: 79013 - DNA, 1499 bp, Homo sapiens
ttccttccatttttatctcaacttttctagtgtgttgtccccttttctaaatggcattgacaaactcatcaagatccagagataaacagtccatcgtttaagaatattttattttgcatgtagaggaaagaattaaccaaagacgtttctgctctgatactttctaaagaaaacagactaattatatataagtggtatcaataggtctgcttataagtattgtcctatgtagagatttactttttggtttttacaagcatagtttgcgcttttagatgtctctcaggtgaaaaatagaagttggcagccctgagcaagcacctgtgacacagggatttttattttagttttaaagtatgatacagagaatgaggtttttggtttgatttggtttggttgtgttttttagttctttattttttatttgggggttctcttagtgatggcatatttcaggtttcagtgacatagatcaagtaattttaaaccaatttggttattctatctaagatgagggacatggctattaaggtcaagccaaactatactaaaagtagtatagggcagcagttaaaattatcttttgaaaatcaagtattacctggtttcttctgtcacaacagaatagctggttacctagtcagtcacagttgcccttgccttcccttgttagtccctggaggtacttgagtggaacagaaggtagaattagcaacagctcaatcactttaggtagcatttctcctgaattctgctgccaaatcctcagggtctatggattggttgaaatagtaaaatcacacatagtgatttcttgcacagcgtagaggcgtttaattttagtgtatagtgaacaaagaaggaaaactgggtcatataaaatttaaccttaaaacacagattataaatatctttgaatgttaagccctaggcagacagacactctcattcttaactctggtatgcaagctggccttgctgacagtggcatagttacattaactgttttttaagttgcatgttgtgatgtgaatgttttttgtaaaagttgccaagttaatcgagtcctaaataagtagccaaatggtaactgagacccactgtagacattactcgctttatattatttgctttcaaatactaaaacctcagctgctaattcagcgctctaggtgtacagtgtctccttcccttggctcctagcaatgtagggaacttgaggttcttcagtatcttcagagattccttccaggccacatatttttatgctaatacttctatagttgcattcaatctacaaggagaaagtgtacattggtgcatgttttataaacccagacacagatagctaaaaccataattagtttttctatacccagagctttgaattaaaaacagatgctttttttttccccaagagcagacagttctacattcctaacattaggaattggtgatacgagaagcaggatccagaattcagaatgatttagtgagac

SEQ ID NO: 79014 - DNA, 1046 bp, Homo sapiens
gttaagtgtcctcctttagaaacttgagtagaaggaaaactgaccagagtagactgcttccttaagtcttctgggttccaactgtttgtaatatcagcatccaagatgatacgagggaagcacaatgctttggactgtgatttgagatttagaaataaattagatatattattgaggcttagaatcctcaaactttgtattttatacatttagccaataaggaattaatatctggggaaataaatttaggcaaatatttcttttttaatgttttattacctgcttctcctgtgttttagttcaacatttgggcttcttggcctgattttcatacaatctcaatttacgaagctgtaaagaggaagatatttgttctaatctcactcttctaataggaatcaggcaaatgaaagtctaccagacttttaaaatgggctgtttttatactctctaggtgttttgtgttgtaaagaccttattaaggtcaggtaaattggtctgcttgctgttgaaatttgccttctagcaaacatatgtgctttctgtttgaccttgtgtttgctgccaaacctaatacagttgaattgggaaacaaaaaaaaaagaaaggaatacatttcctccccaagtgaacatcttctaatgctgcatcaaagctgccctgaagctgcactgaacttctcttgttctctttatctgtgttgagctttttaaaaaaacaaactcaaaacactattgaggcatataacgtctcttataagaaatgtagcatagtgtggaatcttaatttctctccagtttcaaacactccagaggaatgcaatagataagacatacttgctgtttatctaaagcaactgtaatattggaagatcagtccttctgtattatattgtataatagttgctataacactacttgcatgtcttcatggtaaattatataaatatttataaatatatagagagacatatccttatatagagtcattctttgtcattctccatttgtaatttcgagatcacagatggcgaaattccttttcta

SEQ ID NO: 79015 - DNA, 1037 bp, Homo sapiens
gagtagtaactccgactcagaccttttctcccgcctggcccaaattcttcaaaatggatctcagaaaccccggagcactactcagtgcaagagtccaggatctcctcacaatccaaaaacaccacccaagagtccagttgtccctcgcaggagtcccagtgcctctcctcgaagctcatccttgcctcgcacgtctagttcctcaccatctagggctggacggccccaccatgaccagaggagttcgtccccacatctggggagaagcaagtcacctcccagccactcaggatcttcctcctccaggaggtcctgccaacaggagcattgcaaacccagcaagaatggcctgaaaggatccggcagcctccaccaccactcagccagcactaaaaccccccaagggaagagtaagccagccagtaaactcagcagataggagccaggctgcatctctttgaaaggtgtgagatcttcctcctaaacctgatgcatgtgtgtccctgtactttctatgtaaaaaaatcagtgttgatcttctcttgcaaaagaaagtaacatgatcaattatttataagaagacataatacatgataaggaattacctaaggcaggcagcaagtagattaggaatcaatgtctttgtacaagaaggaaaaatagagcaaaaatccaagggggagaaactcattaaaatgagctctcattttttaagctgcctttgaaacaaaagagttgaggataggagatagaatggaattttaggggggttgcctaatttttttaagcctcaattcaaagattatatagcaaaagtgaaacttcttgtttgatattttcattcaaaactttcccaccctgaagagtcattgatcagatattagattatataagaagtctgttgccagggagccagtattcatgtatatttggcttgtgtgtttatttcgtgtattgagaatgaacacctttactttgcctcattcctagtaccctccctggagttcagatttttttttaaaattttgtatgtctcg

SEQ ID NO: 79016 - DNA, 1099 bp, Homo sapiens
gctctttttctctttacttcccaggagcaagtaggctctattaaggagagatatgaccacaggctcatgttgaaacatctccctccagaattcagcatctttctagaccatatctcttctttggattattttacaaaaccagactaccaggtaaccatctttgtgagttctgtgggttagttattttctctcttagtctatgctttcactcattgtagctttgaaggtgttataaatgagtaggggaggtccttagaatacgactgttttaatacatcctgagaaacatggtgaaattaacttatgatgagagtgtcagcgtgtgtgttatgtgtttcatccctctggatggacttaacttcattcgagttttaggtttattcatcttgcaacagattttcctattcctgcatgattcattcggcgtatagaactgctgacagttgaaattatgtaaattctatagctaatttgttgaccagaaggaaatgtccaactaggtaatgcatctgtcaagggctttagggcagcatatcatatgttaatatgctatgggacagcggtcagtgaaaattggctccattttgcctgtggtcagagaatcatttccttagagcatcagttaatgagccttagaagggttgactaggtttactacaaattacatccctaaccccaaccagcggtatttcagaagattctgttgctctcagggagaatttggtcagggcttaatacctaataattgctaccactgaaaacataaatgcggccacacatagattaataagaatatgtattagtatatcatccttatttacaaaggacaatacatagactttactgcatgttaatggtagttaaattctacagtgttgtcagtgttgtgcagtcaaaagactaagaagtatctatagcacagtaaatgtatttgcatatagtaattattgctctgtgaaattgctgcttttgtataagatacaaacaggatataaagcaaagaggcaacatacagccttgagtccttagagaccttaaattggtgagtttgtcttctcatgcatatgccaatttgtgttgtaagcaatagggactgtct

SEQ ID NO: 79017 - DNA, 1027 bp, Homo sapiens
agcctgaccagcatagtgaaaccccatctctactaaaaatacaaaaattagctgagcatggtggcatgtacctgtagtcccagctactcaggaggctgaggcaaaagaatcactcgaacctgggaggcgaaggttgtggtaagctgagatcgcaccactgcactccagcctgggcaacagagcaagactctgtctcaaaaaaaatatacacatatatatatatatatatatatatatatatatatttatttatttatttttatatatatatatttttatatagagagagggagaatttggaagagattgaacatctcttccaaatttgagacagagcaagactccgtctcaaatatatatatatatatatattttttttttaaatatatatatatatatttttaaatatatatatatttttaaatatatatatatatttttaaatatatatatatttaaatatatatatatagagagagagaatttggaagagattgaacatctgtgtactatttcaagaaattatttgggaatataatactatcaatacctaatgaaatgtgggagtcatcattttatctgtaatatgtatctaatctgatatccctctccccaccaaaccttttgttttcatgaagatttcaagtgcagacaattttaaaatgtttgttttagtaaattatccctttcctcttgggttaaattttaaaaatatctcccctcacccccttactttggtccctttgttctgcgctgactttttccccttcatcccgaactttatgagtaggaaaactgggcatttttatggattatcagtcctttaacttttttgcatggagttgggaaactgagcaagtgattccttgataaaatagggaaaaaagtatttcttgttgattcttttctttaccttgttcctgttctgataagccaaaatgagaacttgaccaatatatgataggaagagtatactgtggtcttaaatgctatgctgcagttaatttggcttcttatggcgtgatta

SEQ ID NO: 79018 - DNA, 1115 bp, Homo sapiens
tgaaagcattcattctgtgggattcttgcatcgagacatcaaaccggtagggaccttttctatccagagcacagaatgagtttgatacttttaatgttatgatgggacacaataaattacaaatgtagctttgtgtatttgctgtggtaaaatacaaggtaatattttcattccaatagagacctggaagcaaaaatataacttacctgttaatttttttaagtgataattacaactacaacttattttcaggagtttttctcatacagtgaaaataaaaactgagactggggcagtggcacatgcccatagtcccagctactcaggaggctgaagcaggaggattccttgagtacaggagagggagagtacagtgagctatgatcgctcctgtggatagccactgcactccagcctgggcagcatagtgagaccctgtctcttaaaaagctttatgtttgactattattatgtgtgctaacattgccagttacttaaccttatgcctaaattggcattattccctggtttcttttatagatatattggttaagaaactatatatgttgcttttagttgttcatactgtgttcttgaactatttgttaagtcaaaaattataagaaatcatcagttgtgaaagaccttatttttctcctgactgctactgtggaaatatagtggggtttttatttgctaatctgtttgtcttagaaattgtcatttccataagtgtgaaataggcttttttgtcctttttggtgtttgattgttcattaggtgaaatgaccgatttctgatataccatatttactataaatgtatcatatgttggtacagttgaaaagtataaccgtcagttgttacatgacttctaaaattagcttacatgaaaatgctaactaaatttaacgtagtagagtcagtctatttctatgcatcattatttgagaactatggtacttggaagagtttctatttttatcagaaagcccctaagtagaacaatattaaaacaaaacaaaaaaaactaacaattctggtaacaatttggcttttaccgtcacaagtcctcttacttacatactcatctttgcatttgtggtcatttaata

SEQ ID NO: 79019 - DNA, 1045 bp, Homo sapiens
aaatactgtattgttggtgacatttctgatgctggctgttgaccaaattttaaaattgtttgtgagtgaaataatttcattactttgttgtggataaacctgtggggaaaggttttgatgttattttcaggcatatgttttcttcttggcatatacatagttaatttaacaatatttaaatattttatcaaaaaacagattataaaattatacattttctaaatataagagatcaattgctttcaagttagaatcttctagtaatttagagtgtgtgtgttcttattttctgtgcagttgagaaagattgggggtgggggctttggagaaatttacgatgccttggacatgctcaccagggaaaatgttgcactgaaggtggaatcagctcaacaaccaaaacaagttctgaaaatggaagttgctgttttgaaaaagctgcaaggtaagccctttgtagaatatacaatttatgatttgtatgttaatttataatttatttgtatcttcctgaaccttaattacattctttaagtactaattgaatgtactggtgtcagccgggtataaatacgctgagcatttttctcttggaaattttataatgagttagtagtagtagaagtatgtaattacttagaataattgggctttgggagttctttttcatggagtaaggataagagagtgtgaattagcagaatttttactgcttcggaaagtattgtcataagtctgctatttgcctttcttttttaaactaccaataacagatacctctgagttgtctctactcaagtctttggatgttaaatatgttttaatcacagtaaggaagctgccttcaaatcacactgcaggatggattaaaaataatactgttgattatatgttgattcatattagcttcagtttcagagaataactgtttctggccctgtcgtcatttttgaagtccgttttactacttgggccctatttgtttttattacaagaatgaataattttttttctgacatgaatccagtggtataaaaccctgaat

SEQ ID NO: 79020 - DNA, 1045 bp, Homo sapiens
gccctcctccagaaacccctgcgtccgccacggcccaggtaggacacaccccccgaccccccagggcgccgccctcccccagtctcgaccccctcctccggccgcacccctcgccgagtgaccgagcctgctgaggaggggaggggtaccggggactttcagttcgctgcaagcccggggctcgtgccagaccccgtcactctccatctcggagatcgttctggttctgcccgatttccccgaaggctgccgcctcgttttgccccaggctttgggtgtcttcactgaacttggagggtcacgaagcttcgttctgcgtctctctctgtgggtgacccacatatcacttgtacccatgccacttctggtaccagcaccgaacacgaaggattcctaggaaatctgagcgcttatttcccaccccgcctccccaactatcatggaaaggaacatgggactactgaatctgtttgctgtgttgtaacgacagtgaaggccgcgactttcttgtacttagggtgctgaagtaatgatctgagggatttgctcgtcatttgctgtggcagagatgatgttgacaccctgggatgctgtgggagggacaaaagactcacgtatatgttctgtcaaatcggagaagtaaataatccattgggatgccaggatactttattctacagcgaagttaattttgtatccgtcgaggctacagtagaggtaaaaatgacattgagttgtactttgctttgaattaaagttgatgggtagcagcaatcctggtattaactcttctctctcatcgctttagaaattattctttctttgaacattaaagaggacagttttattatacacttctaataatgtgaagatgttttgtaattcagtagaaattgagtttctgtgtgtgtaggagggtcatgttatgaatgggcacatgtagacacacacgcagagggaggatccactcagtgtgttttgttaacaatgtttggttctgagccattgataatagttgcattggtatctaaaccctgatttgcca

SEQ ID NO: 79021 - DNA, 1041 bp, Homo sapiens
gttgagccatcttgtttataaataatagagctctcctgaatttgtgcatagacttcttggttcctggcttttgttttttgtatcaagagattgtgatataaaacagcagaagataaatggaaaccttccattttaacttacgttgtttctggggtaatgttagaaccttgaaagatgcattcaaagactgtatcttattttgcccttggctattagtgtctcacatatgtgtgtaaatgttttcctaccttctttttgctcagcaaaggcaagcaagtaaaatatatttgctaagtgattagtgatgcacatttggggctagatttttttggtacttttatgtaaagaaaagtggattttgcagtaagggattggcatgagcaggcgtcagaatcacaatcatgattttctacttgaataattacaattcagaaggtatctggataaatagatacatgtctagtgaacaatttgtaacaataacaggtaaggatcaggaaattcagtattcagtttgtcagatttgccagaatgatgaaagtatttgaacatgtgtgtttgtttcttatataattgtattgagtggattgtttgactgggaaatctgggctagaataggaaacagaagatactgacttctaccctaatagatgggccccaatttagcaaagataaactgactttatttttagtcctttttatattaacttaataaattctggagttaggctctcaagaggacagagggactgtctggcaatggccagccagacctttactgccaaagaacccatttcatattgcgttccactgattgagattgattcagatttttgcactgtagatgagcgtatgtctcagtgctgccccaagccccagggatttctcattatgttcaaatgtcctagtgatttaccttaatcattgcaaacaattatgcttatgaagtttacttacaaacaagcaactgagtcactttattttctttagtgtagtatgtgaaggcactggttcaacaggatggctccagaactgtgtttt

SEQ ID NO: 79022 - DNA, 1159 bp, Homo sapiens
aggtaagaataatgtgcttattaaatgtatttttattctcttgcagattctgcagaaggagagtacagtgcactctgtagctatctatctttacctacaaatttgttcctgctcttccaggaatattgggatactgtaaggcccttgctccagaggtactatggggataaaatattgttgttgggttattatacaatttgaaattttaaaattacaattacttgctaagcttttagttcaatcagcactgattaaaggggtggcaaaagtataggagattcctaagttacacacttaagaagtggggataagatcaacagccataggcagttggaatttctgcttgctccactataactatcattcattttatttactttccccacagctggtgtctcatctgttttaaattgggggtggggggtggggattttgctagcaggcataaagtcacagttagtatcaaaagaacccaaattggaactgtatccaaaataggagcatatctcacatggtagcgcatgtatcaggagagtgactgagaaaagaaggaaggtcatttggtagatcaaaaaaaatacttcagttaaatttccaagagagaaatgtgtccttctttcagaaaaactttttaccctattggttactggccctcttgtgcactgtcaatgctgctaacctccagtcttcttaccctatctttgcctgcaccattttctatcatttttataatcagctctcactgtattgctttccttgcccatcatttcctttattctccttgctttctacctttttctttaattgtcttttttttaaatacccaggtcagtatttgtgtgaacgttggcttctgtctcctaccacccttcttgtgcagtgggttctctgtgttgggttcttttctttgcttcctcatttctctcgaaatattctgatctctagcgtgatcaaaatgaattgtttaagaaaatcagtatcatgctttgtgttgagtacaatcacagtaggttaactaattttacttttatattcttggagtagaaaagtcttaattgctgttctagttcagtcaagtattaaaaattcacactttgaaacagaaagtccttgccctctgtatctttccagaccctccttgtctgaaagtcttctctca

SEQ ID NO: 79023 - DNA, 1074 bp, Homo sapiens
cttcctgtggctttgtatgggtaaaaatcagaatatttatatgattttggaagagtcatcaaaattgctgagattcttccttttgtcctttgagaataagctgaccaggttaccgttactggctatcagcttctttatcttgaactcagttcagtagggtttatctgatctaggtttttcatggtcttgtataaaataggagtccactttccaagtaattgccagcacagatctgttgtttgctcacatacaaaaaagtcatgtatttatctcataggtgctacagtacagttgtgagtgaaataaagtcctttttattgggaggaatccaattataaacaaatagagaaatacatataatgtaatgtcaaatgctgataaatgttgcaaggcagaatgaagcagttcaggaatagagggtattggggccagagtggggaactctctgagatagttttcatagaatgcttctctgtgaggagacattgagcaaacagctacatagagggggttgagttgaacagacagttgaaggaagaatattcctaaatagaagaagttataaatgtcaaggcttcgtttgacgtagtcacagaattgcaaagagatgagtatggctgaagcctaagggggagggtaacaggagatgacaggagatgaggtctaagaggcaaccaggggcagctcacacaggacctttgggccacgatagggaccttgtattttatactaagtgtggttacacattagagccatccgatcaggagagtgactcgatacaatttatgttttaaaaaaatcactgtgacttatttgccacccatgggttttgtttgtttgtttgttttttgtttttttttgagacggagtttcgctcttgttgcccaggctggagtgcaatagcgcgatctcagctcactgcaacctccacctcccgggttcaagcaattctcctgcctcagcctccctagtagctgggattacaggcatgtgccaccacgcctggctaattttgtatttttagtagagatggggtttctccatgttggtcaggctggtcttgaactcccgacc

SEQ ID NO: 79024 - DNA, 1115 bp, Homo sapiens
atttgtgcccagataggtaaattttggcacagttcattatatattttacctttgctcaagactattctttcaataaaaagattcctattttatttttaataacactgtttctagtccttcttggtttttttttttagatagggtctcactgtgtgctggagtgcagtggtgtgatcttagctcatttcagcctcaaccttcttgggctcagatgatccttccacctcagcctcccaagtagctgggaccacaggcatgtgtcaccacaccccactaatttttgtattttttgtagagacagggtttcactatgtttcccaggctgttctctaactcctgggctcaagcgacccactcacctcagcctctcaaagtactggactacaggcctgagccactgcacccagcccttctttgttcttaataacagtctgtctcaagtccctgtccttacgtccattttaggaaggagagactggcaataaaaaaataaaacaaaatgttgagtagtgaggaatactatgagaaagctaaagcagtaggttaaagggctgaagacagactggggcatgaggctatttatagacagagttgtcagggagctcttctctgagatggtgacatttgaacagagacctgaataaagtgaggaataatcactgcttttctctgggagaaaaaaattctaagcacaggctatatcaagagcaaaggctcggttgggtgtggtggcccacgcctgtaatcccagcactttgggaggctgaggcgggcggatcacgaggtcaagagatcgagaccagcctggccaacatggtgaaaccttgtctctgctaaaaatacaaaaattagctgggcgtggtggcaggcacttgtaatcccagcaactcgggaggctgaggcaggagaatcgcttgaacccaggaggcagaggttggttgcagtgagccaagattgtgctactgcattccagcctggcgacagagtgagactccatctcaaaaaaaaaaaaaaaaaagcaaaggctccaagtttggaaccccatgatcatgtttgagtcacaacaagaaggcaacatggaatggagcaagcaaagaccagatcataaaagggat

SEQ ID NO: 79025 - DNA, 1025 bp, Homo sapiens
agtgattttccttatagtactatataaaggattcagtagtatattttcatttgcaaattactaaggttatgatgtctccctactgttttagatatgaccttagacaatgaagtgtctaaggtcaatgaagtgttctttagttgaacagacaacctttaggcatcagagactcttaaatctctaagaagctttagagatagggcatggtatcagttctagatagtataaaacaaacttctccagatttgtttgaatttcattattataaaacacagcttagctgttatcaggctttgtgttcacaatgtaggtttttagttttattattgcaatggaatttttcataagctaaatgagacataatttttttctgtatatttgacttctagattaatttttaggtttttattttgtctatattttatacttcaagaacactgcagttcatcttgtattttccatctatttaggaaaccaggtgtatcaggccatggagtttatgaactaaaagatgaatcactgaaagacttcaatatgtacttttatcattactccaaaacccagcatagcaaggtagaaaaaagtatccttttcagtaaataaacctaaatgctttatgctttctaactccacagaaaattttctgctttttctatagtttcacgctggttcttattaatagaggtcattatgtcacccaagaattaaaattgaatcaataatcttatctagtatacaggcaatattcagattttcctgattatactacatatgtctttaatagctgttttgggaagaggattcaatcaagcatcatggacttcatcatcacacactcatttgattgtcatgtttctttagtttttgttttgttttgttttttgtttttgtttttgttttgtgaaatggagcctcactctgttgtccaggctggaacgtagttgcacgatatcagctcactgcaacctccacctcccaggttcaagtgattctcctgccccagcatcctgagtagctgggactat

SEQ ID NO: 79026 - DNA, 1109 bp, Homo sapiens
cttgcatgtgcagcaagcacaacacatatttttttggctccctcacccttatggaaagcatgtacagttgttgggtgatgaggttaaggtgcttgttttcatcttgacatctcctaaatactcttaattcatctacatttagtatcttcacttgttagcttctaatacttctttagagtctgactttatgcccttatcaattgacaagaactgcatttaggaaaaaatctcaaaggatccatttagtaaccaagcttagaaataatttgcccagggtcacacagctagaaataccagacagagctgggctttgcggttaatgttctaaccctgagcacatacctgagagctgggaattgaacccatgcattctgacccagtgtaacaaccatgttaaaatgttatgaatcctgacagttttatattttgccaagagcagagcaaagagagagggctcagataggtgtatgttgaccaacttgtaattgcagggaatggaagaaatccgaagacaggttgggcaacacattgaagtggatcctgattgggaggctgccattgctatacagatgcaattgaagaatattttactcatgttccaagagtggtgtgcttgtgatgtaagtaaaatttgttagtaggatcagtgcctttttaagttcttagtaattattaatagtatagttttatgttgcagcttccttgatgtaaagtttttattatttatagtagctttttacatatttgaatttctctttttaaatttagggggaaactgtatatacttgagtagaaaatgtgccctgtggtagttttgcttattttggggaatagcagggtttatacatgtgtatgtatgtatttatacacacgtttattccctggaaaatgcatattaataataatataatgaggaccatagtagacttttaaatattccaggaatggagaggggtagattattcattcaagagctttgttgtatgtgttagtttcaaactatagaactaatgtatttccttaagcagcaattttagaccataaccgtctttaaatatgtaatcccaccctagattccctttaagaatgatgacctcatttatttattt

SEQ ID NO: 79027 - DNA, 1020 bp, Homo sapiens
attaaatctttataagtttctttgatgattgtatttttaatgtacatttgcatgttaatgggtatctaaagagtgagaaaaattaaaccacaatcctatctttgcagttcaaaaaaaatgtattttctttgttgctttgtctttatgtacctacattacttctttttttgtgtgtcatgctgtcacccaggctggagtgcagtgttgcgatctcggctcactgcaagctctgcctcctgggttcacgccattctcctgcttcagcctcccgagtagctgggactacaggcacccgccaccacgcccagctaattttttgtatttttagtagagacggggtttcactgtgttagccaggatggtctcaatctcctgacctcgtgatccacctgcctcggcctcctaaagtgctgggattacaggcgtgagccatacattacctcttttatacattattttagtgtttaacattgaatttctgtctactgtgtgtatctgtttttcccactatactatgaacttcaggacaggtgtgtccatgtttatgttcccaacacctgcaatataacaggaatttattctcattggtcaagtgcaaaatagtattttatacttgttaataattacttcctgataactcatttcatgataaacattgttcccattgtatatgaaaccagtcattgtctttacagccaaaagaaatattaatcatacaaattataggctaaaatgagtttgtttatctcttgaaactagtacatcctgatgtgcaagtcaagatgacaggtgcttacatccttcttccaagttctgggttatgaaaaactggaggtagaaaatctgttccaaatctcctgaggctgaaacaatttcagctggccctttggctgatgggtgtgaacagttctagggaatctgtactgtggttgtccagagttagctgtgacaggcttggtcagttctaggttcacttaatcagactaacctctgagaatgtagtgtgtgaagtcaggttta

SEQ ID NO: 79028 - DNA, 1961 bp, Homo sapiens
catgttgtacaaaacaaaaactcctaatggcagtacttaaagttattgttaggtcagtgaatatagaaaaaaatctctctaccatggctatcattactgtgaagtattataactgagttatttttatatccagttaagtggtgcataatcacttgttttatcatattttatgagtctctgactatagctaatctctacggtgaataatttagagccagcacatccctaaatacctacccttatagtagaactttaaggtgtctagtttggaaggcaactttaaatcttctgatgcttacaattcctcccctctatcccaacctaaatatagatatctccagtgaccaggggaagggaaaattaacacctgttctgcaggtactgtgtaattcactctcatgagaatcctgtgagatttattagtaactgctatgtgccaaggagctttgcttatcttacctgattatattcttgcactattcttagaaggtacttgatataatcttactttgtagattgtaaatatttgcctcaagtcacaaacctagtaagtggcagaactgagatttgattataaacaccgtttatctgtaaaactcatgttcctttcactatgtcatgtagcctcacaggatacataaacaacaacacaaaatctactctgaaacctggcctaacacaccaatcacaaaaactctttatttagcaaataattcgtgttaattgctttctcagtctctcattgtagaaattctgtagtcacatcttactctttccctacatgtttatttactaatttcccctgaaaccttgtttttaaattagttagcaataaccacacttaatgtattttctttcccagataaagtctaaattctgtcagaatttgtaggtcttcatagtttagctttgtgtttatctgactgtacctcagcatgaaataagtttgttggtactagtaggtactctgttcagcctgccttaggaaattttcattctctcaaagcagcacattccaactttggatagcttcttccaactattagaaagtttcctattgtatattgaactcttgtctttttttgtagcttttattttctggttctagttctctctttgtccattcagaacaacttcaattctcatttaacttgaagaagtatttaaaggcagcagtcatacctgccaggtcttttctgcattgagttgcatttatttctttaactagtcccatttcatgttggttaaaattccttctaaatcattgtccttctctactgaacctgttccaggtgcatgtataccatttatgtgccaagaaatgaacacagtactccaactgagatctgcctaggaaaacacagaagggagggattgctacctctcttattctaaaaaatttatgtctatttagttttgtcacttgctttttgggaggtatctcatggggtactttgtttctcagttgctaatttattgtggaaatgcaacttagaaaagagatgcagttgaaccttggtgctattgaggaacaatattattcttttattactctaacctattcctttgttccatttccagaaagtatagcacactctcaaaccaaatcactcccttactgtctcaccctgtccacacttttctccctcttttcccattgcttttgccacctatttttatctacagacttcttttccttcccttccttacccttttgtttgttccaatcccttacatcttctttacttggtaagtcatctatagaggttgctcattagctatgtgagattgttagaaaccaaaaatgtaaattctcttctagatcagtgcttctcagattttaatgtgaatgcaaatcatctggggagctgctttttttaatttttatttaacttttattttgagttcaggggtacatgtgcaggcttgttacataggtaaacttgtgtcatgggggtttg

SEQ ID NO: 79029 - DNA, 1044 bp, Homo sapiens
aagatgttctcttctaaaactcttcagatatagaatattggaccatatgtgtgatctgaaatgaaattttgttttcttatacaaaagctaatctccctacttagatgattttttttgtacaccatggttaccccttaaactttgtaggaattctggagggtaaagtatctaacttaaagtaggttaagtatccaactttgtgccttacacataatagatgcctattatgtgactgagtatattcctatttttgttctcccagtatatcagggttgttttgcagctgttatgtaccagtatgggaaagaagttatttgcagccagcatccattctgtttaaggctggattcaatctgattggttggtttttctgggtcatatcagttgttaaatactttgaatatattccctgcccaataccattagagtggaagctgctaaagattgccccagattctgtttggagaaaggataaactataccattgcagtcctctgttttttgtttgtttgtttgtttgttttttaacctatgtgtatattttaatagtttccacttctatctctgctaaattgagtaggtgaatttttacttgatttgttgtttgttattctccttctaagatatttttgctgatcataatatcttgccttaataaataggaattatattacttgacattttatagatagaaacaaacctgcagcagttattaaaattgggattttttaaaggtctttagtagtgatttataattgattctctacttatatatttcagtattataaacaactgcagaaagaatatatcagtgatgatcatgacagaagtatctctataactgcactttcagttcagatgtttactgttcctactctggtatgtattgattattccttttcagtctttctaagtaaaacttgttttgctttgtaagaattccacttaatgttgaatcaaattagaacaatgttagaatcactaagttgggctatgtgaatactttagtgctacccaaggactagttaactaggcgctgccttg

SEQ ID NO: 79030 - DNA, 1001 bp, Homo sapiens
gatatcaataaatagaaataggcagtttttataaatgaattaatagaaacagggataattatgaatcaaaaattaaatgttatgatttatttctttgtcaaaagtttgttcttggccctgcgggttggctcacgcctgtaatcccagcactttgggaggctgaggtgggtggatcatttgaagtcaggagctcgagaccagcctggccaacacggtgaaaccccgtctctactacaaatacaaaaattagccaggcatggtggcaggtgcctgtagtcccagctactcaggaggctgaggcaggaaaatcacttgaacctgagaggcagaggttgcagtgagccaagatcgcgccactgccctctagtctgggcaacagagtgagactcccatctcaaaaaaaaaaaaaaagttcgttctcatacgttatataaatattttcacaaatgttatttgctagtatagaaacagcattcttagagaagagataggtggaaaatgacccactgacccagagcaaagggaggttatcacattcacatatgcattcagtcttcctaatcatttatttgcctgttagtaaaattacaataagaatagaagtgactaattgaaaagtatagcaggaaagaagaacagatgtgtatgctaaagtggggggcaggaattaggtggccaagagttctacttagtttttggaagctaaagcataaggctaaaatttacagctttttaatgttttattaatctatcgtgtatctcttaccttactgtatctttttgtctatctaccaaattagattgcaagggtatacagatcaaggactcctttgaatcttttattttgccttatataaggcaatcatacttgccagtcatacttgttgatttcctctgattttgagttgcagtcaattctgtaagacttaagatagatataggacccaagatggaattggaagcagagaaagaaataatgattgttgtaggcaaatgacact

SEQ ID NO: 79031 - DNA, 1074 bp, Homo sapiens
actataccacttaaaatcaaattctgggctgggcatagtggctcacgcttataatcctggcactttgggaggtcaaaacaggcggattgcttgagctcaggagtttgcaaccagcctggagaaaatggcgaagcatctctacaaaaaatacaaaaattagctggggtgtggtgacacgtgcctgcagtctcagatacttaggaggctgaggtgggaggattgcttgagcctggaagggagtggttgcagtgagtcgaggttgcgtcactgcactccagcctgggtgacagagtgagaccctgtttcaaaaaaaaaaaaaaaaaaaaaatcaaattctatattacttttatggtgttactttcccacaggttggaaactacacagatgttatgtattaattttgtcttttttttttttttttttacttttcctttatttgttgtagtatccaaatatatatgttttttttctaacagggagaaaaatgaaagatactattgtgtccttttcaatgatgaacaccattcatatgaccacgtcatatacagcctacaaagagctcttgactgtgagctcgcagaggcccagttgcataccactgccattgacaaagaggtttgtggtctccttttgaattgcgtttctgttttctgtcagcttcctggcagccagatgttgactgagcccttgctcagtattgtgctaggtctgaccatcctctccatttattccttacatcctaggtaaattggttagaacttcagttttgtgtgtatatcataattttaaataactatttataactttcatcttttattttaaataattagaaagttactgaatttatttggcaaagcgtaggtaagaatgtcatctcaactttagtctggtcctataattatttattgaatgaatgaataagtgtatgaattatgaaaagttggtaatttctgaggtcttaacatgatttatttaaattatttttagagtaatattaattctatggctcagtttatttaacatccatccagagcaaaatgggttcttcaagtaatataagtatataaaaggaat

SEQ ID NO: 79032 - DNA, 1636 bp, Homo sapiens
caatttctggtagccataagtctttcagtgacagtaatatttgctcttaatttataaatgcaaagaggaattctggacctgatatgaagataactttgagttgtgtgagaatttttctacctatgtaatattaggattttcacaaaattgcagcccaaatctaaatagtcattctttgagtttactggctattttcatttgttttgttttaaagggagaaagaagtaagaattctaatcaatagagacattaaatgtactattttgactcttattaggctaaaaaccacttgtggaaataaatgtcatgacaaactgcatccacaaatatgttaatttccaacaggtgttaatgtcagttaaaccttttaagtcactttatgttggtaaacataatatgagccatctgcccataaaaaaacgaggattgcttgagtgtcattttttatgtgggtagcacgggtctttgggttcacacatctgagttctaggccctctcattgcctgttggcattgtgaccatgacatattggccttttaacccctttagtctctgttttctaaaacataagagggctgagaaaatatgcccctcagagttttgaggatcaattgagcgtattgtaaaagtatattacatattgtttaaaactgggaacataggccgggcgcggcggctcacgcctgtaatcccagcactttgggaggccgaggtgggtggatcacgacgtcaggagatcgagaccatcctggctagcatggtgaaaccctgtctctactaaaaatacaaaaattagctgggcatcatggcgggcccccgtggtcccagctgcttggtaggctgaggcatgagaatggcgtgaacccaggaggcagagcttgcagtgagccgagattgcgccactgcactccagcctgggtgacagagcgagaccgtctcaaaaaaaaaaaaaaatactgaacacatatgtagcccgtggcagctgtttttacatatcttgtgagatcctcataacactcttgaatgtagatattatgttccttttggagatgaaaaagcactgtcatctcagcaagattaaaagattaggtgagctgtcttaaggtcctgttgccaaaatggcagtgctggcgcttaagtctatactgtatacttcttgaaactaacttaaatgtacattaataccagtatcacttaaatagaaggtaaaaacaaaaataaattcaataacaactaattgttaataaaatctgtttatttatcattgcttgcttcaaggttctgagcctgaggcctgtctccttttgtcagaataggagataagcaagagttaagggtagtattaaaaacatacagtcaggccgagacaggtggatcacctgaggtcaggagttcaagagcagcttggccaacatggtgaaaccctgtctctactaaaaatataaaaattagccaagtgtggtggtgggcacctgtaatcccagctactcaggaggctgagacaggagaatcacttaaacacgggaggcggaggttgcagtgagctaagattgcgccaccgtactccagcctgggtgacagagtgagattccatctaaaacaaaacaaaacaaaacccaaaaacatacggtcactg

SEQ ID NO: 79033 - DNA, 2102 bp, Homo sapiens
gtgggtgcagcacaccagcatggcacatgtatacgtatgtaactaacctgcacaatgtgcacatgtaccctaaaacttaaagtataacaattaaaaaaaaaattctaggtgttgtatagattattttcgcacactttgcaatctattcttctccattagtcaaaatttaaacaactgttatttaaaaattagagttatgtttcaaaagcttatcaattttggcagttcatttttgttatgatgaagtattcagaatttggaagttttggtttgttggtttgttttttaggtaactaatcgaaaatggtttttgttacatccagttaatattacattgaactcaattaaggttggagtattggtgagcatttattatttgagtcatctttatcattcttcatgcttagtaaaatgtttgaaatcaagacaaactcatttttcctttatcagatgcatacttctactggaggagggttctgtgactgtggagacacagaggcatggaaaactggccctttttgtgtaaatcatgaacctggaagagcaggtactataaaagaggtaagaatgctattttgttaaaaattgttaactattttaagtttgctgagattagataagaataaatgttatgtgtatagattccagttagaaccctgctgtttttattctcatatttaggtgtaaggaggctttttttctagctccaaagaaactaaggatttgataatgtctctaaagagagaatgaatttacaatgaaaagatgaattcagaatatgttttgttaagcaatcaacttgatacataagagtacacaggtcgggcgctatggctcatgcctgtaatcctggcactttgggaggctcaatcacctgaggtcaggagtttgagaccagcctggccaacatgatgaaaccctgtctctactaaaaatacaaaaattagccaggtgtggtggcacacacctgtaattgcagctacttggggggactgaggcacgagaatcacttgaacctgggaggtggaggttgcagtgagccaagatcatgccactgcactccatcctgggcgacagagtgagactatctcaaaaaggaaaatagtacacaacatataagcctaaatgaacaaaaggaagtaattattaatagataagagtagcatatagtgaattagaagtgtagagctgatatataaattcagtaattgcttttcttaaagaaaatgtcaattagattacatagatatatcccagtcaaggaaataaagaagtttgagcaagcccagatatagacaattagaaatgagaataggaaaataaccatagaatcacaaatacagaaggaatcacgaggattataaaatactcttttaatgattttgtgcaattacacttgaaaatggattatcttatcagatagtatagagtgcaatatttttattagaaagcagagagaaaacttggtcagttacattgaagaaattcagaaaattttcacaagaaagtacttgccccagaatgccatgttcagaagttttacagatgaattatttcacaacttcaaggaataaatagtttttgcgctctttaaactgttgtggatatccctaaagcagcaaacacctgtagggcacatatgttgatcttttaagtaccattctgctcttacagcaataaggtatttcttgttgtcagaaatacctggttccaggtctgggtcaggggaagtataaggcaagctcatgcaaaagaacgtaggacccagcttgaaaaggttcacattgaccttacttggataattgaagcatcaaaagaaaaaacaataaataaccaatataattgattgaatcacattgaatatataaaaatccgtgagttcctaatgaaacctaaatgagagctagatgaagtaaaacctgtttctgacaatgacaagtagctgtactatcaatttcttactattaaaattggtaaagggaatgaagtaagcgcttatcctgccttttcaataagaattgtatttcatggtaaccaagtatctctagttcattaggaaaagcttttctttctagagaaatgctagctattagacaaggaat

SEQ ID NO: 79034 - DNA, 1014 bp, Homo sapiens
acaatgaatagaaatccctgcccttatgttgcttgcattctaatgaactttgtctttatccaagcctcatttaacaatgagcaatcagcttttgtaaaatatatttgtttatgtaataggatgagatgatggtagttaatggaaaaagtggattattttttacaaaactatttttgaattgtaatctaacagttcgaaaccaggtcaaggcccaaagttatgagaatgatttcagaaagaaaaccaaacatccagacctacacacttaaatgtggctaaaatgagactaaagttgtgctagcaatattatctttgttcaaaacattttaacaatccagtttttgaagcattttcatattcagtttgtgtaccatagaggaaacttgttcacattgtattatagtcataccttgagcatcagtgggagtcatctaaattttggaatctgatttctgatctttttcagggattgtgcaattgatccaacatgtgtactctgtatggactgcttccaggacagtgttcataaaaatcatcgttacaaggtaagaaaatataaccataacctctgaataagcaggaatctgatggccatctagtccaaattcttgagtagtattcacattcctgctataacagctctgatatgtgaacatagccattttaaagaaaagattggaagagataagggatgtgtgttgctttacagaaaagaaaaaaggagtaattttagggagactcaagatcagatattatgtgatgaaaggaccaagataaaccttcagttgcagaatagtccataacaacttttgagaacaagaaaacaaacaaaattttgagctctttgctctacagtgtgtaatatgacccttctttgtgatctctagcctttcagtagtttactactaaaaaaaaaacttacagtaaacctctgtgtattctttctcaaaaatacatacatagaaacgaacatacacttactgttaaagattgtttttaatagaaatgtttttt

SEQ ID NO: 79035 - DNA, 1028 bp, Homo sapiens
aagcaaactgaaacccatggcaataatgggaggttgtccaggatgtgcccctctcctagtcctcccactgtttgctgaataataaatggaacggctctaccctgggggtgtgtgtggaagaattgttatagaaagaattattttcccttagtcattaaagaaaatgtttgtattctttttttaatgtggatgaatgtttgctttttttttttttttaaattagatgcattcaatattccaagtctggacagcatcaagaattattacaggtactgtaataaacagaagacagaccactatgtagagtcagtgttataaggagggtgtggtcaactcaatgaatgagagaaaactttaaaaaaacattttaagaggcaggggtctcgctattttgcccaggctagctctgaactgagctcaaacgatcctcctgcctcagactcctgtgtagctggggctgcaggcacatgctactgtgcctagctgaaaacattttttaacaggtaaaatttttctataaagaatctctagtaatttaaaaaatgagcctttttgtctttttgtgacagatgcatttctttttgtttagagtttttctttcctttaattctttctgtttcatatacaggcatacctcgttttattatgcttcgccttattgcactttgcagatgttgcattttttcaaattgagagtttgtggcaagcctgccttgagcaagtctatgggagccatttttccaacagcatgtgctcacttcctgtctctgtgtctcattttggtaattctcacaatatttcaaactttttcattatatcttttatggtgatctgtgatcagtgacctttgatgttactattgtaattgttttggggtgctacaaaccttgcccatataagtccaggaacttaatcaataagtgctgtatgtgttctgagtgctgcaccaatcagctgttctcccatctctctccctctcctccagcctccccattccctgagacacaacaatattaaaattaggccag

SEQ ID NO: 79036 - DNA, 1498 bp, Homo sapiens
tcctccctggtatgtgatgagtatagtaggcctgccttcataccaggacttcagaaaatgtttgatgatgctgtagaaatatctgccctaggccgggtgcagtggcttacacctgtaatctcagcactttgggaggccaagggaggtggatcacctgaggtcaggagttcgagaccagtgtggccagtgtggcaaaaccccatctctactaaaaatacaaaaaattagctgggtgtggtggcgggtgcctgtaatcccagctacttgggaggctgaggcaggagaactgcttgaacctgggaggtggaggttgcagtgagccaagattgcgccattgcactccagcctgggtgacagagtgagactctgtctcaaaaaaaaaaaaaaaaaaaaaaaaaaagaaaaagaaagaaaagaaaaagaaaagaaatatctgctctattccacagcagaagggttgaccactttgatctaatctgtttcctttttcataggaaacccagaagttctgtgaacaagtccatgctgccatcaaggcatttattgcagtgtactatttgcttccaaaggatcagggtaagccacataagtgttgcatttatcgtgtagatctttgctaatattgtggattatgtcttgtgacttttacctttacccaacttgaacatgtaactttctcccataaaatacagtgaaggataattttgtaatgtaagtgacttatataaacaagccattattctaagatacagatgctttgttcctatgacttcccatctcccctgccttgcctgactcataaggcttttaattctcacagccttctccctcttcaacccgttttaacaccacagatactggctggctctcagccccatatgcaggctcaggccatccttactttcctccacccatgttatatctcaccctatttctgaacatctgcataggttaaatggcctccagccctgcctgtagaatcatgcattgattataatcatgccaaaattataactgaatacatgtcatggatcttcagggttactcaagtggcttaaacttcaagtgtttcatctacagttgttaagagatcacggtccttaatgaatgaatacatggtgtcacggaaagattttgttccaaatctcttttgaagaaaacactaaggaatggcaggaggggcaagaaaatgccatggggatataagtaagacctgagttttgtgttagcatgtaggttaaagcatgtgggtgtacattaccttatagttctgtaatgcttagactcaggaaagcagatggtgcttctgaaaagaacaccaggttgcttattctttgggtttggccacagggatcaccctgagaaagctggtacggggcgccaccctggacatcgtggatggcatggctcagctcatggaagtactttccgtcactccaactcagaggtagtgatgccacagtttaggttaccagttattggggttccttgcctcaga

SEQ ID NO: 79037 - DNA, 1135 bp, Homo sapiens
tacaaagtaagtatgaagacttctcagatagctttttgtgagtaaaacggaactgctgtccagacgttctcaactccctagctcccatttcaaggagtgggaaagggtgggtgtgggattttctttcagcttcagttgtggggcagctgagattctgcaaagaagcttccctttaaaaaaattttagttttccctgtgctccctcctgaggataggttttcccttgacatcctaataagtttaacttacttctttcctattctattcacagagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtgattaaatgagtgcccttccaaagtttctttttaccagaaatacagtggattgagactagaacattgctttcatttgggtttgtaggtttaaaaatctgattctaatcagaagtatatttagaacaaaacactttatttataaaagatgactccaaaattcatcttagtatttcaccatgttatatattattatcagcaagtccttctgaatattatcacagattactccatgtctctaaaatatattggcattgagctcatttgttaggtttgcccaccttattgaacagatttattttccttatacatacttgtgttgtccttggttacgtgtgtccccaaatgtaaataccaaatttttataaatcaaaaattttttagtgtgtaagagattttat

SEQ ID NO: 79038 - DNA, 1211 bp, Homo sapiens
ccttgatcctagtaagaaaggcacaagccctttcatagggagaaaagcgcaggtggaaggagagagagggcaggagggggaagggctctgcctgtggagtgggtgggacccccatgcctaccctgtctttctgtgctctggggcacttctccccacatcccctgctttctgggtccttctccctggggaacctctttcaccagcattgtcctccctcctgtattttcaattctctctgtccccactcagctcttttttaaaacctatgtaattatttttatttttaatgtccagaatgtgtactataagggccagggcttcttcctggacttaattttataaattcttgattggttggtgagaccaatagcgatactttttcttgtctaatttggtttccgggaaagcttcgttcaagtcgtcaatggtcatctgatcaaatggtattaagttcctcatcttctccagctgtttctcatattctccaacctggcctttgagagagacacccactcagcacaagttttcccatcttctttttcttcagcatccacctgggcagtatatttatcctctggtacaggaagcttcaggacattaaacttcttctcaaagtcatccaccaagcctgccttggccacattggccttgtagtaagtccagtcaatagctggtggattctcaggtaaagtagccagcctggaggtgagggtctcattccaggatttcagataattagcaatggccttttggttttggggtatcatctctgcaaaagctacccagtcaatggtttttagagcaagttttcacccagccatcttggtatacttcactgaccatggcagcccatggcccacaccccactcacctcttatagggtatatgtgcacaaatgcagttcactattttaacacagcacatccaccttcaactctcatccccagcttccctagcagcccctgccctttctctcaactccacttctcagccaagctccttgcccactgctttgcctcccaccacccctcacctgctgcagactgccttctgtcccacggctgcctcgacgccacgctcacctcccagctctgagggctgggctctgggcgcctttcctgctcttaccctgcaaggcctcctgcagccctgcgggtactgtccactcctcctgggcttaggtgacttctctctcttggttgtctagctgc

SEQ ID NO: 79039 - DNA, 1108 bp, Homo sapiens
cggcgggtggaaaatattgaaccctttgacgaatttgaggagtggcatctgaagtgcgcccattatttcattctggcagcttctaggggagacaccctctcccacaccctagtgtttccatcctcagaggcatttcctcgcgtaaatcctgcttcgccttcaggggtattccctgccagcgtagtcagtagcgagggccaggtcccaaacctgaagagatatggccacgcctctgtcttcttgagcccagacgttattctcagtgcaggaggatttggagagcaggaggggcggcactgccgagtgagccagtttcacttgctctcaagagattgtgactctgaatggaaaggcagccaaataggcagttgtgggactggagttcagtgggatggacgcctttatcacaccatgacaagactctcagagagtcgggttctggttctgggagggagactgtccccagtaagtccagccttgggggttctccagcttcatttttttaagagtgaggataataacactgaggacctgaaagtgacaataacaaaggctggccgaaaggatgattccactttgtgttgttggcggcattcaacaacagaagtgtcctgtcagaatcaggaatatttgtttgtgtatgggggtcgaagcgtggtggaacctgtactaagtgactggcatttcctccatgtagggacaatggcttgggtcaggatcccagtggagggagaagtacctgaagcccggcattctcacagtgcctgcacttggcaagggggagcccttattgctggaggtctcggggcttctgaggagccattgaactctgtgctctttctgagaccaatctcttgtggattcctctgggagtcagtagacatccagcctcccattaccccaaggtactcccacacagctcatgtgctcaatggaaagctgttactggttggagggatctggattcattcctcctcatttcctggagtgactgtgatcaatttgactacaggattgagctctgagtatcagattgacacaacatatgtgccatggccattaatgttacacaaccatactagtatccttcttcctgaagagcaacagc

SEQ ID NO: 79040 - DNA, 1050 bp, Homo sapiens
gcattttaaaatgttctctttctaaatggagagaagcaaaattgtgtcagtgatcttaaccagtagaaaaaaaatgcaaagaaagtataacctgtttctggagaggtaacttttgactgatcaagcaaaaattttcctctttggtaaagactgatcttcatgataagtggtaagtaaattaagcaccttttagaggagaggtaactctaatagtttcattcaacaaaagttgactgagtgcccacaatgttccaggcactgtgctaaagtctgagagagattgacacagtttctgcccctgagaaatttataattaggttggagagacagacccataagcagatactgcaacatagtgtggtaagctctgcattagacacacacataaggatttatagggaaccaaaagggcattctctaagcagcgtctcaaaagataccattgaacatagctaagaatatccaccacaggggccctggtctcactttgttgatgagtgttatagagcaaaatgattaaattgaaactttgacagtttaatactctatgggtatattaatggcatgcttgttgctacattcatttcaaaatgaaagttgaaaagctttattaaatgaagtgagaagattctgtgcatttgacctagtgctactaggtggttcagagggtgacaatggggtgccccatatgataaatgaaacgtctatgaggataaactaagagattgtaaatgtagaactgagtgtgagggagatcacttaaaactctagtcaaggtgacctgggtataatctcaaagagaggattggagtgtggctgaaaaaatgatacttgttattacatgtaccagacattattcttaggactactttcagaagtaggtatttttattgttccctttttgtagatgaaaaaataggcttaaagaggttaagtgtaacttgcttaagatcacacacacagagtaagtggcagtactatctggttgcagagctcatgctctttcccattcaagcttatacagtcttagagaggtttgagtaagtagga

SEQ ID NO: 79041 - DNA, 1496 bp, Homo sapiens
gagggccagggtgactctggtttggctctctagcaaaaggtacttgagaggacttaaaaacaaacaaaaaaactgatgctctgcacccatcccatgagattctgttttatttgatctggggtgagtcctgggcagagataggctttaaaagctccttaggtaattttaatatccagccagagttgaaacactgctctggtatcttttcttaagtataaataaatctgtttagttacagctatgcatagataaatttgtaggcccttgtttagactcttgaaagaagcatagtaaataggaaaatagactctaaacaaaaagatggttgtttttgaaaaatccttcctttttcattttgaaacattcttgtttacgttggcagactgatgataagggtgtttttgcaacacacctttctcaagagtaccagctggcagctgaaacatttaatttgacccagtctcaggtgtgggatctgtcttatgaatccatcaactacatctttgcttctgacagcaccagatctgaactgaggaagaaatggaatcacctgaagcccagagtgttacatatttaagctataatgaggtgaactacttctgagtatgtgtttcaatcaagttcctgccatatcccacttagtaaaacagtccaccactcctttgaagcatagcaaccaagttccttgggctctatcaccagcaccttacacatggcaggtactcagtaaatacgtgtcttcaactgactcacaagctctcaggtgcttactgggtgggacttgactgttgttgctaattaaatccccattccaccagtgattattgtgactcagcagtccttccctattagtgatcataaaatttcagggaaatcgaagtttctcatcaggaaatgttttggaattactagtataaagttaggaaagtggggaaattaggttactgccgagacctttaagccttctaaacagctttatattttattgtgcatactttaatcagactcccttcactcgctttaagtttttaaaagtattccccagccggatgtgatggctcatgcctgtaatcccagcactttgggaagccaaagtgggcagattgcttgatcctaggagttcagtagcagcctaggcaacatggagaaaccctgtctctacaaaaacaaaaaaacaaaaaaccggaaattagtcaggcacggtggtacacacctgtagtcccagccaccagggaggctaaggtgggaggagacctgatcccagggatgtttgaggctgcagtgagctgtgatgctacagcactccagcctgggcaacagagtgaaaccctgtttcaagaaaaagaaaagtattctccaagatcccaagaccattgacaccaggccacattgtataccagggatttatgtgaatgcctagggatgaccgtagtgacagataaagctaggtgctgagatctggttttgccctctttatgattgtcccatcggtacta

SEQ ID NO: 79042 - DNA, 1078 bp, Homo sapiens
gctgtaatcccagctactcaggaggctgaggcaggaaaattgtttgaacccagaaggcagaggttgcagtgagctgagatcatgccactgcactccagcctggacgacagagtgagactccatctcgaaaaaaaaaagcccggcgcagtggctcatgcctgtaatcccagcactttgggaggccgaggcaggcagatcacctgaggtcgggagtttgagaccagcctgcccaacatggagaaaccccatctctactaaaaatataaaattagctgggcatggtggcgcatgcttgtaattccagccacttgggaggctgaggcaggagaatcacttgaacccgggaagcagaggttgcagtgagctgagatcgtgccattgcactccagcctgggcaacaagagcaaaactccgtctccaaaaaaaaaaaaaagagctagacccacctaatgggcaaagtctcataacttcttctcgaaatgtaatgggtttttcctgtcaaaatgcagctgaatgacagaatgagtaaagaaggatgcttatcaaattcataggatctattaccttgtcctctgtgcttatattaagggaacaccataggcactgagagggaaaagatgttatccatcaattcagatgcaggcaaagagagggactgaaatcttcctttcattctttagactgccttggggatttgagtctagatcaggaaaaacaaggaacaaacagtggcataaatcctaaagtgaatttcctaagctaactggacacagaatagtagatgaatctcactattggaagactttctaaacaatacatttattgagcctctttccgttatatatcctcaggggcttacttgggagctgactgtgtcagaagcttttcccgtgcatggatttctccgtgcttattaagggcagagcttttactgaagcacttaccacagtcatgacacccatagggtttctctcctgtgtgggttctatgatgtgcacgtaagtcagaactcttactgaaactctttccacagtcaggacacacatggggtctctctcctgtgtgtatcctccgatgt

SEQ ID NO: 79043 - DNA, 1044 bp, Homo sapiens
ctcactgtgcaacattggccagggaagttaaatgggatcggatttggaggaggtgggagaggggcagacagtacttttattctctgctgcttcctggggctgccctggaagtcaaccagaaaagcagtttttgcaaagtctatttactgaagattgtgctaccttagaaggccactcggagcacatggaaaggcaggccagctctggcaagactttagacatatgaatgtattccttctgatagtgccatctttctctgccctaggaagaaacacctcttacagtcatctgcaggggattctccaaggacatgggaagatagatgtaagccctggaacccagactcctaagcgaagggaagctgcattctgctattaatgatggccaaatcagctctaagagagaatggcactaactctgagaccttccgacagcgtttcaggagattccattaccaggaggtggctgggccgcgggaggctttcagccaactctgggaactttgctgtcggtggctaaggccggaggtgcgcaccaaggagcagattgtagaactgttggtgctagagcagttcctgaccgtcttacctggggagatccagaattgggtacaggaacaatgtccagaaaatggagaggaggcagtgactctcgtggaagatttagaaagagagcctggaagacctagatcttcggtgagaagggagggggaattcaaattcaaaagtgtgatactgggtggagggctaaattaagatatagacaggcttaaagagggacacagtctcccttggtgaggcttatacttctggtctggtataggtaactttttcagatagtgcttgtctggagatgcttcctgggtgtaccttcacctaccctgtcataatgagtttttcctatagtttcttaatagggaagaaaggggatttttttttttcagcctgaaggtgggtttactattttgatcgtttccttctggagtttcaactgctttaagctaatggcaatggaataagacccttgttcgcgttaacctccctc

SEQ ID NO: 79044 - DNA, 1013 bp, Homo sapiens
atctacccagagcacctagcacagtttctgccacatagcaggtgtttaggtattgatggaagaaaagaagacaaagatggcaaatattacataatttctgcagagcagtgtcttttacatttgagtaaagggaaaagttgtcatgagtgccaagtgttaatgaaaattattttattatattgaatatgtatatacataagctaggtataaactcaagcataatactcttaaacaactataaaatcaaatatttttataaattaaaagtaaacaaaactaccaaatcaataagttcaaatgaccattattctaatgcaggatttctcagcctgttcctataactgtgttatatagaatggtatcagtaacttcgagttattatttgctgtttcagaataattagatattgaacttttcgaaaactctgccaacaagaaacgctcaaatgccaattttaatagtagtatcacttgataactggtagagctgtcttgttaataatataaaattgcttatgtgtattgagcactagctatgtggttgggatatgtgctttacacatgtattaacttatttaatcctcacaattattttcttcagtttataggtatgaaaacaggcacagacaggtatagtaacttgcctaagctttcaagcaagtaagaggcaactcagggattcaaacccaggcagttgggctccagagaccaggttctttttttttttttttttttccgagatggagtctcgctctgtcgcccaggctggagtgcagtggtgcaatctcggctcactgcaagctccacctcctgggttcacgccattctcctgcctcagcctcccgagcagctgggactacaggcgcctgccgccacacccggctaatttttttgtagtttttttagtaaagatggggtttcaccgtgttagccaggatggtctcgatctcctgacctcgtgatccgcccacctcggcctcccaaagtgctgggattacaggcgtgagccactgc

SEQ ID NO: 79045 - DNA, 1049 bp, Homo sapiens
tattgagaagttaggagaatgtctttctgggcagagttaataagtctgaggaataaatgctttgagatttcatattagaagaatctgctgtcctattgaattggtccacaattggaccaagtggacaaatggattaaacatctttagctcaagtcgtcattttttttaagctctttatttgtgccttagcttattaggggtgttcattttcattaatgtaactagtaaaccagttaatctgccacattgctgcatcatttttaactgtgtaagtgtagaaacagtgctctgctatgttcatgctgtgccagcaaagccagtggtgggtgctcattggcccttcaaagctgattgtcctcatcaaataacaacatccagcttttactgtcactggctgtgtactaggcactgtgctaagtgctttaaatacattatcacacacaatccactaaagggctaagttggttaaggggtgtgcccagtgtcacacagatagtagtaaatgggtttatatcccagctctatctggctccaaagagtgtgctcttaaccactagattaaactatctcccaaaataaaaggagacattctaggcaaatagagttaatgaggacagcataagggagccaggcctagctgcacgtctcagttggccttcaacttccgctggctataggaaggagagtggaaaatagggggattgcagatggctgaatcttcctccctgccagaatagtggtagagaaactagtgtaccaaggctcttcagagtttttaaaatcaggtggtcaaaattctaggtttgggttgagaatggagattgattgcagacaggcacaaaggcgctttttggagtagtggaaatgttataaaactggattgtggtaatggttgcccagtgtttgaaatttactaaaaattgtttattagtatgcttaaaatgggtgaatttcattgtaaattatacctcaaagtggtaaaaataaaagtctggggaccgggcatggtggctcacgcctgtaatcccagcacttcgggaggccgaggc

SEQ ID NO: 79046 - DNA, 1051 bp, Homo sapiens
ctggctaacacagtgaaaccctgtctctactaaaaatacaaaaaaaattagccaggcgtggtggcgggtgcctgtgtcgcactactcgggaggctgaggcaggagaatggtgtgaacccaggaggcagagcttgtagtgagccaagattgcaccactgcactccagcgtgggcgacagagcaagactccgtctcaaaaaaaaaaaaaaaaaaaaaagtctgaagaacatagaggcagaggatttttgaaaaagtatataccttagaagtagactgaattgggccttaacttgaaataaaaagctttccttggctttggtgttccaactctaaatgattctggttgctttaagtgcagtggttctcacactttactgtgcattagaatcacctggagggcttgtggaaacactgagtgctgggttctaaccaagagtttgcatgtctgatgagtctccaggtcatgctgctgatgggagagaggtccctctttgagaaccactatgtgtaaatcttaggagaaagtttatccccagtctctcctagattgtgccctcttggttgaatatggaataagaatgtgtcttgcatggactcttagaatggaatccagtttgacaaggccgtattttccacagattcatggttgtcaaatcctggaaacagtctacaaacacagctgtggggggttgcctcctgttcgaagtgcactggaaaagtaagtcatggcttaactgggaattggtggtggaggtgggtggtcaaattatttgacttctcacatgttttattttcaggtcatttcaggtttccctcttgggaaggttataaccaggatagaaaaagctccatgagcagaggagcccatgtaacctttattatggctcaggccttgcaaaaagggctatagagtgttgagtgacaaagccaggatttaggtgcctggatgaccttgaggcaatctttttaaatgtttagatcctgttatccttgcaggaattccattacatgtgccagatgttgcttgctgtgtctaaacatgtgtatttgag

SEQ ID NO: 79047 - DNA, 1021 bp, Homo sapiens
ctctttccttgactagcgcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggtagaaatctccttgtccaatgtaccacaccctcaaaatctcttcttccttaatactatgtggccccacagcatgcctggtcagagcgagtggtcgataatattcctatcctgagattgtagcagaatcatgacgtttgtctgagaagcaggtgaagttgctgccccactgagattagccctccccagaaaaccctaactgtcctgggtattctccgtcctcctttgacggtgtcttcctattttgcaggatccattttgaaaaaccaggaagacacttttgctgcagagctgcaccgtctcaagcagcagccactcttcagcttggtggactttgaacaggtggtggatcgcattcgcagcactgtggctgaggtttgtgtttcatcgtatatatatatatatatatatatatatatatatttttttttttttttttttttttcttaggcaaaattggactagtttcctagaaattgagttacttggtcgggcgcagtggctcacgcatgcagtctcaacactttgggaggccaaggcaagtggatcatctgaggtcaggagttcaagaccagcccggccaacatggtgaaaccccgtctctactgaaaatacaaaaattagtcgggtgtggtggcatgcacctgtagtcccagctacttacgaggctgaggcaggagaatcgcttgaacccgggaggcggaggttgcagtcagccgagatcacaccattgcactccaacctgggcaacagagcaagactctgtctccaaaaaaaaaaaaaaaaaaaaaaaagacactgagttacttgacttttgtttttatcttgatgtcttgatga

SEQ ID NO: 79048 - DNA, 1058 bp, Homo sapiens
atgaactcacagttccacatggctggggaggcctcacagtcatggctgaaggcgaatgaggagcatagtcaggttttacgtggcagcaggcaagagagcttctgtaggggcactcccctttataaaatactataaaaatatataaaatatataatttattataaagtaaatcacccctttataagagtgatttattccctctcagaagaacagcatgagaaagaccacccccatgattcaatcacctcccaccgggttcctcccacaacacgtgggagttatggaagctacaattcaagatgaggtttgggtggggacacagccaaatcatgtcactatgaaataagactgtacccttcttttcctgtattttgcttatgtggttttggaataaagattctacagtcctcataaaatgggctagttaggttttgttctttttctattttttagaacagtttatataagacaggaattcttactgaaagtttgaatttacctgaaaaataatctaagctagatatttttaggagggaaaacttacctagttcagtgtatttaaaacctattgacataaaacaggtatttcttgtattaattttggtattttctaggaatttacctatttcatctagatttaatttaaaaaaatctagtcatttatgttttatttatttagaatttctttttattgtttagtcttattagtcttttcaaagaacaagcttttgtttttaatcttttttcttttttcttttttttttttttgagacagagtctcactgtggcccaggctggagtgtattgatgcaatcttagctcactgcagcctccacctcccaggttcaagggattctcccacctcagctcctgagtagctgggattacaggcgtgcaccacaacgcccagctaatttttgtatttttagtacagatggggtttcaccatgttggccaggctggtctcgaactcctgacctcaagtgatccacctgcctcggcttctcaaagtgctgggattataggcgtgagccactgggcctggctttttctttaat

SEQ ID NO: 79049 - DNA, 1034 bp, Homo sapiens
ggctggtctcaaactcctgacctcaagtgatccgcccatctcagcctcccaaagtgctgagattacagacgtgacccatgacacctcgctgaagccaggagtttgagaccagcctgggcaacaaagtgagaatccatctctacaaaaaataaaaacaaaccagctgggtgtggtggcatgtatctgtagtcatagctacttgagaggctgaggcagggggatcacttgagtccaggagcttgaggcttcagtgagctatgactgtaccactgcattccagcctgggaaacagagaaagaccctgtctctaaaaaataataaaataaaataaaataaaatgctttttttattttaagaaacatgcttggtgatataactcctgaattttcccaaaccccaccattttatcaaatagaaacttgtagtccctattcaatactccctgccaacctcctagacgtttttccgtaccccttccttctactcatctcttagcacagacctggagatagtactgaagattatccaccaaaaatgccatgtgatttcttaggcgccacttgattgcatcagtctggttcgacttgaggtgcttgcgctgcatttgtagggcccagcagtgctgcagctcagcttgcacccggcgcacactcagtaagtacttaaaaacaacattgtacctaggacagaaataacaggatattcaagacaaaaatttcatcccctgcacttcccccacacgacagactctaggactttgtgccacccactcctctcacaaacaggcagtaaggaaagagtgactagagatgtagacaaataaattataatttatttatacaatggaatattatatagcagtcgaatgaactccagctatacaacaagatgagaccccatctctgcattttttagataacttgggaaatttcagtgtggactggatattagattatacccttataatctttttgaatggttgactcgtgttgcttctcatattcaaaaacatgatttttgaatgaaaaaggtaa

SEQ ID NO: 79050 - DNA, 1301 bp, Homo sapiens
gatatatattaatagatgccactccagagggctggctgaaaacaaccaagaactactgtgatgggtagatgctgtccttatgtggcatagatgtatccatagggaaaagcagaataacagagcaggtcatcatcattaaatatttattgagtgcttactgtatgcaaggcactggggatacaaagaggtataattcatggctctgcccttaaggagctcacaatctagttggaaaaacaagacatatatatatatatacatacaaaaatcagtaacaacacagaggcctgaacaattgccaagtggacaacagtacagataataaagaagcaagaaacgagggttcactaaaggctatagtggggaagggagtgcttcactgagagagtgggacttgaactggtattaaaaacaagagcatcccgggcaaagggaacaacactcacagctcagaggcaggaagacactctgcgggtctaagaaatgaagagttaaatgtggctagattggaggtttggtgcagggctaagagagtaatactcgcttagccaggaaaggatgcatttgttttacgcattttgtgcgtctgaggggctggcaggccttgcacgtggcagtgtctatcctgtcagatttgggaggtcagctattaattagatcagctattaatcagactgttctcctaacactttaacttcatggatgtaccttccttcctttcctaatgccaactctgtttcccgggtaggtgtttcactgcctgaatgaaatcctagatctctgtcacagtttttgttcgctggtcagtcagaacctaggcccactggatgagcgtggagccgcccagctgagcattctcgtgaaggtgcgtctgcctggaagtatgcagccttgccgaaaggacagaggtggttttgccaatggagaattcatgatctttcctctgagtcagtaaagcatttcctcaatacacacacgtacagagataagatacaaagataaaaatgttggtatcagttgattttgaagcaggtaatactgtgccacctcacagtgctcaaaaatagttcagtcctgaatagtttattcagcccatcaaataagcattgggttgttctaacttcctcacatcctcccccctccttacttccttgaactaacccccatctcactgagataattatctgcttgtaatcaaaacgggttctccccaaccccagtacttgacaaaatacattaactggaaaccagctactaaattcctactgatgaaagagtactttcataggaagtcatgcatg

SEQ ID NO: 79051 - DNA, 1260 bp, Homo sapiens
gccgtgggcaccccgccttgctggtccctagcttccgcatctgtgaaaggaggcgaccaccccttctaactctaaactttaaaaaaaactgataccgagattcagtggtagctggcttcccagaggtctgtcattcccattcagaaaatcacttcattgtcctttctctctaaaatgtctgcaagcagatttttttctaagctattgtagcagaagagtcaaaagaaactcttcagttttaagatgacattatttagatcacaggttatcctgattcatatttctttgaaggtagtcttgggaaagcatgacacttaataaggctctttttctcttttgtagtttcgggatgtgaaaatttctggctcataaattgaaataacagccacgttcccaaggttgtaacagaagattcaaaacatcccattctagccacacacaaataaatatctgcggcttagtgataggactctaccttttctcctagaagcagttactgaacatccaggagtacaactccttcccatcattcccatgtggaagggtctctcccatcaaggagaacatgtggcatctctgatcctttacattgagaacatttgttggatatgttcatttattcaatagtcatttattgagcacctactacgtaccttggtactgttcaagctgtgggagatacagcggtaaacaaacaatatagagcagaaagttaaatattttatggttcatatgtgaaaaagtaattatgtttataaatagactaactgctggatgttaccaccaagtaagaaagcaacaggtaagataggctttctctctccctataccaagtaatttatacctacacagattgggcaattctagctaatgaaaatatacttaaaagtatttcttaggccgggcatggtggctcacacctgtaatcccagcactttgggaggccgaggcgggcggatcacctgaagtcaggagtttgagaccagcctgaccaacatgatgaaacctcgattctactaaaaatacaaaaattagccaggtgtggtggcatgtgcctgtaatcccagctactcaggaggctgagacaggagaattgcttgaacctgggaagcagacgctgcagtgagctgagattgtgccattgcattccagcccgggcaacaagagcgaaattccgtctcaaaaaaaaaaaaaaaaaaaaaaaaagtattattctccaagaaaaaggtccttaagaaaaaattgagatcaagttgttag

SEQ ID NO: 79052 - DNA, 2348 bp, Homo sapiens
ctcagagaaagtactatgtcttgtcatttgttctgagattaagctcaaaaaaacagatgaagaaatcccagttactacaaccaaagagattcaacatttattttatcataaaagttcagcaaataaaactatatacaagatccatgcaaggaatccagttacacacaagacacatttaaaacctggttaaaacacaatctccacgatagcagggaataaaaccagtaagaccaagtatctttagtgagaaacataatcgtgtttatattttggatgctgcttgaatccaattctctccccaacaatgaggcactggatcacccactcttgtgacaccacaggcagctgcaatgcttcagcacacttcagcaccgaggctgggcatgaggggtccgtcaccaccacatcaaatacccctaaagcaatatctgcaaggagcaagggaaagtgaagaaggaaaggacactcaacttagccctccattagaaagagagatttgattctaaccaatacatcccactctgcacaaaccaaagccctattatgtcaaacacactgctactgatcatgaccaaaggcagagttataatcactatgtgctgaccttgtagaaatatttaacaaatatacgtccagtgcttcacttatgttgactcacctcttgaaggtggtacttttcttctctaagaaacatggatacggtcaacctattaggcctgagccttggaccacaaggcctaacacctacaggtctaaggagatccctggaacaaagacactacacacactctttcaggtacctttgttatgggcacttgaatggtgctgcttcacagaggctgcaccaccagtcatgaggatctcagaccagagctccaggaagttctgctgttggtctgataccaagagtaccttcagattctggaaaggattttcacggggttgcctatgaaggagacaggaaaggaccttagcatgacaagtaatatccaacaaactgcctttctgcaaagggactcatgtacatctgaatgctttcaaaaataaatgccccatcagacatagtgtctcaagcctgtaatcccagcactttgggaggctgtcgtggttggatctcttgggcctgggagttcgagaccagcctgggcaatgtggtgagaccccatctctacaaaagacaacaaaaaaattagctgggtgtggtggcgagtgcctgtagtcccagcagcttgggaggctgaggtagggggatcacttcagcctgggaggttgaggctgcagtaagtcgtcactgcgccactgtactccagcctaggtgacagagcaagacttcatcttaaaaaactaagccctatattagggtcccccttctcttccttctttctatgaatgatctgtattccttgcattcctggctttctaatttccatgtttgttctggggctgagaataatccaaatcatgctcctgagcctatatatttttaatgcttgcttaaaacttagttctctgactttacaggttgagaatattgaacctatatacaaatcttcacacatttgcaaaaggttcctagccaatgtaacctagggaaataaactagataaactcctgaagtcatttcaaacccactcaaatttatcccacagacattccaatttctagaaagctttactctctcacctagattctcttccctccaaagcttgctgtcctcctgcctatacaattctggatgggcttcaaatacttaccagtccagaattctttgctcctcaaggctgtacccagctggcaacagataattacggtagttctggagctggttggcatggcaactatcatggacccagacatgagacacacaaggaatcccactggcaaggcacaggaagtacttccgggttcgacaatgctgatccgcaattagaagacactggtaagctgtgttacactgcaagaaaagaagcagagccaatgggtttggtgacttctgtggaaagctcctaagcagcagccataatgagccatgaagagcagatctgaagactcccaactactacccaaaatgtgatttagtctatcctgcccaaggccactcttctcactggaaggcccaagtaatttccatagatgttctctctgcctcacctgcagcatactgaggacctaaatcctcaacggacaaccaaaacctatgaactcagcctttcaggctaaaaatcagcaaccctaataggggtttctactactaaacataaacatcaatcttcttttgtcccagcaacagaaccatagccattaactaacccaaggtcctaccttctcttccctatacacaacaaaaa

SEQ ID NO: 79053 - DNA, 1049 bp, Homo sapiens
ttaatggctatggttctgttgctgggacaaaagaagattgatgtttatgtttagtagtagaaacccctattagggttgctgatttttagcctgaaaggctgagttcataggttttggttgtccgttgaggatttaggtcctcagtatgctgcaggtgaggcagagagaacatctatggaaattacttgggccttccagtgagaagagtggccttgggcaggatagactaaatcacattttgggtagtagttgggagtcttcagatctgctcttcatggctcattatggctgctgcttaggagctttccacagaagtcaccaaacccattggctctgcttcttttcttgcagtgtaacacagcttaccagtgtcttctaattgcggatcagcattgtcgaacccggaagtacttcctgtgccttgccagtgggattccttgtgtgtctcatgtctgggtccatgatagttgccatgccaaccagctccagaactaccgtaattatctgttgccagctgggtacagccttgaggagcaaagaattctggactggtaagtatttgaagcccatccagaattgtataggcaggaggacagcaagctttggagggaagagaatctaggtgagagagtaaagctttctagaaattggaatgtctgtgggataaatttgagtgggtttgaaatgacttcaggagtttatctagtttatttccctaggttacattggctaggaaccttttgcaaatgtgtgaagatttgtatataggttcaatattctcaacctgtaaagtcagagaactaagttttaagcaagcattaaaaatatataggctcaggagcatgatttggattattctcagccccagaacaaacatggaaattagaaagccaggaatgcaaggaatacagatcattcatagaaagaaggaagagaagggggaccctaatatagggcttagttttttaagatgaagtcttgctctgtcacctaggctggagtacagtggcgcagtgacgacttactgcagcctcaacctcccaggctga

SEQ ID NO: 79054 - DNA, 1891 bp, Homo sapiens
tccctgtgtctgaaggatctctgatggtgtgccacccaacaagattaggtaccaaacttattaataaatatatctcataagatgaatttaaatattttactgagctcctgttgtaagctggtgtctaagaattcctatttatctgtaacatctaccaaacagtttcttaaaaactataattctgtagaggattgttttagtattagatgtcttccgccttcttgagattgagaaacccccaagcattctcatacactgaaaatatcaaggattctggtactgttgggctgcgcccaaggatgaaggcaccaacataaagacacattcaccataaccacactgtctatcagaaacctgaagatcccttcaaaaacactgtccaaatgcctcattttatttttatgagtacagttttattacatctcacgcaggcacacggattttaatgaaactggacagcctgcatctcataccagtcagctttcttgactatgctgaaccaagcaacaaacaaaacatctatacagctgccttgtgaagtcctggtttcaagtccagcaatattgtaaaagggggaaaaaaaaacccatgaccatgaccactgttttaatgccatgacacacctctatgcagaatcctcaaaagactcccaattttcctgtccaggaaactcttcaaataccttattcccactgtgcctatctgattgtttgacaagctaggtgttgcaaacactggaccttgaaatcccaccacaccacatctactcactcccacagcccaactctcccaaaccaaagcctgcccctgatcatcccttccatgtccttgtacatatctacacatggctgcagtcggtgagatatagttttggttaattaggaaagagtcatccacacacctgaaatgccaaccctcacagatgtccagtggtgcaaattatgacaaccatgttgcctaattcaattccctcttgcaagacaacattagtcagaactctaacttgtacaacatcattccatctggacctttagcctttacagacacattcagatactgctgtcagtcacatttacagtgtatacatttatatctgctcattccctctcctagatcactcatttttcagacctctacccactgcagccttccttcaaaaactaacagacaacacagaaataaatgcaatgtacagatttaatttaaggttaaagagaggtataagagttgaaaaggcctagaagctgtttctttgcaatcaccctgaggaaccaggcaccccacagtcccagtcttagacctcaggagaatgaaccttaccctccacatgggtttgctctagcagatgcccatagaacgcaaatggggaagatggcagggcattcagacctgattgacttggatggttgcagtaggctaaaatgacagagctctagtcacaggtttgtcattattgtggacaaaaaaaacacaattatttaacctttaacctctccaaacttgtttcctcatccataaaatagataagatctatctcccatctgcctcacaggattgttttcaggaaccactcactgagaggaattttgtgaaaacagtctagaaactgttaaaaagcaggatacagagtaatttctgtgaccaagatcccagttgctacttgccttgcctcctctacatacaacagggggaccaccagctcataagtgactggaaaagaaagaagtgcctatgtgtcagagctcccagggcttcctaaggccttaccctcctcttcttcactgcttcctgtaggaccatctggcagtttggagcggctggccaacttgtcactggttgtggccatggtaaggagaaatgcgtagcccagaaacaaggtcttgttgagagg

SEQ ID NO: 79055 - DNA, 1453 bp, Homo sapiens
aaattctgctcccctctctcttgtgcttaggccctctagctttctcagacttcctattgaaacatggctgggcatggtggctcacacctgtagtcccagcactttgggaggccgaggttgggggatcacttgaggtcaggagttcaagaccagcctggccaacctggcaaaaccccatctctactaaaaatacaaaaaaagtagctatgagtggtggcacatgcctgtagtcccagcttctccggaggctgaggcagtagaatcatttgaacctgggaggcagaggttgcagtgagccgagatcacgccacggcactccatcctgggtgacagagtgagactccatcaaaaaaaaaaaaagtcatatttcagtatgctcttccctctccccattatccccgaaacaacccctttccagtccctagcattcaataattaagaaaggagttcattccatctgttgttcattgagtccctactgtgacccaggcccagctgctatgggttcaggagattacagaggtaaaatcagtctattcccttttggaactttctcaggctagcaaactgatgaaactccattgattgttacattgtcctggcaccagagcttcttttgtttcctatgtatttgaattgtgtcatctccttatctacccaactgctgctgtgtttcagggtatttaaaaacaatagttcattgaatatttactgtatgaggcatagcactcagtacttcacacataatacctcacatacaatccttatgaagtataggtgctagaaggagttttccagttgaagactttgaggcacagaaaagttggctaactttcccaagatgacaaagtaagccaggattcaaactttggtggtcttcacttctaattccagcctcgttcatataacgtcatattgcctctgagactgttttcttgctcctggttttattttagggaggcatgcatgacctgtctgtcatcttagcctcctaatgaacctacgattcagcttctccaggtcaggtatctgttttttttctcaaggacttattgggggcactcttggcatgggtgttctggctggctggttcacttacttacccaggtgttgaaaactaattcagttgaggcaggctattttgatgtggcaccatctatgtgtaaaaacactttattaccaagtattctctgcaccattctggtgacggtcagtgatggggtgggaggatctatctacaaggggcatttcttgataataaaaaagtgttgggtttttttttttttccaaaggctgcttcaaaatatctcataccctgggggaaatcagagcacgggacagagaaagtgggctgaagatttccaaacatttttcactctcacctactatttctttgtattagaaccacctctttcttcagatgacctcagaagtatttggtgtggctatatga

SEQ ID NO: 79056 - DNA, 1338 bp, Homo sapiens
tgtattgtatatgtgtgtgggggtgggggggtgtgtatctatagctatagtatgtgtgtgtgttgtaaattgtttattcattgataggaagaagtgttctttttcacaggcttagtaatgggtcctgcccaagatcacacagcttggtggcagcagaattaggcctaggctcagttctcctgaattatagcttagtttccttttacatcccacattttgttccttttaacataaaggccttatcaggttttgaatcagagcaggaaagtagataatagagaggaagattaggtaggagaggcaggatctgttttttcctttctttgctctctaattttgctacacacacagagagaaaacacacacatgctgtctctcttagaatgatgtcatttttcacctacagcttaactcaagacttactactcagcctcccagggaaccaagaaggaaatgtttagaagttataatggaattgttaggaaaccacatgccatttcacttcacggaaatcatttgaaccaccagcaatccacaatggctgtctttgggaagctttattttataactaaaggctaccttctgtcaagaaactttccttgtcctaatcccagtgtagtagctacatatatcctaagtgttactgtttgggattgacaactggaattttgttaagtcctaacttcagtccactgttggatctctaaattccctaactcaggcctgctttacagagcccttgtgagagggtgctaaggagcctaagacaacagcaagcttcttttatgctttccaccccccaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttaggtaagacttttgcttcctgaacagctgcttttgggctcctgttctgcttacagtgggaggagattctggacctgtcagtaatgtttccctaacttttattattcctatgtgtggcttctcagatggtggatgagctgtcattttctagagctgctgccttacctgtttccttcttagtaccaaacagaaagtccttagggtttttctggcctcctcagttctataggggactaaacacatttcagtcatggcaaagactagataaaaaatatggccttaaaaagaagcttcttggcctcatgggaagtgggggaaggaacactgtggtgtctgaatcagggtc

SEQ ID NO: 79057 - DNA, 3026 bp, Homo sapiens
cccatcccgctggacactgaagtgacggccctctcggaggatgagtatttcagtgcaggtaatgaaagaagcagagtttgtagagatttttttgtgccttggggcaataatactctgttatgttagtagttaccaagacattacttggtacttttccagtgtctctaaagtcagaaatttcattcctacaaaattggttactcttgccactgacttttctgtttgttcatttgtttttgaataaacttattttggaatattttagatgatttacagaaaatttgcgaagtacaaagtactgctagtacagagagttcctgtatacccctcatccagctttccctattgttgacatctggtgttagtatgggacgtttgtcaaaactaaaaatccaaccttggtgtattactattcacaaaactttagactttatttggatttcactagcttttccatcatgtcctttttctcttccagcatccaacattgcatttagtcatcacataccctttggtctgctctgatttgtggcaatttctcagtcttttgtttttcatgaccttgacagttttggggagtcctggtcaggtattttgtggaatgtccctccatttggatttgtctaatattttctcattagactggagttatgggatattttaaaaataatgccacatagatgggtgggtgtggtagctcatgcctgtaattccagcactttgggaggccaaagcagggggatcacttgaggtcaggagtttgagaccaggctgaaacatagtgagaccctgtctctcaaaaaaaaaaaaaaaaaaaaaaaaaaaaggaacataaattagctgggcatgggggcacatgcttgttgtcgtagctactcaggaggatgaggcaggcggattgcttaagctcaggagtttgagtccacagtgagctatgatcatgacactgcactccagcctgggaaacagtgagaccctgtctcttaaaaaaaaatatgccacagaggtgaaatgcccttctcatgttatcatataaggacctgggaaggtttgtgatgtatccacatgacatcactgatgcaggatgttaatcttcatcactggttaaggttgtatttgccagatttcttcacttttttttgaaacagtctcactcactctgtttcccaggctagagtgcagtggcgcaatctaggctcactgcaacctctagcttccgggtacaagtgagtctcctgcctcagtctcctgagtagctaggattacaggtgtgccccaccagacccggctaatttttgtatttttagtggggatggcatttcgccatattggccaggctggtctcaaactcctgagctcaggtgatctacctgccttggcctcccaaaatgctgggtttgcaggcgtgagccactgcaagagagggacaggtggccttctctaaagttagtgtttttccctttccatactctcttcttttttaaagcttagctacctgctttgattggaacccagtaggtgatattgagatatttttgcttagggagaagtttttagtgctgtgtctgtatgactgcacatctaccacttattctctggtttgaagaacagtgcctttttatttttgaagtaggtaatattggtgatagtgagaggtttatgcttgtggttatgcttgttgttattgtttcatgtgctagttctttgaatatattgtctcctttctatggaaataatttgaagatacctatttgtgttgagtttgtcatttaaaaacatctttctgaggactttttgaacatggattggcatataatgggggaaaatggctttctttctatctttttttttttttttgagacacagtttcactctgcctcctagactggagtgcagtgagtggcgtgatcttggctcactgcaacctctgcctcctgggttcaagtgtttctcgtgcctcagcctcccgagtagctgggtttacaggcacgcaccaccacacctggctaatttttttttgtgtttttcgtagagatggggtttcgccacattggccaggctggtctcgaactcccaacctcaacttatctgcctgcctcagcctcccaaagtgctgggattacagacgtgagccaccatgcccagccaaaaaatggatttttttttttttttttttttttttaaaaacagagccttgctctgtcgcccaggctggagtgcaatggcacgatcttggctcactgcaacctccgcctctggtgttcaagtgattctcttgcctcagcctcccaagtagctgggattacaggtgcatgccacaacacctggttaatctttgtatttttagtagagacagggctttgccatcttggtcaggctggtcttgaattcctgacctcaagccatccacccgccccagcctcccaaagtgctgggattacagtagtgagccactgctcccggctggaaaaatggctttctgttggagtccatccaggcttctcttgtatttggaatcctctgagtaattgttgtttgccctttgttcattattaaatgggccacttcaccttctagttctggataacattgttagctatatatgggatcagttgggagtagcacatggattggggtcttttattgtgactcatagtttgtatgtatcaaatgcattcgttcttctttcaggtgtaaagctactcttaggggttcatatttggccttttaaagacggagttctgtaacaagagtgaactgtggcatcaaggtgtggggattctgtgtcccatttcttgaggctgtttgctcatgtcaacactagactacttctagttctagtagctcttcattagtgtgaagtatattgttggccttgggcttctttgtgtttttgagggagtctttgtgacttagtttggggatagagatttaagctaggagatgaacaagtaagggaaaagggagtgattccacaggatagatagagaaccaaggcttgctttctctgtgttattttccttggg

SEQ ID NO: 79058 - DNA, 1044 bp, Homo sapiens
acatgtcaggaaaaaaatgcagaattaccattattgcatttgtatatgtaattctttttaaagacttggctactttgatactgaatgctgaaagtaaaatcagcctaccataggggagataaggtgagagacaaaagtgtgcattttctcttcagaattacggagttagtggggtgtaggagggaggataaagatgtgaaaaaatgtgatatagttgttattagaaaacatgtattttttcagaaatgcaggactgaaattctagcacttttttttagccacaggcaggtcctaggtaataaaggccgaaagtctcaaactaactaatgattcgaggtggtaaatagggctttaagacctaatttgctaagaagttatcttttaaaaattattcagatctgactaaaatatgaactcgggctgtctgtaaatagaaaattatgaacaagaaataatgaagctggatgctatgttagttaactcagttattcttttgaatagcagtagttgttattagtttgttgtatttttgtaaataagaaatagtgcatttgaattttttcagtgttgaatgagttttacctgtcctgaattttccagcagttatttgtctagtatagtacctggcacccttaagttattcgataaatatttgcttaatgttttttgaatgaaagaagctcaatcctcctaagtaatattatttaatagttatcataaaaagtagggtcttatttagccctacattattcttgtagtagaactagatataaaatcttaatttgctaatttttccatttctggacactagctcaactctttagtcataatctgttctttggaatagatgaaatattttatatttaattctaggagagatcagtgtatattgttttaggtaataaactgtggttttcactttaatacaggaaaaacagataaactgagattaacagatacatcattctggttttatataaaggactaaagagtgccttccttttatctaaagagctattgcaaatgtaaactcgtttactaatt

SEQ ID NO: 79059 - DNA, 1280 bp, Homo sapiens
acgctactgccctccagcttgggtgatagagtgagactgtctcaaaataaagaaataaataaataaaattacaagaaatgtttgtatgtttatacttactagttttacttatttttatttctttttgttattttttgcaaatactagtagagcagagtgaaggtttaggtgtgatactaactaaattctgtttctctttcctttctctccttggttttgtttttattcagagcctgcaactggtgaaagaaaaaatggatctactgctgttgctgagtctgttgccaggtaaccaaagctggatgctatttagagtttaatacacagctactggtgatgagggtagatggtttatcaacaaaggaaaaaagttaaaatgagaaagttaaaatgagactctttcataaaggatttagcaatgttttgaatggatcatagactttttagttaatacttttttaagttcagtgaagcttttttctacacctagaactaagataattgaaatgtctttacttttgttcatgtgagagttcctttccccccttttttctgttgctgatacaagagtctccacaatctcaggattgttgatccaattgatgagaaaaagaaggattaacaagagatagctacagaccttgttccttctgcaatcgcatactcagctgcagcctcaggtcattttctcttctgcctgccaaattaactactatgttgagctgttatttttgctttgtcatggatgttgtaatgctttgaggacgagtatgaccccatactgaggttttggttggtaagctttgccatctggtggctgtgagaatacaattgtttcaggcatgagtcatccagcctgaaaacgctaatagcagttggtgaaacataggcaagaattcttcttttattttcttttttattttttgagacagaatcttgctctgttgcccaggctggagtgcggtggtgagatcatggctcactgtgacctcaacatcctgacctccagctatcctcctgcctcagccacctgagtagctggggctacaggcatgtaccacctcatctggctaatttttgtattttttgtagagatgaggattttactatgttgcccaggctggccttgaactcctgggctcaagtgatccacctgccttgacttcccaaagtgctaggattacagatgtgagctaccatgccccaccaagaattcttaaattagaggctaggcgggtactgttaataactaaagtggctaggtacaagacagagtgttt

SEQ ID NO: 79060 - DNA, 1048 bp, Homo sapiens
ataaaaattttaaaaagggtttgtcaagagagagagtatgtgatagccttaaatcttactttacctttggatctgaaattacaactagcgaagtgttaaggatggttatatcagtaaattttactacctttcctaataccaggagcatagtatcaaggactgtattcagtgttacttacatcatttcatccttacaacaaactttttaggtttgttgtgtttttatcttatagaggaggacactgagactcaaaatgacaaagtagtttactcctaggttggactattaagtgcaatagccagggtgtgagccaggtttctatttcagagccagggctccaactgaatttcagctgcctccctgatggactgtttagattatgttgggtcatgaatattttagaaataattaaaaaccatttaagggttgttttctctaaggctggtataaattgtaaatgaacaaattttaatcccttgaaattagtgacattgttgtgagaatatgggatttttttcagtacgacctttaatctgttgctgcatgttcttgaaaatgtcctttttgtttctttttgttgttattgttgttgagacagggcttctccctgtcacccaggctggagtgcaatggggtgatctcagctcactgcagcctccatctcccaggctcaagcgatcctcccatcttagccccctgagtaggtgggactacaggcacgcccaccacccatgcctggttaatttttgtatttattatagagatggggcttcgccatgttagccaggctggtgttgaactcctgggctcaagcgatcctcctgccttggcctctcaaagtattgggattacatgagtgagccaccgtgcctggccaccctttgtttttgaagtgtctgtcctaaagcactttgggaagaacttgggtaccttctatttgtgggtgctctaaaaactatttaaaattagttcatcaacctaaaatattttctacttattttattaagttcttttatttttaatttgtttttaatatgatataaattt

SEQ ID NO: 79061 - DNA, 1017 bp, Homo sapiens
caaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtggtgagtgtgattgtagattattcttgtctccacctaaattataatctggaatggaaagttggcgagaactgcatgcttatgtcaggagtgaacactatctttggtttatgtttatgaacaaccaataataattgggaaattaaattttttggattgcctttttttttttttgagacagagtcccgctctgttgcccaggctggagtacagtggtgcagtctcagctccctgcaacctccacctcccgggttcaagtgatttctcgtgcctcagcctcccaagtagctgggactataggctcatgccactatctggctaatttttgtgtatttttagta

SEQ ID NO: 79062 - DNA, 1031 bp, Homo sapiens
tggaaatgagatggtgaagaatagctaatacagtaaatttagtattatggatactagccattttctttttttcttttttttttttttgagatggagtctcactctgtcacccaggctggagtgcagtggcgcaatctcggctcactgcaagctccgcctcccgggatcatgccattctcctgcctcagcctccctagtagctgggactacaggcacccgccaccatgcttggctaattttttgtatttttagtagagatggggtttcactgtgttagccatgatggtcttgatctcctgaccttgtgatccgcctgccttggcctcccacagtgctgggcttacaggcatgagtcaccacacctggctgccattttctgttacatggctactatgtcttcaaatcttcaatatgatattaagcctaggtttttcatattcatctgggtaacagtttactaacttaatctgtttattagttaatctgacacagataggaatttaaaatctagcggaaaggacataaaacttaaaaggatataatttgtttcacacctctttaacctccaccaatctttcattccacagcctcagagagctagaaagcttgagttaattaccagcaaaacatattatgttggttgtaaggcgggaagggaagaaggctatcttcctttgctatgctgtgatacaggttgctgtgcaagacattcagagggtcaccgaggaacctttgttggtctcttactaaagttgtaaggttttatttaagaaattcttttacactgggattaatatagttgatactccatctattgctaaggggaagggaccaacaagagactcttcatagtataaaacagtaatggctgctcataaatccttttactcctttgagcaggcccaaatcttgaaaactgctgcatttataacatcaagtgtcatgtgcatttttttgacttctcccatctgtatcatggcatgagcttgacttcacctaaggtagacgttggaataaaaggctcatttgct

SEQ ID NO: 79063 - DNA, 1689 bp, Homo sapiens
agtggacaaagagcagctacaatcagtaaccaccaactctggttataccaggctgtctgatgtggatgctaatactggtatgaaacatgttttctggcatttggagttgttgtgttttctcccatattagaggtagttattttttctttgataagttttgcagctatccaaattaatataatctaagtaatttagtaaggttgaagagttttctggtaaatacttgtcaattgttggtttgtgggctgaggttttaagttattggttactttcctttatagactgatgcctgtatatattttaaattggacttctgttaaaatctttgctttttaaaaaacatctgggactgtatctagtattttgaaaacttaattatctccttcctgtcattttataaaactctcagcaattaagcatgaagaacagtccaacgaagatatccccatagcagaacagtccagcaaggacatccctgtgacagcacagcccagtaaggatgtacatgttgtaaaagagcaaaatccaccacctgcaaggtaagccgaactttctaaaaaggatttacgagttttgctgtagggttatactaatgtcattttaccagatgaaaacatttttagaaattgttgatttttaaattattttccccttgtactgggcatacttgtggtccattggaaacgttgattatttatgaagtctcaagaattgttttttgtctgtctgtctgtctgtctgtttgaaacaaagtctcactatgttgccctgggctcatgtgattctctgccccagcctcccaagtactggggccacacttgactactaatcttatctttaggcattctacaaagacctttttttgttgattaaaaaaatttttttgttgtagaaatggagtctcgctatgttgctcaagctggtctcgaactcctgggctcaagtaatcctcctgcctcagcttcccaaagtgctgggattataggcgtgagccactctgcctagcctgcaatgatgttttaaggctgctctaactataagcatgactccgtaatctttggttgccactcctcctttgtgatctttgtctacagagacactgcttgtctgtgggaggtcttcttagcctctctggtgttatgaagagtaacatgactattttatttgaaagcctactgtttctatacttgaggagcacccagattgctttgggttcttaggtatcctgcatctggtattttatggtatcgatagatgtagggattttctcaggttctttaggctcttaacttggtaggaattggggaatgtgcctctgcttcatctctcgtgatttttataaccaaagcttcattacctctggccagtaagtgaagtttgaatatggcagaagaaaactgggatgcttccagtttgggataggggataaataaacagtattgttttgttatttccttcaatggaaagagtggggagagagtgtcctaagcaaagttgaatatcaagagaaattgtctttctaatgtaaaacactcagcataacagtgactttttaggcttttcttttagatgctgccttccatctagttatgctattctgtttaccctggggagtggtagaacaggtgaacctcataagtctctggaaaggggccagggatgaatgtcttatacatgttagtattgatc

SEQ ID NO: 79064 - DNA, 1107 bp, Homo sapiens
gctgagattgtaccagtgtactttatctagcctgagtgacagagtgagactccgtctcagcaaaaaaaaaaaaaaaatttaggagtattatcagaactattaggcatgttttccatctatcaactgaagtaccccaccagttttagatctagaatgtttaattcttaccctaaacaagattcaattgttaccatgtcttttgcatatctttataatacccattttttgagttcatgctctgtgttaggtcctgtattggacgtttggcatatagtataatgttatttaatcctattcttaaagcagctgtacgatgaagacattacattacttccattgtatagacgggaaaattgatggacaaagaaattagataacttgctttagagtacattgctagtaagtggcagagctggctttgaacctggtcctaatgactctaatgcctcctctttcattctaactaatcagtgcttctcagtcttccgccccaatatttctaaggtccaaggagaatgtagagaacttcaggagttttggggtggtagaaaggggaggtggttagagaggagaatgttagcttgagatggttaaagactattgttttttcttaaaaagaaatggtttttggctgggcgcagtggctcacacctgtaatcccagcactttaggaggctcagacaagaggatcacttgagcccaggagtttgagatcagcctgggcaacctagtgagaccctgtctctacaaaagaaaaaaaaaaaggactgggtgtggtagctcacacctgtaatcccagcacttcgggaggctgaggtgggcggatcacctgaggtcaggagtttgataccagtctggacaacgtggtgaaacccggtctcttaaaaatacaaaaattaacgaggtgtggtagcgggtacctgtaataccagccactcaggaggctgcatcaggagaatcacttgaacctgggaagcagaggttgcagtgagccgaaattgtgccactgcactctagcctgggtgacagagcgagactctgtctcaaaataaaataaaataataaaaaaaaaaatagcagggcatggtggtccgtgcctgtagcccc

SEQ ID NO: 79065 - DNA, 1149 bp, Homo sapiens
tatagtagtcacctttccttaattatctctcctccttttccactgctcctaactgccaaatctttgatcacttcctgatcactgatacttatagatgctgctaggaagttggagaaaataaggctaatatgactaaagctccattagcctaggaatatatacagcaattttatattaatatatgtgaggctgacatcttcctgatgtgactggcttcctgtaaagcaggctactcactcttttgagaatgtttctgtttagaattactcatgtcatggcttcctccatttatccctaatgatgaaaatcggcagttttaccacttagtactcctaggagctttggtgaaaggccagatacagggatgacagaggatgaaattaatgactgaacagaagtttggggattatctgctgatgttaataattcacactgaatgctctaaccttgtccttttggctacagagacttgagagtaggctgctttctggaataatgtaagaaatgaaaagaagttaaaccaaagtacttagccattcttcagattaagatgcagcgatacttgggaagacacttacagagagaacatagttattctcaggcacttcttagaaatgagcattgatatataaacacctactaggccctttccatcaaagagtttgtctgtggtgtcctcaaggagcttagggccatgtaccctagatcagagcttactttggcatactgcatatttttaggtttggacatttttatcatggtctgtctatgtcacaggagaatagtagagaatttcctggaaaaacccacacagctcaagacagccacagccccacccctgctggctcctctttcagctgtccccacaaacaacagtcagcccagagcagctgcagacactgcccctccctccagccttctgttagtgaggacgcaaaggggaccaggcagctgggatgagctcaaggggatatgctagtgccttatggcttgactaccccacaggctgggccaccattcctatcacctatcctcaagccctgggccaaaatgctgagaaagcagacaaaaatgtatcctacagtgacaaggagagtgcacttattcctaggcactgccccctccacattgacatacccacacacagaa

SEQ ID NO: 79066 - DNA, 1481 bp, Homo sapiens
tgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatcc

SEQ ID NO: 79067 - DNA, 1079 bp, Homo sapiens
gccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccaga

SEQ ID NO: 79068 - DNA, 1051 bp, Homo sapiens
ttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgcagatagtgtagtgctgcttaggctttttctgactccatacatgcttagttactgggccctggcttctacctctctgcttcaaccagtattgaatttatcttggaagactccaatgcttttgattactggaaacacttgtgcctgagtatgaagaataggagcctagggtggatacatacatctggtctgggggagggaagaggggcagaaggcctcctgggaaggggatatgcattccgtggggtcaagagttgaggaccaaataaccaggatcag

SEQ ID NO: 79069 - DNA, 1044 bp, Homo sapiens
agtttttaagtgtagtttccatgtggcaccagcctacctatgataaagctattgcagagaagtttgaagagtggagatgtctgctggggattctgggggagcttaggaaggaataatattttaagaacattgaagaactgggtctgcccacactaaggtgggagagcttggagatctctgtaaaccataaattgaagggtatggtctctttgtagggtatagcaggagaacccaggctcactctctttcaaagttttatccttggtatccttatttgtctctctgtattatattttgtcttcagggtaaatctaggttttttaggtatggttttcttctattcaagagctaagactctctgagggaagtaaaactaggctggcttcctgactagaaaacctctacgtgctaatctcctattggctagcaagtgacagctgctagattttagcccagtcaggttgtacatcttcacaaggcactgctgaaatctctccctaggttgaccagcctatgctggctcagtttatccctgcccccaggctcccaattgtgcctgtggcaggagttcccgttcagagcctcatgggtgtgccggctcatttagcttcaagctcttctggccttcatgtgccacagccatctccagaatagaacctgatgcatgaatagcatagcctgggacttggacttagggtccacaatatagtacaaggaacgtgggctcctgaaatcagagctaaatcacgtatctcctagttcttaagtgccatgagaaaagacccaagtccattaaacagaccctcagacgtatgtacctccaattccccgaagtactgttcagcagcctcacccgttgaagaagatttaattctgctaaaaggagttgaggaaaaaagagctggaaaatgcaggtgttgtgcaggaaaacaaatttaagatctccaatgccctgcacacttcctcaggggccttgtggcctcctttgtttttcttgtgctggagcttggaggctaacatgcttaagaagccagaatctgggct

SEQ ID NO: 79070 - DNA, 1049 bp, Homo sapiens
aggatgcgccctttggccctgaggactacgatcaggtcaggctcaaaaatagcctggatccccaattcctagaattctaaatagtagggatcaataataacagtatttactgcatgccaggcactgttttagttattttacacatatattatttaatccttacagcaaccctttgagataagtacaggtccacaatctcttatgcataattttgaaaattaaaaagatttttttcttgacattgagattcatttggcagctaaacctgacacgaactgtcataagacttttataatccttagttttcccacttagtgtaaatagtcgtgcattttgtggcagaaatattaatgtgtttggttatgccatgggccctgatggaggtattatatacatatggcatatgtactgtattaacttctaaagtcccacagattctcagttccaaagcacagctctgatcccaaggatcctgaacaaaagaacgtttcagttatccattgttgcataataaactaccccaaaacgtagtaacctaaaacagcaaccattttattatctctcacagttctgggctcatctgatcttgcttggagtctctcctgaaattgcagtcagatattgactggagctggaaccatctggaagttcagctgggactgtgggatggctggctctctccctcttcatgctctccctgtaacctcagtgcctcttttctccacatggttcttcatatggtttccgtagcatgatagccagaagtattaaatggtagctttagggatattcaaaagcagaagcttagaagctttcttaaagtgtaggcccagaaatagcacaacataactttgttattttttattggttaaacagttacagggccagccagatttaagggaagggaaggaaaggaagacaaagaattgatggtcatctttaaagcactacaaggactgtagaccacaaggactttcctcccattttacagatgaggaaacctaggctcagaagaatctaagcaattttcctcatgtcatccagctaat

SEQ ID NO: 79071 - DNA, 1028 bp, Homo sapiens
ggcagctgagctctctcattcctctgcctttgaattaaattactgaattcaacactactgtgaggaggtggaaaagggctaggaacattgtgaaatgagtccaaagtttgaaatgtcactctaaccttctcttctggtaggactcaagagtagccttcctcgaggacctgcctttcccatttgctgcctgaagttaatgtttcttgctggccaaatcagggacatgccggcattgtaagggctgattatctgatcctcttactaatttattggttggggtggggtgagcagggaggaaaagggataccttgcttttcttttatggctcttttagcatctcaagtcatagcccatatgcctcctttcttgttgatccttcttcctatagctttgttttgtttccccttatagttccctcttatgcttttcatctccatccccagccccacccacagccagggggcttgggttctgagctgatggggtacccccctctgcagagcgggatgagtgggtgttccggcagggatgtggtcattgacggccagtgagggcgagagtaccacggcccacttcttccttggagctggagatgaggggctgggcacccgtggaataggcatgaggccagaagagagtgacagcgagctccttgaggatgaggaggatgaagtggtaagaatggggaaaatgatgtaacttggggttggagcctctgtcctaaagagttaagattctattggttagagatacctctctgttctttccgaatgcatagactccctgtcataaacaggccctatcctagtttaggggaggggcagtagagattggtaggttgcctctcttagaaatccctgccctggccgggcgtgggtaatcccagcactttggaaggccaaggcggccagatcatttgaggtcaggaattcaaaagcagcctgtccaacatggtgaaaccctgtctctactaaaaatacaaaaattagctgggtgtggtggtgggcgcctgtaatcccagctactcg

SEQ ID NO: 79072 - DNA, 1212 bp, Homo sapiens
tcacccttgcacacccacagggtagacggatcgagtttcagcttaaaccgaggggtgtgggggaagggtgttgggttcagctagtccacgtgggtgctgtcctccacttggtgctgaaatctgggcggccacatccccggggcgggagggggctacatccccggctttagacgcgcgagtctcaggtcccgctaattacctggcgggtgctgcccacccctgccctcgcgcacctagcgcggtggcaggcgggaaggcggggcctgggggagccccacccctggagactgcggctggggcctccctctcctccgcccgcccgcctgccactagctcattgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgaggtaacagtgcctgaggcgcgggaggaggcgggggcaggaggtgatgggaacgaaggtgcgggtagaagtgagaatccgggcaacagagaagggctataatcacgaaggccctggagctggagggctgtgcagtctgcagacctcagtggggtgggggtgggggccaaaaccataaagcaagaacattcctggggacctgccaagaccagctctggccctacgagttctagctgcactggctgcccaaatccctaattgtaaagccaggaactatccttttcgctcccctccatctccttccctcatttcctcaattcctctccttaggcttttcccctcctccatccgtagtgttgtgtcatgggaggaaagaactgagcagatctgaagaaactgagctggccagccagaggcaactagaactattaggaaagcatagactctgaaagtccctaaagagattaccaaggtttaccctctttctaattccccctcctcccgcggagcaaagccagacatggccaactggacagct

SEQ ID NO: 79073 - DNA, 1048 bp, Homo sapiens
aggagaatttaggctgggtgcggtggctcacacctataatcctagcactttgggaggctgagactggcagatcaccttaggtcaggagttcgagaccagcctggccaacatgacaaaaccccatctctactaaaaatacacaaattagctgggcgtggtggtgcatgcctataatcccagctactcgggaggctgaggcaggagaatctcttgaacccaggaggtggaggttgcagtgagcctagatcgcgccactgcactccagcctgggcaacagagtgagactgcatctaataaaaacaacaacaaaaaaaaacttcaaactatagaatgattagctaaaaactgagtatggtagaaaaggagccaaaatcagaacaaactacaaagaaatgctttatgtttctttaaaagtaagaatggtaccatttttgaaaggtttaggtctctgcttctgtctattcacatgtctttttctttagggacctcccgaattccctggtaacagtgttcattctcttcaccttggatcattggtatgcactgcttcaggacgtctggaaggtgcctgaagtcagtcgcatcttcagcagcatctatttcatcctttggttgttgcttggctccattatctttcgaagtatcatagtagccatgatgggtaagcatagaggaggtgaaacttgtttgggaagtgtggttgggaaaaagttattctgaaagctgggattggtggcttatgggtataaagaacctagtgtagcaggaaggcttgggttctggattggatatttcacttggattctccccacccaagccctcttcccaagtctagtcattaccatctcccagctcctaatggccctttggggcagttactaactttcagaatatcaggaaagagctgaatgaggagatggcgcgtcgggaggttcagctcaaagctgacatgttcaagcggcagatcatccagaggtctgcttctcccttttcaaccccaactttccttctcaagggtttcctgagctcatttcttgtttctacttct

SEQ ID NO: 79074 - DNA, 1209 bp, Homo sapiens
cccgtcccaagtgtgtccactccaacactccttcgggggctagctccttctctcctccattctcgcttctgggcctcacctcagcccaggttctcttcgcccactcagtcctgacttcacgcttccacctccagctcaggcgccccctgagcccggctacccctacgcaggacgagctcagggccggctcccagcctcactgcgccccatttcccgccccgcccgacccccaggtttcggctcaccccgggacccggccctagcccctgcccccagcccaggaccgggcccagccacgctcgcccagacactcgccgcctcggccccgccccgcgctccggccactcggcggtaacgagttggtcccgcccgcccgacgaaggcgacgcgcagccaatcagcggctgccacacagcggcccaagccgggtttgggggttgggacctccggctgcaggtccgcctgggccagacgcgcgagcgcaagcagcgggttagtggtcgcgcgcccgacctccgcagtcccagccgagccgcgacccttccggccgtccccaccccacctcgccgccatgcgcctccgccgcctagcgctgttcccgggtgtggcgctgcttcttgccgcggcccgcctcgccgctgcctccgacgtgctagaactcacggacgacaacttcgagagtcgcatctccgacacgggctctgcgggcctcatgctcgtcgagttcttcgccccctggtgagtccattctgccgaggcgggggaagaaaggcggggctgggccgggggcgagagcgcggggaactgttgggcctacgcagcgccggggcccttcattcctgtgggcccctgctgcggcgggcacatttctcattcccgggagctggaggcgcctcgccgagagcgggggagtcggtgctgatcggcccaaggaaaacccgaaggctgcgctcacgcagggcctcatccttatctcggtgctcttgtggcacttcctatttgcagagggttttgccaccccttcccccagtccaatatgtagctatatcttttctgcgtgagtcagtattaatgctcctccagtctacagactaggcatcccaaagccttgtagtggaagcggacgtttcaccaaatgcagaagtcctggatccctagggtatttcctttcatcttacctcacgccgcacagccattggtttctagcca

SEQ ID NO: 79075 - DNA, 1075 bp, Homo sapiens
ggtacgtgtacaggtgttggtacctttgataatagctctagatgatttgcaaaatcaaattacattacacctaaaggatatgtaccaccatcgatatatccccttggtgatagtcgtaatcaaagtaagccactgttaataatttaagtgatttatccctcatgtgttctgaggcagaaaaaagatgaagaccaccgctttagctaatagagactacaagggcagaatttaaacaggaactttgcattttatgtgaggcctaggaatctcaattttaaagaattccttaggcagttctgatgtagttaggcaagctccagtctgcctttaaaatctaatgttctgtggcatatatgccaagaattccttgatccccttaggatttgaccaatcctagtattttgagaatataggaagaacctgcagcagaaacttggataagaaaatagtttgtgtattttgatctttaggttgattgcactgccaacactaacacctgtaataaatatggagtcagtggatatccaaccctgaagatatttagagatggtgaagaagcaggtgcttatgatggacctaggactgctggtaaggatcctgaattacattctggaaactgatgttaagtaccttattctttgtagtggaaacataaaaatgtgtttttctacacagtatactttcagtcttaaaacttcctcatctaagaggtcagtttggtggtaacaaaagacctctctaaatgaacagattatataagtaatatagaaaatacacaaacttgatttataaggtcagctcgacattttttcattttacaaatatttattgagtaattactgtgtgccagatattctaaatatactaggtcgttggcatttattgataaaatagacaaggtccctactcttgtgaagcttacattctgggggatgagggggagaaggcaacaaacaagttttaaaaatatagatgagctgggtgcagtggcacgtacctatagttttagctactcgggaggctgaggtgagagactgtcttgagcacagcctgggcaatataagtttgtccccat

SEQ ID NO: 79076 - DNA, 1037 bp, Homo sapiens
aatcttggctgggtgtggtggctcacgcctgtaatcccagcactttgggaggccaaggtaggtggatcaaaggtcaggagatcgagaccatcctgtctaacatggtgaaaccccgtctctactaaaaaaatacaaaaaaaagtagccgggcatggtggtgggcacctgtagtcccagctactcaggaggctgaggtaggagaatggcatgaacacaggaggcagagcttgcagtgagctgagattgtgccactgcactccagcctgggcgacagagcgagactctgtctcaaaaaaaaaaaaaaaaaaacctgaaatcttacaaggaggaaactgggtgactagggacaagggtggcaagaagatttcatcttatacccttttgtaccttctgaattgtgaatgatgaataattgccttctcaaaaattataaataagttgtgttgtcataacttttattttgacttctaagatggaattgtcagccacttgaagaagcaggcaggaccagcttcagtgcctctcaggactgaggaagaatttaagaaattcattagtgataaagatgcctctatagtaggtaagtagcaaatattaaaccgtgccacagaattgtcagtttggtttccaaaaccctccatgtctgggaaaaccacagaattaaagcagttaaggaaaccttggggcagttgagaaggcaactgacagaattgggtcagcaattactataatgtactatatagtacattatataattactatataatgtaattataatgtggggggcaattggtgttttatttgagtgggtttgtgttctcatagatgtaaaggtttaatttcaattaaagggactggaaggggtgggtgtggggaaaaaaataaaggactaggataggaatatcttcagcgttttctaatgcttcttaaactctgagatttgactcacaatagggtagttatgactgaaaataaggttttaaggtaggaagatacaagtaaataataaacctctgctattttcacagaaattaggg

SEQ ID NO: 79077 - DNA, 1055 bp, Homo sapiens
ctagattttactgattctttatattttacaaggagttagcatgtatttattaaacatttatgttttagtcacttttctaaatgagtagttctgaagacaaatatagagaaggaaaaaaattgggtgaagtggtttacagtttattttgacatgtcatcttaatttaatccttctgatacctgaaatagtccctgaaactcttaagcaatttgcccaaatttgttcaattatgggaaagtaaaatgaagacttgaacactgacaaattttctcccttggctctctcaagaaatgtttctgtaaagggtagagggaaaattctcatcctaaatattgtgcctgtctgaggtagtcatggcaaagcagacccagtcctcaaaatagaatgaaatgtttatggtttatggaatagacgtttatggtttggaatgtccatctgtcagcacttattgcttcttccttgtgtttaatattttctgtataggttttttcgatgattcattcagtgaggctcactccgagttcctaaaagcagccagcaacttgagggataactaccgatttgcacatacgaatgttgagtctctggtgaacgagtatgatgataatggagagtaagtgactgagttgaatctcctgaccaagtattattgtgtgaactggtgatactgattgactgggacaaggtttcactctgtcacccaggctggagtgcagtggtgcaatctctgctcactgcagcctccacctcccaggttcaaacgattctcgcgcctcaacctcctgcatagctgggagtacaggcacgcgccaccacaccctgctaatttttgtatttttagtagagacagggtttcaccatgttgcccaggctggtttcaaattcctggcctcaagtgttccacccacctcggcctcccaaagtgctgagattacaggcatgagccaccgcacccagctgaattggtcatttttatacctaatttttcccaagggtttattgagtactttcaaggcattatgctacatgcccagaaactattgctgccttcaagg

SEQ ID NO: 79078 - DNA, 1990 bp, Homo sapiens
gcctactgagacttttcttttttttttttaaggggtatcatcttatttcgtccttcacatctcactaacaagtttgaggacaagactgtggcatatacagagcaaaaaatgaccagtggcaaaattaaaaagtttatccaggaaaacatgtgagtacttctttgtatcttgtctgggatttatttgcttgattttagtttgtttacctcagttattaagccgagctatattttggcgtaaacagtctatttggggggattgtaatagtaatagtttgagtttatattaaagcagtaatgtgtgggtgttagaactcctgttgtcatcctgtaaggtatatattgctcagtacttgttctaaatgtttaaaatctctttccttcataaatgctatcaattattttgtggcaactttatgatatagctaaaaacttggcaagccagttgataatggattatttcatttcagttttggtatctgccctcacatgacagaagacaataaagatttgatacagggcaaggacttacttattgcttactatgatgtggactatgaaaagaacgctaaaggttccaactactggagaaacaggtaataagaattatgtttttccctcatgaacaagtttacccaatgtatagacagtcccttctaactatcttgttggttccttaagaatctgtaaaacaataaatggttccttaagaagaggtaaaaaaaaaaaaaaaaaaattaaagtaactatcctgttaccatgtgtggtataaaagcaggaaagaatgggaacatttggcttccaaattgtctacaattgacttcaaatggctacatttgaagccataaggacaaataaactgttttcacaatctgttgggcatgtatttcgtaggtgtttctttgctttgtgacacagtgactccaagtagaaggtggaaatttgatataaaatgcacttaaaacattgtgcttacttgcacattgagcctctcagtgcattttacccttacaaattttgttttcagatcagttattatgcctataatagatttcagttatatattacagcaagatttagcaggaatgcaccagttgattgggtatcaccaatttgccagtgaagttcagtaaggcattgaagtatatcataaccctgtgtcagtgcccaagagctcagactgttcagactgattccagaaggctagaactatagaacttagtctttgctttccaatcacttgcttcttagtttcaaaagtgcttgaccaccctgtatagtcttggcacaaatgtctcttgtttcccacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgtgagttgctagttgggctttgattctccaaggcaattattaaagccttttatactacaaaggatttctaaagaacaataaccctggaatgtgaagataggtcttttaatcaagacctatgactgtcatttttctcaatttaaatataggtactttagaccaggcgtggtggctcacgcctgtaatcccagcactttgggaggccaaggcaggtggatcgcctaaggtcgggagttcgagaccagcctgaccaacatagagaaaccccgtctctactaaaaatgcaaaaaaattagccaggcacggtggtgcatgcctgcaatcccagctactcaggaggctgaggcaggagaatcgcttgaacctgggaggcggaggttgcggtgaaccaggatcgtgccattgcactctggcctgggcaacaagagcgaaactctgtctcaaaaaaagaaataaataaagaaaaataaatacatataggtactttaaggattatg

SEQ ID NO: 79079 - DNA, 3912 bp, Homo sapiens
tttctttttgaaatagcacatgggtctaaagtgaactcagaatcgggaagatctgaagaccccggaaacaatttttaccctcactttctgagattttgggagattgagacaagagaaaatcttccttgtgagccagtcaataaaacaaaatactgtaaatagtgtgctccagagcaataagaccttgttttcttacaaagatgaatctccagaagaccaatgattctcctttctctgaactttgtaatccacaaagaacacactagaaataaaaggaacggtttgtttcttcagtcggtagttctgcatattgagagatgagagtcccccttttttagccttgaaaagctaaaatacatagtaactattcaaagaaattgctgtaattttctcagcggtgggaatagattaacaagccttacccttgttttccaattgtaggcgtgatgggaaggctctggagaggttcctgcaggattactttgatggcaatctgaagagatacctgaagtctgaacctatcccagagagcaatgatgggcctgtgaaggtgaggtgctcacagcctcatcaagctatgagcaattgcctgtcctcatttctttgttccaaaactgtggggtctaaatgaagacttcgttggccatctctttttttttttgtccttactcccgagtcataaaataagcattggcaggccaagcggtggctcatgcctgtaatcccagcactttgggaggcaaaggcgggcacatcacaaggtcaagagtttgagaccagcctgcccaacatggtgaaaccccgtatctactaaaaacacaaaaaaatcagccgggcatggtggcgggcgcctgtaagcccagctactcgggaggctgaggcaggagaatcgcctgaacccaggaagcagaggttgcagtgagtcaagattatgccactgcactccagcctgggcgacaagagcgaaactccatctcaaaaaaaaaaaaagcattggcagggctcataatgcttggtaggggcaagcgtgtaaagcctgcgtagaattttctgatgaaatttatattgggctaagttactcttgaggatagagcaacccctaagaacagtgtgttgctttgaattttttatagggatgtggtcttactctgttgcctcagccttctgagtagcttggactgcaggcatgtgccaccaagcttggcttgaaattattttaaggaatggttgggtagcacttctatgtcctgtaacttcctgaacatagtttgacaggtgacagacataggaacgagttggtatctagtgaatgacaacatctttaatacaatctgtaaatgtgatttgggtttccatgacttattttctgtggtaacacatcaaattagagagggattgggtctaggaacaaatacagttgtgaatttatttttttatgttaccaactagagattcttctgtgttttccaggtagtggtagcagagaattttgatgaaatagtgaataatgaaaataaagatgtgctgattgaattttatgccccttggtgtggtcactgtaagaacctggagcccaagtataaagaacttggcgagaaggtaagtgtgaaccctattctgaggataacatttgagcgggagcagtaagtttatgtatgtattcagcattggctaatttggttggttcctaagtactgatagatttttttcccaattacttgctgtttactcactttctcgtgactgccccctagtgctccagcctgtgcagtgcctgagatacccacttttaacattccattcctcaggctcaatctagataatggttaaaaatatctaaggacttctgaattttggtaatggcttacatgaatccatatggtccttcatcttaaaacatttggcttagcccctgtaatgtcttattcagaccaggtaaatttgaaggtggcaatatgtagagtcttaatacaagagaaaaaagggaagcttgtggaaagtgaggtactaccatctgcaaaccactcttcccacatgaacagcagtttatctgctggaattacaggtgcgcaccaccacacccggctaatttttgtatttttagtgtttgaagaatgagattgttttaagtcttcaattgactaagtgtccctctgtcactgaaaacttgaaatgtaaacatttaacctgttttattaacagctcagcaaagacccaaatatcgtcatagccaagatggatgccacagccaatgatgtgccttctccatatgaagtcagagggtaagtggcttaaaacttaacaaaagtgtctaggcaatagataggaataaagcttgtaaccaccaggaaatcattactagacatagttttcatattcagttgaaggcagaaccactgattccttcttggcttaagagttctgcagtatgggcccacataactgcttgaaattaataaatgtttctttccccagttttcctaccatatacttctctccagccaacaagaagctaaatccaaagaaatatgaagtaagtgaattgtcccatatccccacaaatatatacacagacgtaaacacacaaccttaaacatagttctttaattgggtttatttatttatttaattattttttgagacggagtttcgctcttgttgcctgggctggagtgcaatggcgtgatctcggctcaccgttcaagcgattctcctgcctcagcctcccgagtagctgggattacaggcatgcgccaccaccccggctaattttgtatttttagtagagatggggtttctccatgttggttgggctggtcttgaactcctaacctcaggtgatcagcctgccttggcctcccaaagtgctgggattacaggcgtgagccaccgtgctaggctaattgggtttatttaactaaaatctctttaaactctcatgggcagtatatgtggctgctaatatgcttttacaaactcagaagtcttcctgtttgggtggggcagatcagggttctttaaaaagttacacttttaagctgatctttctgttttcagggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagacccctttaaactgtcttattttccaccagattgagaaccagatgttctctacacactatcactgttcaatagagctttcttcagtgatggaaatgctctgtaatctacactgttcagtacaggtagctacggagcatctgaaatatggctagaaactacatttttgttttgattaatttaaatagccatacagttgctaccatactggtcacggcagctgtagactgactgggtccatagttcatcacctcaaaattctttcaaaatttattatctctttctctccttacatgtttatttcccaggcctaccctggtgattagaacagctgaagggcctttcttgttaggctgtccatgccctaaggatgggttcctgtttatccttgccacgcagctgagcttactgcatgtttatatctcccaagga

SEQ ID NO: 79080 - DNA, 1128 bp, Homo sapiens
acaacactccagcctgaggtgactgagtgagaataagaaaaaaaaaaaggatggcctgagcccaggagtctccagcctggggaacagagagaccttgtctctaaaaaaattcctcccatataacgagcttccaatttctaaattttagcttgactaaaagtgcttttcaaaatagtctttgccactgtttaattatattaatgttacaaaaaaaaagcccttgccattctaacttaccttgtccagacgtttccggctggcagaggaaggcagtgcctgaacaggttctctgtttggaacatgggtctggcttctaggatattttaagggaatgggacagatgaagaccagggtaggaggtggaactggatcttttattacaacatttaagagtggagattagaaaggaagacaatgccaaagcttcccatgttagtcccaccccatccaaagtacctcacttcccactgtgccatgtgctcccttgaggatcctgggagtgactgtccttggttgcttgccagtggatctgacactgacacctggtggggaaagtggcaggagcacttggttccctggagtactgggataccttggacttcaggctttgccccaccttatcacaactccctgcaatttctggcctcacccacctcctctagtgccatctgtggctgtgatactgcatctccttcagaatagcctcctgtgttctgccaactctcaggatgtctggcatcttcagtcaggttgtgtccctgaactgatgatggggctgggatagaatccatggctgcccaaataatgaggcgctccctgagtgagcccaggcagtggaggctgttaggcccagacctggaaaaggatggtggaaaaaaataggagggtggagacctcttaagcacctctccacatttccctcccccactttccacaaaccctttcttgccggctacctgttccccctcacctgaggaagcgttggcacacaaggtccaagctaccaccagcgccctcctgacaacactgggacactatgaaggagaagaggcaggaccaaccagggcctgggagtctcagatactgggggtggaaggagacggtaagccccatgaagtcagcccctcc

SEQ ID NO: 79081 - DNA, 5983 bp, Homo sapiens
gagctgtgaacaactcgtgtccaaataagtggctgagaggtggtcctaagtaagcacaagtttagtagtagagtactcgtaacacagaactggctgaaaccccgccctcttgtctacgggcgttctttcagggcgactttgtcagtaccccaaactgtccccgcatgaggtcactctgcacggtcacgtgctcgagcccgcgggagcgccacatcgccagccgcacccctccacccccaacctgcccacgtgacccggcctagtttctccaggcccgtccctacgtctcactcgggaagccccgccccacgctgagcgctccgcctgcgaccctccgccacttacccaccccggctcaagcacgacccgtggatccacgtgctttttcttgtccaatgggagccggctcccgggcgcgaaggggcggggaggaaaggaacgactgtgctacgttgccagaaggggcgggacctgcaacgtccgacagaacgaggggacgtaacggaggcaggttggagccgctgccgtcgccatgacccgtgagcaccgagcccccttctccttgcccttttctttccgttcaccctaaacaccaccggcgaggcgccggctttgaccttccgtagcttccctagcaaggcgtttctctgggcgcgctctgtggccaccctcacactcggtgcccggaaatcgagccctttgcccacggctacttcacgggaccaccctcccgggttaggcataggccctcccggatcttccgcggtgtaaggagaaggccagcgcccctgtgataggcccagagcccccactccacaagccagcccatcccccacggagacccaaaccgtccacacacaccttgccagctgtttgggccccacgccgccccaaaacacgcctccagctggccccttgggacctcccttctctagtccgtattttgacctggcccgtggcagattcgccactcccccctaccccaagcagcctgggcctcgatgggccgttgtcggggcccggagattgaagtggtgttggatcctgctgctggccgcgctggggtagaagggtcgccggtgtgtgggcagagcggcccccgcgtctcacctttaattttctttccttaggcggtaaccagcgtgagctcgcccgccagaagaatatgaaaaagcagagcgactcggttaagggaaagcgccgagatgacgggctttctgctgccgcccgcaagcagaggtagccccagggaggggagggaaagggacggtggagacctgggttagaccaagggttatagaaggaaagagagctacctcagggcttgaatgtggactagtcgtgaggagcagagtgcattgcttcctctagggttttatttcctccccaccctccaaattgttagctcacagccttacaggaaaggacgggggcgggcgcctgccctcagtctgatttctgagcgtccctgggtctgaccttaagggcaagggcagggagcttcacatttcaaatacagttgtggttacggcagcccagtacttttggccctccttgctgttcggttctcctcccttctcccaacctcctcactggtgttgctgggtgtggtcctcaatacagaatagagacccttgggcctgtgtcaccagacttctgaccccttgggcaacagccagatggagactggtcgccttttgagcctcagctctcttcctcttgttctcctagggtgggagtacagcagccaaacgctgaacttagtcccatccacttccatcttatcctttgtgcccttcatccccctgcatcttgtcctttttgccctctggtacctcccagtgccccatcatctctacccccagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattccttgagcgcctggtttgactggggacttggggggatggggttggaagaatgactgccctttcccaccaaaaaagggagaactctttagattcagattgtgggtatgtagacttaataagtgaaacatcacagaagaagcctttattatacaatgacaaccaaacaagtactccggatatgcagtagaggaatcctctaagaaccatagagacttcttttctgtgatttttgttccccacccttgaacaccatctctaggatggagttggcctaagagtgaatgctgcaagatctgtgtttatgcctcttttcctcattcttcctcagtttgttcgtctgcttgaaagttggccaaaaaatcctgctgctcaccgacttcccgtggtcagctgctgtcaagcgttcactttctcttctgtcattcctcatggaatgagggtggttttgtcttcccgcttcccttgacctcaaaatcaggattaaaacctggggtagcctctgtgctcctttcttctatgccctggtttgttctgtggttctgggcttcttatatccgtgtgcccagggctgaactccttattttcctttctccaagggcagagccgagtcttcagtccctgttggtctttccccacccccacttccagcccaagagccaggaaagggctggtgccacactgtctgctgggatcagcggtggttctttgagctgctgatttgggtgttaggctcttgagctgggatgcagatgtaacagtagctccagtgagtcagacactctgcccagcacattagactgtgtttgaccacttcttccagttcatagtattgacttcagcccaaacggagataactccctgtgtgtccttgaggtattgagctgggctggacagctccccttgagccaactctaggagtacaatgtcaggggaaccccagtttgtgaaaaggacttagactggaggatatttgttatctggggatatgatgcggtggcggcggcgcctcaagataaggggctggggtttctgggtggggggccaacagagtggtgccagtaacagccccagatagaggagtacgcaggcccagcatgaggcaaccttgacccagaaggtggcccagctacccttgatgaaggtcttttccagttctgctccctcatagctgtgtaaccaaaggctctggttagagaatatgaagggccttagcttttagacctgttctacctcctcaccaaatataatggcagacccatgtgtgtctggaatggccttgaattgctctttccttaaaatagctagctcttcaggagagtatctaaggcccactccatcttacctgaaccagttggtaagggtaaccatgacatagagtgaggcaaggaagaagacgaagtggaaggcagaatagttgtaggaaagatgctggacttggactggaggagctggaggggtttcttggtcagctggcctcgcagccccacccctttgccctggagagaggaaatggctgctgggagcagagctgctgaaacacctcttcccctctcccccaactacctttgttaaggctcttgagggttcttatggcactccacagagatctaccacttcttatggttcctcacttggcactcacctttgtctgcctccactgtttcagggcagcagaaacacagtgagggcttctgcaaaacagaacgcaggttttggaatggtcttaaaagatgtgagggtgttaatctaggaaacttcccccgtgaaaagattggtctagtattaaaaagtggaggcacacctgggttcaaattctagctccagcatataagtggctgtgcagactttggtaagatgtttaatcttttgtgcctcgatttctccatttgtaaaatggagcaaatacctacctcacagggttgttgtgagggttaaattaaatgagattatgtaaaagtatctagcacagttgcctagcacattgtgggtactcaataaaaggtaacagcagctataatctgagcattctgggtagaggttggtaggatgtgtgtgtgtctttgtgtgggggagggagggtgttggggatatggagctctttatcctcacctgaaactcatagctgtaaaccttgacaatccacaggggtccaaatacctcagccaggtaggaggcctcattgctgagaaagaatagagttcttaagctggtttagttaaatagggattatctgggggcatttactaccaattggtccatactggtaatcctcaaaagggtaccatactccctgtgcccttttccaccaaagatttagaattctattcatgtgagagccctaaggtctttggacatattttaaattctcaagtcattccccccacccccttcatctcatacagatcatctgacaaagtactattcttagaatttgtccctgtttgtggggagcttttctcactctagtcttgctctaaactttaaataatggtcccagacattgtcctgaccatccttccctgtcttgggcaccctcctttcatacctccacccttgacacctttacgcaccaagcaaaaagcacacaagcatacatgatgctagcactcagcattgctagagagatatctggtgtttggggttccattttactcaggccaggcaggcacagggtgtgattctgtccttgaaggattactgggaagggacaacagaagagatgggtattaacaatgagctaggtatttggcaggggcaaaaaaaggtcttagcatggagaatccaggtcctgtcccttacctctctctggaggacggctggacagtgcagagaaagtcagatacatgatatagcagctgatgacagaagcttgtaggaggccagagcggggttgctctggggagtaagtataattgctttagtctacaggctggtaatttcctccatttctacccccacttgtacttctgtctccccatcctttggtggggatagggaagcagagattcttttatcaaataattgagattagggaggtaatgaaacttgctatgcttttaaggcccccaaaacctggaatgctgtaggacatgtacccactgaggcggatgcaaggagcgatggagaggaaggagatgaggccacagaagcaaaggtgcagactgaggagcatcttgttaagcaggcagccagctgggtgtgtataatagtggaataggagcacagctcccacacctgccatgctgtagaatcctagggtggccagcaggacagccaggaaccagctacagtcttgagctgcacctgtctgcctaagggtggaaagtgggcaatggcttggagctccagcattttttttttttttgagttgggagtcttgctctgttgcccaggctggagtgcaatggtgtggtctcagctcactgcaacctccgcctcttgggttcaagtgattctcctacctcagcctcctgagtagctgggattacaggcacctaccaccatgtccagctaacttttatatttttactagagatggggtttcaccatgttggccaggctggtctcaaactcctgacctcatgatccacccacctcggcctcccaaagtgctgggattacaggcatgagccaccgtgcccagctggagctccaactcttttacccattaccaactactcccctgctctcagaagactggtgtgactagccatcctacttggcccacgcagtcatcacattcctaagcttttttgatactgctcagtgggaagctgtgggac

SEQ ID NO: 79082 - DNA, 2622 bp, Homo sapiens
actctccccttcgcaccctctcacctgacagaagggacttttcactaggacactgctgcctccgctgtgctgctgtgccaggcccagggaggtgccggggctggggccggccttggcacccaccatccttgtcccagggattaggcttaggtccaccagatggaaggcagatgagagcagcagttgcttctgtcctcagcccattggactgccactgtgttggggctgagcacccggtcccgggcagaatggagacgtccggaagagaacactgacctccaggttgcggtaaatgcaaatgccctgtgaaggagctttgtccttagggcctcaacactgcggccactcaggctgttctctccagattagggggcagtttgtctatctggccccctgtggattagcattctttattggtttaggattagacgtcattcaggttgaacggagttccctgaggtgggtgggtgcgtgtttatgtgttgaggggactattcctagtttatgaggtggttaaggatatcggtggggtgggctggagcggtgtcgggttaggtctgagagaaggcctcgcacaaaacactgtacaaacccgaaaggaagtctgagagacgaaccgccttcctccctgaagcttctagaactggagcagaaagaaggtgtggcccagggccagccccgcctcctccccgggcggaagctgtgtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggtaaggttggccaagagcatgtcggggcgggctgagagcagaggggggctctgaggctgtagctggaagccagcgctccaagacggggttctgatcccgttggcaggaggaggcaatagggtagagccgagggaaacagcggtcaccggagcgcgccgcttgcctaaaggagcttgatagtgggcttaaggggacctcaggtgcatagaatggaattaaacatagtccttgctacctggtaacacttgtcatcgtgaatccatgcatgaaccgcttgttttgttggccttttagattattgggaattgtgggtagcggtgcagtaactagacctgcctttcccataggccatgtctgtgattggagacagaaggtcccgggagcagaaagccaaacaggagcggtaagtcttcaggggcagccaactttaacagttcttccctccccggtccccagacaaaaataaaaaccattattaagcctttataccgttcttcaaatttatcaccaattcctgcagatctaggcgccacaactttactcttgttagcagaaggcctcctggcaacacctgctgccaagactccaggggaaaggagtattagtgggagtttttattttcaatcaagggtttatcaagatttatttacagggcacttctgggaatgacccttcctgggagtttatggtgttggttgagaatgaggactaatatatttaaatatttttgcagggagaaagaactggcaaaagtcactatcaagaaggaagatctggagctaatagtgagtggtagtgcctaactagtgtatgcggaggggaggctattctgcttaatttgggttgtttcctgaaacaagcggagtcagtatatttggtggcacattaatgcctgggaacctatgtaacatgatttttttctgcagatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagttttatcatcttgggtcaagtagagtgtatactatatcctatgttgtggagaatttatatgttggagactaactgaatttaagtgacccattaaaatctagcacacctgtatgaaaaatcagtgtagaagaatacctcatgtgcagatgctaggtggcaggccagtctcattcatctgactagctctcaacagtattcaaggtacatctggagtctcagcagagttactgtactcaaatggcatgtgtctccaagacagcttatgaatatctaaaaggccagctacctgcctaggagccactatatatatagatagatgtaggttatgaacccagttcataggccaccttgagttagaattttggtacctacaacatgcttgattttgagtgattaaaaaaaaataatttggctgggtgctgtggctcacacctctaatcccagcactttgggaggtcgaggcaggtagatcacgaggtcaggaattcaagaccagcctggccaacatgtgaaaccccgtctccactgaaaatagaaaaattagctgggcatggtggtgggcgcctataatcccagctattctggaggctgaggcaggaatcgcttga

SEQ ID NO: 79083 - DNA, 1029 bp, Homo sapiens
acctagggtccaactgcttattcttccaactgtggaacacaaggggagtctcagcatctggtccttgatttggttttttcattgtttccttggcccctgtatccagatattggacttactgctatacttgtgatactgggtagcccagactttgaaggtgctttgtgaggtttggactcatgctgagaaacccacaggaaagcactgtccaggtaggattagaggcttcccacttaaaactatttctgagaaatcttaggttttatcactgctatggtttcccatatttacttgggactgttctgactttctttttccagcccttagcttgggttagaaaagtggacatgtaagtgaacaatgcattacttctaccttaggtttaggagtaatatacccggaaatctaagctcatggaaacatgttttccatttttgcttggagtccgtttttctagttgtacatactttttgatccatatatgtgtgcatgtcaagaaataaaagaatcacacaacaaggagatttttagcatgatactggaaataaaatgtccaagctgacaagtattaattgcctattaaagtaaaagataacaattgtcaggcagaaggtgtttcacattttgataattccctttgatctcagaaacaagctcaggtactagcttggctttaggtagcatctggatttattccatgaccaaatacagatgtttttgagaagaccaaggtcttctcacatcctttaaatgtcccactggaagaatcaaatagtttagtgtcgtacgataaaaatgaatgcaaataattactatgaggtggtaaatacataaagatgaacacaggtacaagtcactgttgtgtgggatacaatctaagaattatcctagagtcagaatgagggtaaggccttgaaactcttggagaaatgtctgtaattgccatttgagtgtccttacagcagactcaggggccgttgcagggttttttttttgtttgtttgtttgttttaaagagacggctctgtt

SEQ ID NO: 79084 - DNA, 1024 bp, Homo sapiens
ttcattatgttagccaggatggtctcgatctcctgacctcgcgatctgcccgattgggcctcccaaagtgctgggattacaggcgtgagccactgcacctggcctcaatttggatttatattgtctttgggaaatgggaattattagatctgttagggatcctgtaagaaaaggcacaggacttggagttctaatattctgttttcttttattgatctgaataggtaaatgaatataaagaaaatcaaaacatcgcttatgtgtctctgagaccagcacagactacagttttaataaaaacagctaaggtctatcttgcccccttttcactcagtaattaccagctagaccagcttatgtgccccaaatccctatcagaaaagaattctaacaatgaagtggcgtgtaagaagactaaaataaagaaaacttgcagaaggattatacctccaaagatgaaaaacacatcttccaaggcagaatccacgctgcaaaattcatcctcagctgttcatactgaaagtaacaagctacaacccaagagaacggcagatgcgatgaatctcagtgttgatgtggaaagtagtcaggatggagacagtgatgaagataccacaccatccctggtaagaacttaattagtagcttgttctggtttctcttttttgaaatttgaagttctgataaatcgaagtttttcgaggatctctctggtacaaacaagttatttcatcatctaatgtaagtataaatgtaataatacatttttattatttttaaggtttaacaaataacttccttgggttatttttgctcttgctgttgatgtgtcaatgaaaggattgacttaatctttactctgcttccttttttctttctctaaactaactgcatatatttttgggtttagtcatactttatggtgcctttctcacctttacatgtttatgtacagtatatcagaagtcatcagtttgtgggacatggtattgactgacctttgatatcagggtagggaaacata

SEQ ID NO: 79085 - DNA, 1014 bp, Homo sapiens
aacactatattgtttagctttgtctttttttggtgttcacatacaatatgccttttttatattctgagattttcttattttgctcatctttacatatttatgcttttaaatttacccatgttgatgcgcacagctttatttcgttctttttttctgctatatgatattccactgtatgaatgtactacattttattctactgttgatgaacaattgagttgttatttttattatgaaaagtgctgctccaaacattcttaagtctcttagtgcttatgtatgggagtttctctaggagtagatttctaggattgtatgacagcccatattattccatatactcaggtgtcttttttgaggattaaatatgagatggaatgttgactacagtttttagtatatagtatactttcaatcagtaggttttactaattctcgaagtaatgtggactataactgataattttttatgtgaatttttggaaataatttcagaggcttctctttccccaacattttaaaatgaattacttttttaaaaatgaaaaaatagtgcataaaaaaatagagaatgtatattatttaaaaagtaaactacagtgtatggaagggaatgcagtgaaacgttttaagtttccttcctattttagaccttagttttccaggccttttccctagaagtagtagttttatgtgtattcctccaaaggtaacctcagcatgtacaaatgtatgtgtatatgtaacctttttgtatacatgtactggactttgtttttgctttttataaccaagggttcctttcagcagtgcataaagatctatatcattctttttatggctgcgtattattctattagatatgtataccataatttaacagacctcacctctttttgatgaacatttaggtttgttttttccatacttcttattaagataattgtggccatgtatatatatatctatgcagtttataaatatatctgtggtatatattcctagaagttatct

SEQ ID NO: 79086 - DNA, 1052 bp, Homo sapiens
gggcaagttaactcctcttaagtttctggggtttttttgtttttgttttttgtttttttttgagatggagtcttgccctgtcacccaggctggagtgcaatagtgcagtcttggctcactgcaacctccaacacctgggttcacacgattctcctgcctcagcctcctgagctgctgggattacaggtgcctgccaccacgcccagcaaatttttgtatttttagtagagatgggatttcaccatattggccaggctggtctcgaactcctgaccttgtgatccgcctgcctcggcctgccaaagtgctgggattacagtctctaagtttcaatccactgtctttaaaatgtgatacctcatttgctaggttgttgagaggattaaatgagataatacatgttattattactttatagggtacctggcattcatttattgaacaattattttgaatgtccatgatatgccaccattactgttgatgttgaaagtgaagttgtggggaaaacagacaaatacccttgccctccttgtgtttatattctagggcagggagcccaacaaataactttttattttttataacagcctttgttacctcctgggcctttagaaatgacttctgaaaatcaagaagacaacaatgaacgatttaaaggatttctgcacacatgggcaggaatgagcaaggtatcacttgggaaggccaatagcctttagaatcatctgttaaggaaatatatatatatgtaaaaatatatacatactaacttagttctttcatctctcccaatgtttcagccaagtagtaagaacactgagaagggattatctagcattaaaaggtaagttgaaattccttgtgtttcttttatattttttgagatgtttgagttataaagactatacgccattttagggaattttgaaagtgagatgaaatgtttccaccctaacaactgttgtttttgtgtatttcctcacaagtgttgccatatacaataccactaggatataagcttcatatacaataccactaggatataagca

SEQ ID NO: 79087 - DNA, 1020 bp, Homo sapiens
taattgtagacacagctgatcagtgcctttgtttcttttttgttttgttttgtttcttttttttttttttaattttcagttagaaggaataagttctaatgttcagtagcagaatagggtaactatagttaacaacagtgtattgtatattttaaaatagccagaagagaggacttgaaatgttcccaacacatagaaatgataaatattgaaggtaatggaaccccaaataccctgactgtgtttccattatgtcctgtgcatctgatggggatgatgagaggataaatgaggttatttgggtaaagtgttttataacccttttaccaaagaatttatgctttggctttctttacaagaagagtgtgatataagctgattgttacttatattcttaggtgtatagaaatgaaagaagtagcttttcctccttcgacttcttggcagaagatgcctccactttaatagtaggacactgggatggaaatatgtcactggtggatagacggacacctggaacttcttatgagaaacttaccagttcttctatgggaaaaataagaactgttcatgtccacccagtgcatagacagtattttatcactgccggattgaggtatggtctttataagactttatgacttagaccttttaatgtcacaattacatggtttagtttggttgtcaaagatattgtaatacaatattacaaaaggtattacttttgtaatacccaaaggccaagtaattttcctttctatactgattgagacttgagtgattttttttgaaaatgaaaaattcttttagatttgataaatagtgaaaaagctgaaagaaatttttgttttccttggcattatatgcattcgcctcttatgagaagaaaatttaaatttcacagaaaaaaaagttacatgtgacctataacttgttggcctgtgttaacttttttctaggaaggattgaaaaaccaactagaaacttgacagctgggcgtggtggctcatgcctgtaatc

SEQ ID NO: 79088 - DNA, 1045 bp, Homo sapiens
gaaaaggaaagaatttgtaaagaacagaaaatatatttgagtaagtattgtttggtaaaacttagttacatatgcatatatatttgttaggtatatatgtttatgtgtattctgatgtaaaatatatatatatatatattttattactatagtaccatgggtaatggataaagaagttaaagctactgcttagaatgaagaaggccccaggcttacctgtcccgatctttaaactgtccgaaggaaattcaatagcctgttaagtgaataccttcattcttacttgtatttgggggaatattatgaaatactcaccacttttggtattttatgaaaatgttttcttttcagaagttatggtaatttcaatgtgtttgttgttgggaggggagctgccaaatcagttactaatattactgtgtgacatctatccaacttttttcattattcttcattgccaaatactgaaagacttgtaaatggctttggcaatatgtttgaattctaagaggaaatattttcccataattgtatatcagagaaatatagtgatatacaatttccttgaaaaccaatttctaaataattttcttctctgtaatctaagtgtaaaaaggtttagttttttaataggtttaggtgtttataagcaatagttctctattttctagttgatataagtagaagaattgacaagtgagatggaaatgttaatttataaagggaaagaaaagctaggtgaggttgagttataattaaactgttcaggaaacatcgtaaaggctttaggctccctttttcatttctataccaattaatctcatgggttctagagtggttagttctacgggaattgtttttgtttttgtttttaaagatgctgaaaactactctcaatcaaattagtaccatcatttaagctttgaatacttggcagtaattgcctgggctcgtcaataaatgttagcaaattcttgatgttcctcacttttgtggtttcttttgccattgtggcttcataaacagtgctatttatattcagtta

SEQ ID NO: 79089 - DNA, 1113 bp, Homo sapiens
ttttgtatttttagtagagacgggggtttcaccacgttggtcgggctggtcttgaactcctgacctcgtgatcctcccgacttggcctcccaaagggctgggattacaggcgtgagccactgtgcctggccgcttctcagtttctaacagtatttatctgggggtaaggacaaggataataggtggatacaagcaaaataattatgttatatgatccaagtgaatagtagtcagctgtgtaaatcccaccagtatccttttatctatgtgttagtaactttaagggaggaaaagtaagacaggctattattaaagaaagagcccactcttccatgatatttaaatatttatttaagtttaaaaataatcttcatggcaccaatgattttatgctaactacatactgcatatgtagaaaaaagtacattgctttgaaggaaaatgtaacttaagagtttttggcacacagaaggttaacaactatatatttttaaatgtatctaagaaattcacatttgcaggtagtttaccctctactgcttaaagatgcagtatgctattctttagtaagagttttatttcctgatagatgaagctatgaaaaccattgctttttctacaatgagataaactaattttgagagaaaatgagagacatgttagaacacagtataaccaggttaaaaacttgaacaatttttaaaggtggagatataccaaaaaagactagtcaccaatcaaaggaggtttattattcaagcactatttgaaaagcaaactgaaggaaacttttctatccatattttctgggatgagccctggaaaaaaacaaccctaaagtttctgtttacagagcaaaatttagctgttagaaatggcatagactactgtactgttagaactctagacacaaggaacatactaggatatggaatactgcatctgtctctaatgtgaatatgaaaggtcagagttgaggctatcactcactgcatagaaacaccagattctacaaactgaggtaggagcactacactaaaaggtaatcttctatgttgcataagacagtagataccaggtggacaccagccccctgtctcctgacagcctttt

SEQ ID NO: 79090 - DNA, 1418 bp, Homo sapiens
atccttaccagtatgttagcagaagagggtcagtcagctctgtttccatgcctgacatgtatcaaagatctgggacctcttcccagtggaggcactagggttgcttgtttaaagggtgcttgaacaactaaccagcaaagagatgtctgatgccaaatgggcaagatcaaatactggaatgctaaaacacagctggaatctaagaagggaagagggcttctctgaccattttcataccagcaacaatttaggcagaattataaacatctatttatcgagtgacaatacaaaccgaaggagatcctagtagagattaggggtcagttaaaatcaactagccactgccacttgtcatctacatagcaaaggctttatttagcacaggactaacgtgaaaagtagacccagagatgaaaaggctgtcaggagacagggggctggtgtccacctggtatctactgtcttatgcaacatagaagattaccttttagtgtagtgctcctacctcagtttgtagaatctggtgtttctatgcagtgagtgatagcctcaactctgacctttcatattcacattagagacagatgcagtattccatatcctagtatgttccttgtgtctagagttctaacagtacagtagtctatgccatttctaacagctaaattttgctctgtaaacagaaactttagggttgtttttttccagggctcatcccagaaaatatggatagaaaagtttccttcagtttgcttttcaaatagtgcttgaataataaacctcctttgattggtgactagtcttttttggtatatctccacctttaaaaattgttcaagtttttaacctggttatactgtgttctaacatgtctctcattttctctcaaaattagtttatctcattgtagaaaaagcaatggttttcatagcttcatctatcaggaaataaaactcttactaaagaatagcatactgcatctttaagcagtagagggtaaactacctgcaaatgtgaatttcttagatacatttaaaaatatatagttgttaaccttctgtgtgccaaaaactcttaagttacattttccttcaaagcaatgtacttttttctacatatgcagtatgtagttagcataaaatcattggtgccatgaagattatttttaaacttaaataaatatttaaatatcatggaagagtgggctctttctttaataatagcctgtcttacttttcctcccttaaagttactaacacatagataaaaggatactggtgggatttacacagctgactactattcacttggatcatataacataattattttgcttgtatccacctattatccttgtccttacccccagataaatactgttagaaactgagaagcggccaggcacagtggctcacgcc

SEQ ID NO: 79091 - DNA, 1080 bp, Homo sapiens
ctttaaaattatgcaaatctctccctaagaaccccaattattccacagttgtcatattgtaaacatggacatggttctaccatctcgggggacaaaataggggaggtcaagtctacaagtgacttgttctgttctgcgtttggggctgtccaattagggtatcagcagctgctctacttttgtgtgggtccaggaatatgtccattgaccacccttaaataagccctcaagccccagatgacttagaaatctctccctgagatgaaaacaggatcttgtgtgtgattggttttagagttgaagagcttgggcctaggatcccacactcgcccttcatatgcctgtgctgcgtgcttcgaggacttccctctgcaaggatggtgatgctttcctagaacttatgcagaggatgaccctagggggcagcatttctacatctaagtgttggtctctgccacggtcacattctgtgttttgtaggcatctcttagaaatctattttaaaagattcttttcctggtcccttctaaggctgttgatcttggaattctattttctgaagcttttcattctcaggatcagtttctttcttgcatcgtttagttcatcaggctctattttcttaatccataaagtaaaaacaaaatatgaattgttaagaaaataacatttcgttgttaaaatataaattgaaatagtctttgggtcaagggggtgtatataaaataagcactgctatccaaatctcaacagtctctcaggtaacttaactctgctttctcttaactacactttgtccaacatttctgacagaactatctatctctggtaccactgaattcgtttaacgcccctggagcactataaaagtcttgaggttcttcggaaaaaaaaaatcacgttaagtctagtttcattatacaaaactatggtgatgcccactaggctctagactaaggggacagacttaccccacccctgatgctgctgttgctgtagcggtggtcccttcagatgcccactctgctcagatttgaaaaaacaaaaggaaaagaaaatccaactcagaccatcataaga

SEQ ID NO: 79092 - DNA, 1035 bp, Homo sapiens
cgagtttgaacaattccactatcaatacttttgtcccctcaggcgatggtttgcctgcaaaatccgctcagtggtgagcctgctcattgacacctgagaaggcatgactcctcccaaaaactagccaggtggaccaaggaacccggctacccattcccagcaatgggacccatcgcggaaccatcggcacatataccaagtcctcctctcatgactcaaagtccactgcagcctaggagggtgtttcccagaagaagaaagggataggctcatgccctgtctaaacaaactgggaaaactcattttcttcagaagttatttcaagaaaggctcagcgactctgtttctcatctttccaatttgcaggataatttttggttttgaattttgatttttcatagatgtatattattttgaagtatcaaataaaaataatttattttactattactgattattgcagtagtatcacctagcagaggggacactagttgaaaactagagagctgctgtcctctgtattctgcaggagcttttcctgctggtgccactgggttccagtagactcatcactgcagcctcagcagggcaggccagggatctggacaatggggactgtttagttttttgtttgttttttttgccagccagaacttttaaaaaagtaaacatccatgtagaatgattaaatggaaagttgcttcttatgatggtctgagttggattttcttttccttttgttttttcaaatctgagcagagtgggcatctgaagggaccaccgctacagcaacagcagcatcaggggtggggtaagtctgtccccttagtctagagcctagtgggcatcaccatagttttgtataatgaaactagacttaacgtgattttttttttccgaagaacctcaagacttttatagtgctccaggggcgttaaacgaattcagtggtaccagagatagatagttctgtcagaaatgttggacaaagtgtagttaagagaaagcagagttaagttacctgagagactgttg

SEQ ID NO: 79093 - DNA, 1032 bp, Homo sapiens
agagagagtttctaccccatcattccacaaagtcagaacagctagaacggaggctgaagagactgagagcagctgcagaaatccaaaaatattgaccttataagctcaagatgctgtatgctgggtttttacaaggatattcggtatttgatgaaacccagttaggcatgacatattccccttctccccattcctacctctcttttattaaaaattttatagttacagtgtctatgttgcccagcctggtcttgaaccctttggctcaagtgatccacctgccttggcctcccaaagtgctgggattacagatgggagccatcgtgtctggcccattcctgcctcttaaagccctccacccaacaggcagacttgagactcaaaccgtggtcccagctctgcatcaggggtagtttggaattcagattctttcaaactggggtaaaaaccaggcccagagttcagagttcaacaacaagcttccaagatgccgcccaaaggaaaaagtggttctggaaaagcggggaaagggggtgcagcctctgggagtgacagtgctgacaagaaggctcaaggtcccaaaggtggtggcaatgcagtaaaggtcagacacattctatgggaaaaacatggcaaaatcatggaagccatggaaaagttaaagtctgggatgagattcaatgaagtggccacacaatatagtgaagataaagccaggcaagggggcgtcttgggttggatgaccagagggtccatggtgggaccatttcaagaagcagcatttgccttgcctataagtgtgatggataagcctgtgtttacagacccagcagttaagacaaaatttggatatcatattattatggttgaaggaagaaaataaaatcatatgaaagactgaaagaaaaaaaaaaaaaaaaaaaaaaactaggcccaggacaccaaaggcaagaaaggcagaatctttaacaaattaggggctgggtgcggtggctcacacctataatcccagcactttgggaggccaggagt

SEQ ID NO: 79094 - DNA, 1186 bp, Homo sapiens
atgccttggaaagacagtggttctcagtgtgagcaggatcatgttcccttgggtgggaggagaaggggagcaaatcagaaactttaaaggggccttttcttttcttttttttttttttttgagatggagttttgctctcgtcagccaggctgaagtgcagtggcacgatcttggcgcactgccacctctgcctcctgggttcaagcaattctcctgcctcagcctctcccaagtaattgggattacacgccgacaccaccatgcctggctaattttttttttttttttttgtatttttagtagagatggggtttcaccatgttggccatggtggtctcgaactcttgacctcaggtgatccacccacctcgacctcccaaagtgctgggattacaggcgtgagccaccgcgcccggcccaaaggggccatttcaaaccacaggagcacccccaacacatacagattctgacgggctccccctggaagatgttcccctctctgccacattgagaatcactgcccagagccatgttatccctttgtaatatctcctttagtccaatatgtacagtccctgaattttggacacagacaagcagagaaacatggaagacgtgatgcgtgaatccaggcccagggagtgatcagtgagtaaggggcaaaaggtttgcatccacatcctgctgaagcctgtggaaggtgggagttggaacagtgagaggcagagaagtgctcactcactctctcccacacaccgtgtggcatttcgctgtgggaagcagagtgaagacgagcttgatttggtagatccatcttaattattcactctacatgatgtcttttttcctttcgtttttcttggcaaacatttgggcagagtagggttggtgggagtgaggggatgggttcttattaacttccaggctaagactcaccttccctttggtctgaggaaggcagtccatcctgctgtggttagaagatggcttttgaattttcttaggacagcttcttaaattttaatctatacacaaatcacctggggatcttgttaaaaggtgtaggtggaagtgtaggatgggcctatattctttatctccaataagctctcaagtgatgctgatacccctgatatgtgggctacactttgagtagcaagcgctgaggagagaagatggcttggtt

SEQ ID NO: 79095 - DNA, 1045 bp, Homo sapiens
actctgatttggacagggataccatctccaggaatacccttaccccagtttgatcctctgttctttcctacactgatctcactgggtattaggagttgaagactcaggaaggaggagctcatcaggtaattagcctggtcatagtcatttagtaattaatcaacaaatacttcttggccgggcgtggtggctcatggctgtaatcccagcacattgggaggccaaggcagaaggaccccttgagcccaggagttcaagaccagcctgggcaacatagggagacccccctcttcagaaactttaaaaattaactgggtgtggtggcgcatgcctgtgattccagctattctgaggctgaggtaggaggatcgcttgagcccaggaggtcaaggctacagtgagcggtgattgtgccactgtactccagcctgagcctcagcaacagagcaagaccctgtctcaaaacagaaacaaaaacccacaaatacttcttgaggatcatgtacagggcactgggctgtgaaccatgaatgcaaacactggacaccatgcttctgtctctcccagtaatggagaggagagtggaattaaacatgggaaggttagcattaggacagctaagcagtacaggcagtgcatatcatgagatcagagaaaagatggcttttcccaagtcactttttcaggtatgtctaaaccgcgtgtctctgcagccttgagatagctcaggtagtgccttgctcagattagaccctcagtagatacacactgaattgagtgtttttcccaatggttttccatccactttttggccttcaaataacacaatattcagttggcagcagatgttaagatttttttcagcagtaatatcccaaccaatgtgcagaggcacagaagatgacagggatgcgccagaggcctcagggagccgctgggctcaaggttcctgcctcccctccactcacccctactcttcttgaccaaaaactgaagaaggagcagtcacacacttccagaaaacttgcctcctctgtttgctctc

SEQ ID NO: 79096 - DNA, 1050 bp, Homo sapiens
aaatattgaccaaattcactcattgaatttgctagtcttttaacaagcaaaaatgtctaggaaaaaaaaatctcagatgtcagtaatcttaacacaaaaaatattgtcagtggagtcctctttgaatccaaaaggtaggcatgtttctaaatcatatattcacagagtgatggagtattagccctggaagggactttggtaatcatctggtctagggatgtaaagtagttggtgtcccagctagagtcagagttcttgtgtctcatctcccagtcagttcattgtgctcacctgacttctatagttgcagctattaaaatctaaatcagctattaaaatattcatatcgactattaaaatctaaattatgattattttcaggcgcataatgtcagctttgctaacactacctcagatccatttgatttcttgggaactaccaggactgtatttggtttatttttaaagccaagcagctttataaaccttaaaatatttcgtcttcgaaacctaaaaggctctttatttagtccatgatgaatatttgagtagtgttaaatttatcattctggcagtactcacattgtacttgtcattaattgtgactcatcaaagaatgttttgatgttgagtccttggctaacagatggctctgtttagaggaattgaggcagtgagctatgaggtccaaggagagagacttcttaaataattattcactagaggttgtttgaatttgtaagaaagcacagtaatctgtgggggagggaagtttagtctttgtgttaaggcttgagaaggctttttttcagctcccttcagaggatgcataagagagttgatgtcagtgttgtttgtatgccaggtgtgggctggaatgacacaaatggccagcagagatgcacacagttgaatacttgtttgtttctgtttctaaggagtctgtcaccacctttgtgacatagccatagagaccaccacacgggaaagaacaggagctcaagcaataggagtactaataagaacttgagtatagaatgtaaagcaatg

SEQ ID NO: 79097 - DNA, 1060 bp, Homo sapiens
gggaggccgaggcaggcggatcatgaggtcaggagatcgagaccatcctggctaacatggtgaaaccccgtctctactaaaaatacaaaaaattagccaggcgtggtggcgggcgtctgtagtcccagctactcgggaggctgaggcaggagaatggcgtgaacccgggaggcagtgcttgcagtgagccgagatcgcgccactgcactccagcctggaggacagagcgagactccgtctcaaaaaaaaaacaagaaaaacaagaaaaggatattaactaaaatctagaaagaagtcatatgatgatccagtcataagaattagatattcggcctggggaagggaagacttggaagacatgggataggatagtatcaaatatctgaaaagcaatcatgtagaagcctgggtggagttgatctcttatccttcggaaagcagagctagggtcagtgggtagaagttgcacactagaagttacctaggagaccttacttattattaagaacttgccacaaaactcttcaaaggtgaatgggactacctgtatgaggtggtgagctctctgtcatgcacgtggaggctagaaaaccatagccctgagattaggactgtacagttgtataggttagttattgtacaagggcacccggccaagggggcaactggggctgaaatccagccagtgctgcagtaactacatcatgtatcctggcattggttacccagaggaagaggtacctttttatagttcacccaaagatgccccagatctactagatatagaaaggttttcttatcaggtgagagatcagattagtaaccgctaaccccctgccacatcttattgtccattagtctatggtcacagctatatttaattaaaactcaataaagtaaggtgaagaaaatccaagcaaacaaattccatttaacccaaaggagaataacttatatatgctttttaatatattgatgcatttaaaggcctccctaaccccatcccacatgatgttgtgtgatgtgctgcaggaggggataagagagagatggagttggt

SEQ ID NO: 79098 - DNA, 1003 bp, Homo sapiens
ccatatatatctttgttaaagtgtctgttcaaatcttttgcctttttaaaaaaattgcgttgcttgtttttttatggaatgttgagggttctttttattctacatgcaagtccttcatcagataaatgctttgcaaagattttctcctagttcttggcatgtcatgtcgttctctcaacagtttcttttgaaaagcagttttaaattttgataaagactaatatatccatttattttatgagtagacatttatttgttttttatgggttgtgtttttggtgttatatttaagaagtatttgcctaatccaaggttacaaatgttttcttctataaattttattgttttatgttgtacattttggtctatgatccactttaagtttttttttttttaatatatggaacaaggtatgaattgaagtctccctctccctttttttttttttagcacatagatatcccgctgttccagcaccacttctttaaaaggctttcctttctctgctgaattcccttttacaccttgttgaaaatgaacatgtgtgggtctatttataggctctttattctgttctgttgatctatttgtctttctttgtgtcagtaccacactgtcttggttattgtagctttataatatcttgaatctagatcatattagtcctccaaatttgttcttcttttgcaaacttgttttgcatattctagatccttttattgccacatgaattttagaattcatttgctagtttctacaaaaaaagcctcctgggattttaattgagattgcattgactctatagaccaatttggggagaatggacatgttaacaattttgaatcttgaaacctataaacatgatatatccctctgtttaggttttctttcatttctctcagcaacgtcttattgttttccttgagttgttagagttttaaatatttgctaatcacttgtgtgtaaagtggtgtctcattgtggtttcactgctgacgaccag

SEQ ID NO: 79099 - DNA, 1038 bp, Homo sapiens
gagtattgaaagagaaccaagggccagcttctcattaaaatcagaggcaagaaagcatctaaagatcaaatgacttaaatggtagcagaaaagactttaggaggtaaataaggaaatgtttgtttgaaggcttaatggaggatattgtgttagaaatgctgagttattttccctagtactaactttctaatagcaatgatgttaaggatatctccccacaccccaccagcattctcagttactgaaggacttctgcaggagtgggacagtcccctattagaaaagctggcatagttgaggttctacctatatttaagcagaggtagattttattagagaagcactcaagtgtagcttttgatttttttggaagcatactttatagggcctgaataccttattaaaagcaacataatactacattaaacgagtaaacaagcatctagggaaatcacacttacaatcaattagatttatagactagtatttcgaagcaaaaacaggaggaattcaaatggaacatctaggattctgagcagcacattggtcttggaattcaactacaatctaatatgtcttggttcctttaccttaaatactctgttctccaattagagttggttttgttcttcaagtctttattttcacagcatcgcccgacttctatgttgcttcttctttaattttttttaagtaagaaacattctgctttatctcattatttaaccattcagggacacttcccaggcttttctatcatttgtgaagaacagtgggtaaaagtaaagcacaatcattctggaaattctttatgaaacagaaaatatataaaaatattcagagtatctccactaatgcctgatgacaattcatttggacttttgaactggagagaaagaaatcatccaatagttttgtgtattgctatctatgtttctttttggtcagtaatgtatgtgttatttccaaatggccttcctccatgaccctcatccaattcatgaggaataacatattttgaatctcagaaaagactgc

SEQ ID NO: 79100 - DNA, 1316 bp, Homo sapiens
ttcatacgtttcgtcacaaccactttcctcatttacattgattagtttgccttcactaagttcctctggtgcatatctagagtcccttaaatagcagcaatgtcaataatctcacagttagctatttcttctataaccctatttacattcctgttaccactttttgttactttgctgcattttcatcttcgttagccagttccctctttcagttatcatttttgggtttcatcattggaagacaaggaggcaaccccaccgcacactttgttgtttgtgcattaactgaataacagatgcacagtgactagtcaccgacagactgtgaaagaagtgacgtgatttgtcactgatcgtgatacacatctgttatttatgttgtgaactgaagagctagcaatcaagtttgtacttcatgtaattactcacagttaataaaccatggcaactgaaatttcaaccctgttgtttggggactgacattctttcatctaagaaccatgcaaagtgaggacaacctcagtcaattcctgcattccttcaggcccactgctaattttctgattcctggtcagttatctactctgacattcagatctttttctggtatatatgccttactaacttcatcttagtgaagtttctctttctcctccaggggcaatacctttgatctttcctctctgacatttatgctcttggcttctgaccattccttcaatctctaagtttgtttgaaatactgatttgccccgctagcttgtgatcgtttgcaaattaaatagacatttctccattcattaatgtgaatacttatccgcacagaatgtcaattcctgaataccagcacaggttcacccagccagctcatccttatcctttggtcatatggtccagtcagttgtgtaagggactctgtaaaggtcctgggtggggcctcagaatctatatatttaaatgttctccatattatagccaagtttgatttataatataaaccatgctttcctggttcttagtaatcttactatagactactagaagtttagatctgacaaatatactagagattgtcttgtcaaacctactcattttataagtgagagaactaaggtccagagttgccagatgacttgcccatggcttcccagttacaagcagagtaggaactagaactgatggttccaaacgcccaatcttttttttttttttttttttttttgagacggagtctcgctctgttgcccaggctgaaatgcagtggtccgatctcggctcactgcaagctccgcctcccaggttcacgccattcttct

SEQ ID NO: 79101 - DNA, 1073 bp, Homo sapiens
caataccttagttccacattgaaccagttgaagatgttaattatattatctaacaaagtctctttagtgtgatgtaggaaatacctcacacaaaggaccattttactatatataatataacatcatgttgtataccttaaatatatataataactttttttaagacaggaaaaagaggcctttaagaggcctactggaagtagaccggagatctcaatgtcatgaacattgaagaacatatatttttgttgtcattatggttttattgtggttgtttggaaacaacacaagtcatatggactgaaactgttaattgtttcttgtggcgtgcatgatcattctgatttttctataaagagtagagatagatagacgtgtttccttttcatcatttgcaagcattgtctagattatggggaggcaactgccactgttagatttcaataatataaaaagaatagaaatcaggcccaggggaaaaatccactcactttggtagtagaactacatcaagaaagctcaggggcaaggagacaacaggcaaggagacagtttctcctatggagacagactaggttctatcagcaattctggtatcctgtgtcattgccagcaggcaccctgaagggaatgagatgaaccacaagagaatgtgttggtaagaatatatcctttgcaaccttactgcagaatggggaatttcttttgagcttgatccgtttttgttccctagagtcaaaaatatgttttcttgaggaatctcaagagtagaatctttgggtgtggattggggagaggagtgcgcagagaacaggacaacaatgaaggctggttttagagaggtagagcaaagatgccgtaaacaagcatagtagttagagtattgtgagatgaaatttgggagttacccttcaggcctttatcatcataagagtcattttctttctggtgctagcagcattcttctgttaaggtaggtcccctgtgtctgtcttcttgaaagtgggagttcaaactttctctcttttctttcttctcatcatgactagagtatacctgagcagatatttgtg

SEQ ID NO: 79102 - DNA, 1074 bp, Homo sapiens
agactttggaagtgtcatttattcagtggtgcacttacagtcagccctctctatccgcagtccatttcacttgtctttgggatatctttgcttgagaaacaaaatgtgaacaagcagtcacccttttaggaatctaggatttcttagggagatttattaagtcaatatttgtcagtatctgctgaatccttaaaatgaaggtctttagaaatttgcacatagcagtgaaagtgaacagatggtgagttcaggaaggaaaaagaagagtcaagcagtaaagacagatggacaccaacaaatatgaattgaatagcccatttgttccctctttagctgttgcacttgaaacctctgatttctgatcccaccaaaagtctagtgaaaaatgctcctcgatgtctcgctggcatttttctcaagccccatcctttttgacctctgggtagcattttctgttgtgacctcctacaccctcttgagcctctttcttgctttgtgacagtctgctgattctcagattactgctctgatgattccttctttgatggcgtcatcagggtctttttcttatcctaaatgcaagtattccctaaggttctgccctttacccttctctttcctcctcctttgctatctcccttgatgatctcatccactttcatggcatcagctcatttgtatgcataatagtctcacatctatagcttcagcaatccagacctctcctcagggcttcagtcgcacatttccaacagcctgtcaggtggcttcactaacacttcattgtgtccagaaccacacatcatctgtccgaccttcttctatttctctcctgggcacctgttcttgaatgacatcagcattctccaagtcacctttgactcttccctcttagtgatccccacaacagttagttgcctggacctgttgatttatatcctaaacatctgttggctctgtctctcaattcccattgctacaaacttcactactaccgtattaatttctccagagagcagttcttatcgtcttcagttctctacttaaaacttttaaggatgtaaagtattagga

SEQ ID NO: 79103 - DNA, 1357 bp, Homo sapiens
tacaacagttattattattatctcttattatccaaggccactctatttataaaattgtagtagctagactcgaacccaagtcttcattttttttttgttttgtttttgagatggagtctcactattttgcccaggttggagtgcagtggtgtaatctcggctcactgcagcctccacctcccgggttcaagcaattctcctgccttggcctcccaagtagctgggactacatgtgcatgccaacatgcctggctaattttttgtatttttagtagagacagggtttcgcatgttggccaggctggtcttgaactgctaacctcaggtgatccacctgcctcggcctcccaaagtgctgggattacagttgtgaaccactgcgcccaacctccaagtcttcatttgccagaaatggtagtttccacaatgccattgctgcatccctatggcctgtttcagggtataatgaagaaatacattattcgtatatataaatattaactaccttataaggactctgatggtttcttagtaaaacacttcagtggtataattcccactagattgctcagttctcttggtcaaatattatgggtagttttggtaggttttttcttttctgaccagatctgccacattttgtcagcattctgggtttgcagatgttgctgtttaattagattgctctgtagaggatgagagaaccaggaggttcatttgcataactgataagtggctgggttttgaagcaagagataatgcttctttgggtcctatgaactggtgggaaggcaaggtgttagtctttttctgttggagattatctgtaaaccgggaacttctccacatctaggcactccctgtatctgaatattgtattctgaaccttactctgtactctagcaagatgataaatgtaatgcagatataaatcaacctttcatttacttaaaataataattctgcagtaaaggaaaaaacgacagctactctgatccttgaatactgggcaaaggcaagccatctatctgtaagtgcatagtccttcagtatgacgtaacctttctcatttaatgaacattttcccctagtaactctttgtgctggcaaaccatgaaagaaagcatgtggacttggcagcccaaccctgaagtttttgtctcaaaaattattgcaatttctgtactaagggtccaaaggacatttgtttggacacagacttttctgaaattaaaaagaatgaccttatttcacttagtgaaatgagttgtactcttaaatagagtccattttgaatagtttttcttagagcaacactgtcaaaaaagaagatatattttatattcttctcattatt

SEQ ID NO: 79104 - DNA, 1050 bp, Homo sapiens
tcccagctactcaggaggctgagacacgagaatcacttgaacccaggaggcagatgttgcagagagctgagatggtgccactgcactctagcctgggtgacagagtgagactctgccccaccctgccccaccaaaaaaaggaattaaggagggtggaaggaaattaggctgaccataattgccagagcctgtataagtaaagtgaatgagaaaaggtgtgattttcctggatcaggtttcagaacttatcctgtttaacaaagaaaatcatatgttgctgattcccagaaaggcggtaagtgagcagccaccaagcctggctctcaagagtggtaggctcctcacctgtcattcagtgggcatccatatctgttggctttctgtatactattcatatttaatactccctattttcttaacactcccagctctaattcttccacagatcctactgtaccaaattttattccaaagtcaacagcatttcacatttatacttagaatactaattaaattatgagttaccatttaatgcatagagtaccctaataacctgaaaaatgaagacttgcttctgatgttgacttactcagttgttcctatactttggcagactgcatagatgtataagatattagatataatacatataattacatatatttgtgtgtgtgtatatatatgtgtgtgtgtacattctcccatgcatctcttttgtttgctagaatatccttcttatcaatatctaacttcctttaatgtccatttaaatggcatttcctctatgaagcctccattcactctctcttaacccctagctagacgttacctcttcccatgtctacattccaatagcatttaattatttttttcatagggagttttaatgatattttgttctatattatagttatttgtatatatttgtatcccccctaataatggtgatggtggtagcagctaccatatgttgagaactttctgttggccagccactggattaaactctattcctcacaataccactgtgagttaagtattactacccca

SEQ ID NO: 79105 - DNA, 1514 bp, Homo sapiens
agaggttgcagtgagctgagatggcaccactgcactccagcccgggcaacagagcgagactctgtctcggaaaaaaaaaaaaaaacaaaaaaaaaaactagaaaagaaagtcagcacaggtttccaccagccctctttattccttctgccgtgaaagtggcatgaccaaaatcagggctgttgcttctgcaagggtcgcagaataagagtcatgtaacagaaaccaagctgcccctgacctgaatccaaactgcactgtagtgagaaaattttgtccttataaacatgaagatttggggttgttactgcagcaaagctgacttaattctttccaaatattccatgttacataacaagaggaactaaatatggaaaatattctaacctctagtttttttgggttttttttgtttttgttgttgttgtgtttgttttttgctctggagaaagaagtgaccatcgttatggaaataaatgctatgcatacagcatatccaggtgaaaattagtaattaaaggatagaaagtcttattttaagattgtgacattgttatagggacgtaatatagagaagaaggtactaaccctattcagtggtgggttaattctgggttgtgatcccagggtcattgtccacagtttgtgaacaaccatgggatcctttctgtctttatttgtgtggatgcaagcgatatagctcagattccaacaaacaccacagattcttcttgctattttttattgcattgtattttaggaatttgtaaacatgtaagatttatttagtggtgaatacacctgtttatttacttacgccagaggcaagcaaaagaactggtagacaatgaagaaagaactgttgatcccacagtgatcattttagctaatctgtgcacacatggtaatcaccatgagcagaataaattttggaaaaagaaaaatatagtagctttttcctttagaaatgcttaggattcctctggatttgagtggttggaatttccctgctgatatatttctggtttgtatatagaactgcccaccattttctgtttgagaaaaatcatttcatcatgctcaaaccttgggtttgctaagaaaaaataatagtcctaacttcggatactttattgtgatagacagggcttgcaactgaatctgataacagattcgtagttcagttctcttgagtaaataaataataagctgtgaagaaaagcaacaatgtagggccaaatcacttttaaagtaattgttcatgtgctataaatgtggaaagggaaaaaaactagatagaacatgagaaatacagtaatagttaatctagtgtattttaatacagtcaaatgctattttaaatcgtagaataggtatgacagaagagggtaatgagtggaactttttgcttaagacaaaacatactgaatgaaatttgtttctatcaagaaagagagaggccagatgtgggggttcatgcctgcaatcccagcactttgggaggccaaggcgggtg

SEQ ID NO: 79106 - DNA, 1058 bp, Homo sapiens
gtgaaccaaatgtaagttaaatatggtggcaggagccattccataaaggttacaaacttgttttaggagtgaagtggggacttttttggcttggtgccaaaatggaactggcattgttttttcaattcagcctgcctggtatttctatcatagctttgctagttgatcagtttcctctcactatggcctcttattcattccttcatttggcaaatatttgttgaatacctacttatgtcaggcactgttaaagcagtggatgtagtggtaaataaaatagaaatggtttagtctatttctttgagccttcctcagagaaaatgtcacttctttgtcaatgtctttacagcctttatcctgagaccaggagagaaaaattacctaaatatccagtctagtttaaagcttaaactgatccagtaattcagacagtcccttggggtagtgtcataaatgatggccataggtgtctcctggtctcaggggcaaggtccctcatccactttagtgctgcttgttctgctgtcatttagggctgaaatatgtggctgtaggctgcttgctcagaacccagtagcactctggctacctgggcctccccctgacttctggttgcacccccctgagcctctggtgtgtctgccatccagttcatcctcttataatctctcagtatctgtgccttatgggaactatgggggctcaggaaacctgaacctcagacacttctctaccagacctgctacaacgctgagtcactgtttctgtgcaccatgttgtggtggaggctgcctgagagttgatcttctctagactcccaaacatgaagaaggagtgggcacttggcctttgattttatcctcacttatttaacaaactgatttatctccaggctgaggaaatcagtgttgctttgctgcacttccatctcgcatagtctggaagtctggaaggactttttcctacattatatccttctcttgccatagacctagcatggcagttatagttggatggaatatctcctctacactcccttttgtatgggcatgttggtt

SEQ ID NO: 79107 - DNA, 1046 bp, Homo sapiens
agttttgggttttacagttaagtctttatccatcttgagttgatttttgtatataatgtaaggaaggggtccagtttctatcttctgcatatggatagacagttttcccaccaccatttattgaatagggagtctttttccccgttgcttgtttttgtcagctttgttgaagatcagatggtcatagatgtgcagccttattcctgggctctctattctgttccattggtctatgtgcctgttttagtaccagtactatgctgttttgggtactgtagacttgcaggaattattttctaccctgcttgaattttaaaatagctctcaagggacctgatccataaagatttgcatctataatctatagagttggagcagaataatcatttgataaaaatgaaagatgtccccatttttagtttctctaacgttcaagtaatcttaaagttaaggcagatgtaaggataagatgattggggaatatcatgaaaatagccaccaaatactggactacgtgaaataggaccaaaaggggttaacattgccatggactgaacatgtttgtaccctgcaaaattcatatgttgaaacctaatccccagtgtgatggtattagaagatggggccttcgggaggtggttaggtcatgaggatagagtactcatgattgggattaatgaccttataaggggttgaagataccagatttctccccttccaccatgtaaggacatattaagaaggcaccatctatgaaccaagaagagggcccttaccagacaccatgaatggctggcaccttaatcttagattctcagcctccagaactatgagaaataaatttctgttgtttataagccacccaggttatggtattttgttacagaagcccaaatggactaagacaaacattaattttgtttttatattttcatagagaaatgatgggataactgtaatatccagttgtgtgtggcttttttttctcccctgtggaagaggggccctgggcagaactttatattcttgcacttttcaaggacttc

SEQ ID NO: 79108 - DNA, 1028 bp, Homo sapiens
caagggcccagctgccggtgcctatactctctaaacaacttctctcctctattttcaaagacagagtcagaaatagtaattagaagggacccaggagggttttttttttttaatttgaagataagagaatgttgagcaggtgcgtgagggtgaagagggactaattgaaggaacttagttctggaagagattgaaaaaagaaaaaacttgagagaagttcaaccttggtcaggagaaatgtgcccttatcctctgacactagcttaagggttgttatgtctgaaacaaaccacagagtttggagtaggcatttctggtcttgttttgatcctgttgacaagtgccctctcagtacatattatgggcaatgctgcgttaggatttgttcctttaatttttgtgacatatgacgcagtttctctggccagaggcttctcttaggtcagcatacatttctcacttagttcatccaagcagtgccttcagagagagtttactacgaggaagatctgtcaggagcacatgtataacattttttagtcattctagttagttggcttcaggacaaaataaaaacctcccagctgatgaatacaaagtacctgatgtcaccttcttaaatgcctcaaagtagcatggggctactcaagttttatgatatataaacataaaatataaaacatagatttttaaaaaatgggatcaacactgctcaggtggcagttggtccaaagaaaaaatagtcaggtaccaacctctaataagaaacatttgcataatggcacatccctgacagatccaaaagggtctccaaattttattacttctgttttaccctagcaacattaataagtacatcataacaggcattttttggccaagaaaaatcaaatactctttgggaggtaaaacggattttgatgccttcaaatgaatgctggaggaatttggcaaaagacattctagcaaatgccaaaatagcagtcatccaggatactgtgtgtttgactcacagccagtcaggcaca

SEQ ID NO: 79109 - DNA, 1202 bp, Homo sapiens
gtattgtggtgtttccaagaatttgcaaacactaaaatgtaaaaaggttaggaactgcttagaaaaattatagtgaccattgctattcttggaaaagtaattacaccaacattgtattttaattccagagccaaaaaaatgtgtgtcagagtcagctagcaaacaccaggaaagcggctgtgaaggaagattgaaatttaaattcatattagcctcttgagccagtatttttgtgcatggcccattgtacttttctatttgccttgagttggcactggacattgaataaaccttgaagacataaatgaaaatgtgtatgggtatggaaatgtgtaaggatatggaagtgtccttggtgcaataaagcgcataatgcattttctgtcatttgtcatcaaaattattttttcactatgtgtggcttgtctacttccattcttgctgtgaggtattagcacatttgtagctatttattaattcccctttttattttctcttgagttctgtcctacttgttccttattcagggttaaatttaaaatgttcacatctttttctttggggaatatttaagaaaggaagactacgacatcactccatcttcttcaatgaaaggagaacttcattcattcattcaggaattatttgctgagtatgtactctgtccagggtattatgctaggtgttgggtgtttctaaattaatcaaggagatgactgcagagctgatttctaaggtactgtttaaagtaacatttcagtgctgtgcataatgatagcagcaaagagactatacaactgtaggtcagaagaaacagaataattccactgaactatctgtgacagagtgacaaatgacaacagatcttgttcaagccctgatcatgagctgaaggaataactgcatttcctattagtcagatagtgctttgacctgatattaaagtcagctgttctcatatttaggatacaacagcattgtattcacttatcaaagagaatgggtgacaaatactacatttctcctttctgctcttctccttctgccccttccttacactctgaatgccctttctaaccactcctatcattttgtttctcctccttctatattagtgtactgtctattgaagaatagtctttattactagttttattgtcaactgatatttcttaataaatcatctgatcttccatgttgaa

SEQ ID NO: 79110 - DNA, 1025 bp, Homo sapiens
aacgacagtgagataccacctcatacccattaggatggctataattaaatggatagacaagccttgcttgtgaggatgtggagaaactagaaccctcctatactgctggtaggaatagaaaatggtatagccactttggaaaacagtttggcagttcctcaataagttaaactctatgtttatagagttaccatgtgacccagcaataccactcctaagatgacaaccgagagaattgaaaatagatgtccacacaaaaatttgttaatgaatgttcatagcagcatttttcataatagcttaagagtggaaacaacccaaatgtctatacactgagaaaaggataaacaaaatgtggtatatccatgtaatagaatatgattttgcaataaaaagaaagtactgatacatactacaacatagatgaagcttgaaaaagttatggtaaaacccaaagggccacaagtcgtatgattccctttttataaaatgtccagaataggcaaaccattagagacaaaaaatagattagtagttgccaggcgttggtagggattaggaaatgtgttggcaggaatgagaattagctaatggatacagggtttcttttaggagggacaaaaatattctaaaattagattgttgtaaacatatcaaaaatcactgaattgtgccctttaaatggtgaattttatgataggtaaagtatatctcaataaatccatttttgaaaaagaattgtttgtcatagatgtttgtattataaaatttattgatctttatggtagggaaagggtcaccccaccaacacataacatttaaaactttccacaggcctaggaacattaagctaaaggacaaatcagacagcaggccagagggcacccgtgtctggcctagtaattggtcagaggaagtttaaacagttttttctttttccctctcccctcctttcccctcctctcccctcccctcttttttgagacagtcttgctctgtcgcccaggctggagtgcagtggcacg

SEQ ID NO: 79111 - DNA, 1026 bp, Homo sapiens
acaacactgtttgtcatgttattagtagctgttaatcctttactataactgccagagattttgtgttttaaaagacataagtgatcatatatacattacataaagcagttgaacatgagaaggcacacaaccatagatatattccataggagtgttttttataaaatgcacaatttcaatgctttaaaggttgggtgcttacagtttgctatttgctttcacacatgtgatgacgtttaatcctgactataattctatgaaatggaaattattaatctcattttgtgaataacttgtcttgctcagtgcctcttcttttcatattctgaattctttcctaaactatcttatctgtgcttacagcttcagttaccatctataaaattagtaactatatcaaatttatatttctcaccctgagcttcagtttttttatatctaattatcttgttagcctttccatttggatatctcagaatgaactgcgctcgtggacttccctatcaaacctggtcctcttacagtgttttctttattaatgaatgacatcatccatcgtccatctgattgtgcaaaactagaaacctaggtcttgccttaagccatccttattcttgtttcatatccagtatgtcacagagtcttctcaattttgcttcctacataactcaaatctgtctgcttttctccatctccactgccaccgctcccatccaagctctctagcatcatctttttctgctattccagtaaaaatactagtatttgggcttttcacccactcatattcattctccacacagcaaccagaacgatccttgcaaaacactaatttcaagatgtcactacccatcccaccctccttaaaactctaatgaactttacttcaagaacttcccattgctcttaaaataaagactaaatctttaccatgactggcaaggactactgtggttgctttccttccatgttcatcttttgccagtatccccctaactctctgagctttttaatgtaccacattct

SEQ ID NO: 79112 - DNA, 1087 bp, Homo sapiens
ttcatgacttccaaaagaaacctcatgccccttagcagtcactccacagttccccagcttccggtctgaggcaaaccacaaatctactttctgtctctatagatttgccaatgctggacatttcatataaacataattatacctaccatgtgtggtcttttgtgactggcttccttcacttgatactgcttgatatttgtttttttgaaatattcttgtatttataacttctcctcagaacagatgtggtcttgtaattctcataagtccttctgtggcctggttttattggatttgtgagatttggttaagttgcagaatatactgttacacgtcaaataacattggctgctgatgataatgaaaatggccctgtttcagagctaagattaggttatagatgtatttcataaagctgatccaaactatggatgtggtcaaatgaattgggatatataggactccatggttttcacactgacccattttctaatgggttatttgaggctttgaggtttttaattcctaaggatcataaagcgctggaactggaagggacccagcagtcatgaagcttagtccctcttctctaactcctatcccattttacagaattcagaatgttcattgttcaagatcaaatagttaattaataacagaaccaattatagcaaaattagaactaatgtgtgtcgattcctaatccaaggttctttacttccttttggattttgttgctgttgtatcctgggttctctagaaacaagagcctgactggaaattaagtgaagctttatttggtggtacaatttcagaagagtaagagtgaaggaaaagagatgagaagtgagaagctttgagaagcaaagcaaggcgattagattaccatgttagcaattgtgtcatgatgatcctcaaagagacacagctggttattcagcaagtacatatgcttgaccatgtgcaatatctccagataggatagatagaacagttcagccaggcgtggtggctcacgccagtaatcccagcactttgggaggctgaggcaggtggatcacttgaggtcaggagttcaagaccagcc

SEQ ID NO: 79113 - DNA, 1053 bp, Homo sapiens
atgtaattaagtggcttctcaccttttctttttttaggcagtcgtcatagaattatcatttctgccctcttgttccattatggaatgaaatttctgttgtcctaggtcatcagtgcctaagccatttggggactaaaaaaataagtgtgctgtatagttgaggattttattatttctgccccaaatattttgactttaattttgaagggaatatttctaagatgtacctttttaaacagagaatgtttatcttactttaatctattgttgattcaaggtcatgtttaggaatgtcagtgttctgtgttgtagatatatatggtgcagggcatgaagctgaatgatttaatttgtcactgtagagctcagcactgtcacagccccttctcccctgggcccttgaactgccttggttttcacgcttctgggtatccacctagtgtggatactaaggagcatgtccttaggcactctttgcatgctgtcttccctcgctgccttcaagggctgcttatgagctggtaactctttgttggattaggctgtagaatgagtttcttttctccctcttttgtaactggctttcttatgtgccagtgtctgctacttgcaaccttgctgcctactctgtcatcatttccaacctctgcttctgcttctaatctctgttctatctgacagctctctccacttaccttcttgtcttctcctttgtgtcgtacacattgtcagcagattggaagaaggcttttcctacaaatagccagtgcagctctttagcacttttggctatttttgttgccaggtgttcagggacttgatctgaaacttaaatactattttttaaaggtgtttctgaatttgaaaccagggatttgtccagaaacctgtctctatataaatgaagttttactttaccttataaaatatagtgaccctagctgggtgcagtggctcacacctgtaatcccagcactttgggaggctgaggcaggtggatcacgaggtcaggagatagagaccattctggctaacacggtgaaaccccgtctc

SEQ ID NO: 79114 - DNA, 1948 bp, Homo sapiens
gggattggttccaggacccattgaggataccaaaatcccttatataaatggtatagtatttgcatgtaacctatgtacattctcccatatacttttttttttttttttttgagacagagtctcactctgttgcccaggctggggtacagtggtgcaatcttagctcactgcagcctctgcctcccaggttcaagcagttctctgcctcagcttcccgagtagctgggattataggcacccaccaccatgcctggctaatttttgtatttttagtagagacggggtttcaccatgttggccaggctggtttcgaactcttggtctcaagtgatccgcctgccttggtctcctaaagtgctgggattacaggcatgagccacagcgcccagcctgtagctactaacttttgaagtaatactgatacttcttcagaaagaccgtgtcttctagttttaatattggaagtaacatctctgtggtccccatggtggatacagtattttgtgtggtatacatattcataatcaacttacttgagaaggaaatttgggacttaaatttttataaacatgaactttttaaagtttattgctgccaaaaatgtttattgcaaagtaaaaaggcatcaccacacaagaaaataaagtctttatttacatcaggaaaataaatgacaaaatcactgtgaaagagtatacagactactatctaaatatgttgcagcaaggctgttcagattgtatttcctgcacttgtatctaacctacaatttctcacatttcccactgacctcactatctggaagcctagcagctttgtgcatctcacaaaagacatggtcaggaagaatgaactgtccctagccactcatgtacctgtacacttcatttgttcagcaagcatgtgcatgccatctttgaaagagaagtattacgtccggtatcagaaaatggtgggggaaagtgattgctggccgtatttcagatttaacaccatatgggaaatgttaatgcatctcgccattagaaaagaccatgacaaaggctggaaatttaaagcaaagatcctgcaacattcataaccacccaccccagcttattttaatgcaacgagtaataatagtttttgaaaagttaacattctgattcaaatgtcaaatgtcaaactttatggacttccctgacagcagcaggtaaattggactggcataacaaactgggatgagtagttacacatttatggcctatatcagaagctctaaacaattcaaagcataaagggtaatgataatagtccagccaaagggccagactaatagtgagagaccactggccgccctttattgctaaaaagcagtaatcttggtgaagcttgggagaaccctacacttttctttaggactgaggctgtgagagcatccatggacattacagtttgtctactttaagcccagactgaaaccataatctctcccaaatgcattgagacttgtccctgaaatctgcccctagattttgactgtgaaggagtcagagttaagtaactatgatattgagaaaagctggaatgtctaggttgtgggaagtgagagaaaagagaatataatgataaaattgcatctgtaaatcacataagagtagggagtcaggaaggacataggatttccccattgatgtatctttgtgtcaagagctgaaaaatgtaggagggtactgccttactcttctgagctaatcaaaagcagcagcaagtacacagtgaaataagatttagttgttaagtggcagagaagagtgttacagtttgaaagtttatgttgtatactagacattatgtctaagtactgtggaggatagagagacaaataagaaacagtttcctcctgttcactgagcctatatatttttaagggatataaaatgtttgcacacaggggcctgtctcagtt

SEQ ID NO: 79115 - DNA, 1050 bp, Homo sapiens
aacatgttctctcaactctgatagatctgaacaactcatttttccgtgaacacccccttgccactagtttcctgcgtaatgccttttccccagaatgcctgtcttccttcagttcttcctatggaaattctgtgtaaaatttaaatgccttgaagtctctgttgatcatctcttccccttccaccagagggcgctctccaatctttgaatccctatcacatcgtaaacgactgtgtggcccttactatttgacctcgtattatagcttttgaaagtagattgtgaattctgtgaaggcagagacttacctatctgtggacctctccagcagccacccagagctagtagagctagtaggtatttcttgaattgatttattgaattgagtatttcttgaattattttgatttaaattgaaaacaagaacctggacacctacatctgtggagaaaaatcttgaaaagataaagcagaaaacatggggtagacagtgggaggtgaaactgagaaggtaatttatgctttagctttacagcaaatcagagcacctggagttgaaaacctcatttttctgaatgtcagttttgtttttgaaaaacaatcagtgcatagcatatttactctttaatctcaaaacattaagagtaaaaaaaaagtggaactggttgagtaaaatgatataaagtcaccttatctgacaaactgtatcatctgttttgaatgaaggccctagaattgttgtgaaggatgtcatgttcatctcccaattatggagataaaaagtaatgagtgcaggaactttgtaaactctaaagcactgcatataagttgacctttaaagttaaaaatatttcttacaaaatgtaggtcagtttatatgcttattgactactgttagctggttggtaggtggtagcagtctctcagctggctctttaaggatgggtgggtcatgaaatcaatatcatgaccaaaatcaatatattctcaaggataaacccagtcccaaacttttatattaaactgtctaagtcaacctgtgtactagat

SEQ ID NO: 79116 - DNA, 1057 bp, Homo sapiens
tcatataaacggaattctgcactaagtggccttttgtgtctggcttttttcatttagcataatgttttaaagattcatccatactgcagcatgtattaatgttagtacttcatttttatggcaaataatattcaattatatggatatcccacattttctttactcattcatcaagtgatagacatttaagttgcttccactttttggctatcatgtataatgctgctatgaacatttgtgcgcaagtttgtgtggctatatgttttcatttctcttgggtatataggaatgaaattaattgctgggttatatggtaactctatatttaactgtttgagaaactgccaaactgtttcccaaaatggctgaaccattttatattaccaccagcaatatgtgagagttccagtttctttgcactcttagcaacacttgttattttttattatgtccatttgtgttttttactatgaccatcctggtaggtaaggaatagttcactgtgtttttgatttgcatttctttaatgataaatgatgttgagcatctttacatgtgcttattggccatttgtatttacttgaagaaatatctgtttcaatctttgcctatttttaaattgcattatttggtttttcattgctgagttttaagagttctttgtatattctgggtgccagatgattatcagatatcaaatttgcaaatattttctctcattctgtgggttgtgttttcacttttttggtagtgtctgctatggtctgaatgttgatatttccctcaaatttatatattggaaataatccccaatgctgtagtattaagagttggggcctttaggcgtgattaggtcatgagggctccaccatcatgaatgggattagtatgcctataaaagaggctcaaggggcttgtctctgccctccaccctctgaggatgcagcaacacggcatgatccatgaggaacaggccctcaccagacaccaaatctgctggtgccttgatcttggacttctagcttccagaactgtaagcaataaattatactgttta

SEQ ID NO: 79117 - DNA, 1073 bp, Homo sapiens
gagataattgtagatttacatgcagttgtaagaaataatacaaagaggagagcctatgtatcttttacccagtttttccctatggtaacatcttgcaaaactgcagcacaatatcatagtcaagatactgacaatgatgcttgcagtcaggatgtagaacatttccgtcaccatgatgatccctcctattgccttttatagacacctctcaccctctcatccttgacacttggcaactactaatcctttccccatttctataatttagtcatctcaagaatgtcatataaattgaatcataccatttataaccttttgggatttttttcactccacataatttcctgaagattaatgtaggttgttgagtgtatcaacagttttttttttattgctgagtagtattccatggtataacagtttgtttaacctttacctgttgaagtacatctggattgcttccagttttcagctattatgaataaagctgttatgaacatttgtgtaaaggtttttgtgtgagcataggttttcatttctttgggataaatgcctaggaatgtaatgctaggttatgtggtagtttcatgtttagatttgtaagaaactgccaaactgtttcccagagtggctgtaccattttacattcccactgacaatgtgtgaataattcagtttctttgcatccttgccagcatttggtgttgtcactattttttattttagccatcctgataggtgtgtagtgatatttcatggttttaagttgcctttccttaatgctaatgttattgaacatcttttcatgtacttatttgccatcagtatatcctctttggtgaaatgtctttgtatgtcttttgcctattttctaattggattgtttgtgtttttattattggattttgaaagagcctgggctttatagatatcaatttcagcaatgtgctattcattccttgactctgccttcctgccttcccaataccttattcacagtaaccctcacatctgacttctatgatgtgttgtagcctgagaaaatcatgattccattctgaatagatctggaa

SEQ ID NO: 79118 - DNA, 1080 bp, Homo sapiens
aggtacctcatcccctttattgaactgtggccatggacttctcaatgatatccctgtaaccctaagacctagtgaaaaacctggtacaggaaaaagtatacagtaaatattagatgaagaataggcaggagaatcacttgaacccggggggtgaggtgcggaggttgcagtgagccaagatggtgccactgcactccagcctgggcgacagagcaaaactctgtctcaagaaaaaaaaaacaaaaaaaaaattcagctctgtgatttccattttttctcctgccaaagatcatgttaattatttctgtttctcatggcctccatattttgaaatatttattattctctattgattaaataataattcatttgtttcctaattttactgaccaaagccaaccaggacttctggtcaatatgagaaaattacagttggttagctgcagctcagaaaaaagaaaaaaaagatatttgtgtaacaaataagctttttgaaataaaaataacttccaggcccaattattactttgggggggcttctatgattctgaacacgcagactaaaaatcaataatattgtctaaactactcattttatagataaacatggtaatgcttcaggagttaggtagaaatgacttacctgcaaagccaaactaattgattcccagttcagagtctatttaggatggatatataggatagggcttggagagggtattctagaatgaggccttaagttcttggctcctttttaagaatacatggtgttggattactgttaacataaatttggacagaatttatggatagaatcccatttaacaaatactgtattatatctagttatatataatgtcattacatatccccatgatctaactcacagttcataccaatgttttattgtcgtaagctgcaaaattctattagattttaaaaatttcatatgaataggtgtcatagaggacttgtttttgtctgggaaggatgtgggaaccccctccttatggccccaggagagggaatggcttgagagtgcatgttattaacttgagatcaggactaggcatccattag

SEQ ID NO: 79119 - DNA, 1050 bp, Homo sapiens
tctttttgtaatctcttacagttttggtttagttttttgacaatgcagttgaatatattctccatgtgtttaagaacattttaaataagtgcccatttctttgtaatgatttttctcagaaacaaacaaatcctcaagctactctagtaatattcctactccagagtagtacaccatagctcttgagaagaaaaggaaaaataatagtttctgtgtgttttaagtggaaagtagtttctttgatttacatgaacattaaggcatgataggtaatgacaatttattcctaaaatgtattcagttacccattgacatggatatgtcataacctgttatgcttgacttatagatttccccagggaaaatgttccaagagagtgagcaaaagaaatgttttctggggaaagtatcaaggcgagagtgttgttatttcagacatcacaacatttccctatagcagtctatatccaagaataaatctgtgctagccaagcagatgaatctggcatttctgagaatacatgtgatggttgaattgagatttttggtaacaactgtgggtcactctaagatacccatttctggacatctcagactgagagatgactataagaggtatcattttaagtctggagaccagaaagcctctatacttgttcatagagctttttttttttcttttcttttttattattataatttaagttttagggtacatgtgcacattgtgcaggttagttacatatgtatacatgtgccatgctggtgcactgcacccactaactcatcatctagcattaggtatatctcccaatgctatccctcccccctccccccaccccacaacagtccccagagtgtgatgttccccttcctgtgtccatgtgatctcatagttcaattcccacctatgagtgagaatatgcagtatatggttttttgttcttgcgatagtttactgagaatgatgatttccaatttcatccatgtccctacaaaggacatgaactcatcattttttatggctgcatagtattccatggtgtatat

SEQ ID NO: 79120 - DNA, 1029 bp, Homo sapiens
gtacgtaggggaacatttcctggtagccatattagatttccataggtaaatctcttggtgctcagatcacagtcatttgtgtgtaatgatatctggatgtggtttataccacacccccagattgcttccccagattgtatatcaaagtcacgatcttttggcagaattataattgcccatggggaatggtggcctctgagtttcatagctcagggatgtattgttggagctgctgtcagtttttcactagagatataacaattgaagtgtcttacatttctatagttctttttaaaaaacaaatttgagatacaacacataccatttaaagtgtacaatttaaatttaaagtgtacaattcaatggaataaaagctaaaggattattagcctggagaagagagaaaacttataagaatgtgacagcttcctccagtattagaaggtctatcatgtggataatatacaaaaaaggtttaagtctgtgctgtgttgccccagagggaagaaccaggaagttgcaaggagatagatttatatcaacatttatatctgaattcatatcagaagaatttctaacagttggcattagttgaaaataaagtgggctgcctcgggagttcataaaactctccaacaataatagtatccaaacaggagcaagatgactggtagtggggaattctgtaatggtgattcaggcatcccatgggttgtattaggtgatttctgcggtctctttctaccatgagagattgattctttgaaggctagagaaaacaaagggagaagaagtttacagcttgcaaaacagggggtatgtataatgtaaagataggtgtgttatcatcttcttgaaatttggtagtcaaaacataaaatttgagattagccgcctcattatataggtgggacattcagatacagaggttattaaacattgcccaaggtcaaatagccagtcagtggcagagttggaactagattccctattgttttaagacaaataatggaattattcattttaata

SEQ ID NO: 79121 - DNA, 1013 bp, Homo sapiens
caatgtaaccatttttagtgtatcattcagtggcattaagtacatttacagtgttatgtaacctcatcactcactagttccagaatactttcatcaccccaaaaggaaacccacttagcagtcactcctatttctctcctacctgcagcccctggcaaccactaatctgctttctgtctctgtagatttgcctattctggatactttacataaatagaattatctaatatgtggcctttggcatctttcacttaacatactacattttcaaggttcatccatgttgtatcaagtattaatactttattcctttttacaactgaataatatttcattgcatgaatataccacattttgtttatccattcatctgttgatggatgtttgggttgtttccatcttttgggtgttatgaatagagctgctataaacattcatatgtaagtatttgaacacctgcttttaattcctttgagtgtattcctagaagtggaattgctatgtcatatggtagttctatgtttagtttattgaggaaactctaatatcccttgtataattttatagatattgtataacacatatggatattattgcttgtatcattattaaacacctctgtttctctcattcctgcagtcttcaggccctcttggttctaccttttaaaattatctcctgaatatgacaggagataataaaaaagcttccatttccattcaaaccatcagactcttagtatattttacctaaccagttgctaagtgatttgggcaaattatttaatgtcttcaagtctccatttcattattgataagatagaggataatgtatatatggggttgtcataattgagataatacatataaagctcttagccttctgattgcataatagggctcaataaatgtttgtgattattaataatcttttaacttgtctctcttcctcaggtttggttacctcaaaattcattagccatactgctggtagagtaatttttctaaaatgca

SEQ ID NO: 79122 - DNA, 1071 bp, Homo sapiens
caccccaaaaatgcaagtattatgatatataatggtgaagacttttattattttttttttcagtggggctgggttgtattgctccattaagatattaggggccgggcgtggtggatcacgcctgtaatcccagcactttgggaggccgagacaggcggatcacaacattaggagatcgagaccatcctggctaacatggtgaaaccccgtctctactaaaaatacaaaaaattagccgggcatggtggagggcacctgtagtcccagctactctggaggctgaggcaggagaatggcgtgaacccgggagatggagcttgcagtgagctgagacggcgccactgcactccagcctgggcgacagagcgagactccgtctcaaaaaaaaaaaaaaaagatagcatggttgcagtgttttgtcaaccaagtattgtctctcatccatgcttttgcataatctaatggatgtagtcatttctacccttcttcacctgactagcctcattcaagttcaagtttcagattaaataactcttcaggagaagtgctcatcagccagtcttccttgttgcttcatgcccttccctttccctacccctgataagatcaagttgttttttttttgtcctgaaggaaggaatggaagagagtttagaaaatatgtacattcctaaaaatactccctatctaatgtatacaagtttctgtgctaatttttataagtaataaaaagggagtaatggctgggtgcggtggctcacgcccataataccagcgctttgggaggttgaggtgggtggatcacgaggttaagagatcgagaccatcctgaccaacatggtgaaaccccgtctctactaaaaatacaaaaattagctgggtgtggtggtgcgcgcctatagtcctagctactcgggaagctgaggcaggagaatcacttgaacccgggaggcagaggttgtggtgagccgagattgtgccactgcactccagcctggcgacagagtgagactccatctcaaaaaaaaaaaaaaaaaaaaaaaggcagaggatagaacaaatatacaatta

SEQ ID NO: 79123 - DNA, 1034 bp, Homo sapiens
agctaattttgtatttttaggagagatggggtttctccatgttggtcaagctggtctcaatctcccgacctcaagtgatccacccacctcagcctcccaaagtattgggattataggcgtgagccgccgcacccggccagtttactcttatgtagtaagagtaggtcagccttcctggagtctgttaaggatggaagtgggctttcaaggccaggccatatccagtcaggcatgcctttgagtgcagcatacagttggaaggactagggcaagaatggggagaaggtataggagcagttcctttatcttagtgggtttccagttggccatgccaggagggaataaagtaactgaactctggaaaagctacagaatcctgctgcagggggtacatttgaggagaagccagaacattaaatgaaggtaagaaaatgcaagaaagaagaagcagcacaggtgaatcagagctccttcagcaacatctgacaggggctctcttttgggcatgaagctcagggttcatttttaaagtcatgctaaacagaaactgtgaattcaagccaggcgtgttggctcacacctgtaatcccattactttgggaggccaaggtgggaggattgctgtaacccaggagtttgagaccaccctgggtaacatagtgagactctaactctacaaaaaatttttaaaaattagccaagtgtcgtggtgcatgtctgtggtcccagctactcgggaaactgaggcaggaggctctcttgagcccaggagattgagggtgcagtgaaccacagttgtaccactgcactgcagcctgggcaacagagcaagaccctgactcaaaaaaaaaaaaaagaaagaaattgtgaatcccctggaggtgcttgttagatgaatggagtccaagtcctgtctcatagagattctgatcaggtctcagatggactcgtggaatctgtatgttttcaaatgctctagatgagtcttatgcttgggtaattttgagaaatactctgctgctagattatattaa

SEQ ID NO: 79124 - DNA, 1038 bp, Homo sapiens
ttttctacaaagcttgctgttcctacaggtgagggtagctgtttttttctccccttaggtttactttactctcactcatcaactctggcaaagtggatttaaccatcagatgtattctttatttcagagaacaaagtggttttgttggacttcttgttctctcactagcttttgtgaaggaaaaaaatcctgcatgttccatactaaaatgatagcattataattttgcatcattacattatttaactgttatcagtaaatctatgaataaactcttcgagacatccattctctacttgtgtttgttgattcattatcatgctttttgtactttccaaagcagaccccacattttttgtatgaagcatcaataagggtgagatatggcaagggtcactcaccatcatccctgcttatcactgtctcctttcttgctcctgacatttttcagtgagtagtacccctgtgtgacagctggaatacagagtggtgactgcacattgaccttaagaacacatttgtggttgtgaaatgggctgggtcaaggactgccctcctgcaaattcccttctacaaaatttattttaaagatacacactactaggctgggtgtggtgacctcacttacaaagtgctgtaatcccagcactttgggaagctgaggcgggtggatcgcttgaggtcaggagtaaaagaccagcctggccaacacggtgaaacctcgtctctattaaaaatacaaaaattagctgagtgtggtggctcatgcctatagttccagctacccaggaggctgaggtaggagaattacttgaacccaggaggcggaggttgcagtgaaccaagatcacaccattgtactccagcctgggcaacagagcaagactctgtctaaaaaaaaaaaaaaaaaagatacaccgtactagattgatccttcagtaatacactgtagcatttgttttaggttgttaaatgagtgggcttatgctactacgattgctttagtgtttatatagcataagtgtggcatttgtgatt

SEQ ID NO: 79125 - DNA, 1040 bp, Homo sapiens
ggcatcacagagtgggaaagactagtttatttccttcttttcttttttcttttctgtttgtttgttgtttttttttttgagatggagtatcacttggttgcccaggctggagtgcagtggcgcgatctcggctcactgcaacctccgcctcctgagttcaagggattctcctgcgtcagcctcccgagtagctgggactacaggcgtgcaccatcacacccggctaatttttgtatttttagtagggacagggttttaccatgttggccaggatggtctcgatctcttgacctcgtgatccacctgcctcggcctcccaaagtgctgggattacaggcgtgagccactgtgcctggccccaagactagtttatttctagctgcaggaactagttcccttgtttaggccatttagtctaatgaataaaaagaattcagaaaaaccgggtttctttccatacagcaacttctttgggaggtaaagaaaaagaatcttagtctcagaagtcaagctatctgtggttcacatctgccttgggagatagcacctccttgcactgtgtctcattgatggttgtcactttctgttgttacaagagagcttgggtcccatgtgaggtcactaatattaataatgtagaagtggtttttagttcagaggagcagcttgtcaacagcttgtatttttaaatattgtactaggaggaagtatactgtattcatagggtatgtgcttctttattagtaatcttaatgcatttatgagcagtttgacatacactaattatttatagtgctgtggattccatttgctgctaggtgacaatgtggagagttgggatgcaaaactgtgattaagaagctattagttggcctggcacgatggctcatgcctgtaatcccagcacttcgggaggccaaggcgggtggatcacctgaggtcaggagctcaagaccagcctggacaacatggtgaaaccccctctctacttaaaaaaaaaaaaaatttagccgggtgtggtggcacatgcctgtagtccc

SEQ ID NO: 79126 - DNA, 1030 bp, Homo sapiens
atttttactttttaaactttgttaaaaactaaggcaaacacacattaacctgggcgtacacaaggtcaggatcatcattatcactgtcttcaatctccatatcttgtcccactggaaggtcttcaggggaaataacacacatggttaatgataaaaagtatagtataataatacataaaacagtaatagtcattgctattatcaagtgttatttactgtacataattatatgtgctatgcttttatatgactggcattgcagtaggtttgtttacaccagcatcatcacaaacatatgagtaacgcattacattatgatggctatgacaccactaggcaataagaattttcagcttccttttagtcttatgggaccactgtcatatatgagatccattgttgaccaaaatgttgtatgagctgcataactgcataggcaaatccatggagacagaaagtagattaatggttttccaagactggggaagaaggaagttgggaaatggggaatgattgcttgctaatggatatgggaggatttctttttggggtgatgaaaatgttctaaagttgattatggcaaaggtcgcacaaccttatgtatgtaccaaaacccactgaattatacactttaaatagatgaattgtatggcatatgagttatccctctataaagctgtttgatctatctgtatttcaacagttagagtgataacttgaatattgaaaactttgaaaatacatgttgtgagggaaggtaaaacgccaaagactacattttaccagtatatgtctaatcaaaactattccataaaactccttcctaatttgaatagaatgattttttcctttgaaggtaaaaatcctctatatcttttaccattttattaatatttaattccttcttccttctttctggagaaactttggattctgacagagctccttctatactgacctgacaagttctcagagactggtactgttgcagctaatgagtcaagtggacactcatgctggctgtgttccc

SEQ ID NO: 79127 - DNA, 1065 bp, Homo sapiens
cgtacagccatggattcaaccaactgtggatggaaaatgtttaggaaaaaaacaagaaaaaataataaaaaaccaatacagttaaacaaccatttacatacatttacattgtattaggtattataagtaacccagaaagataaagtatataggaggacgtgctagcttatatgcaaatactactctattttatataagggacttgaacatttggattgtggtatctgtgggggttcctggaaccagtccccaaggggcaactgtagtgagcttaataagaagaaattgtgtggtaaatactcaccatccatttagttctaatgggcagtagtaattatgggttttcttgtcgaagctaatgaaggtaaaaaataggtccatttttttaaagactaagttgagaactaatagagctaaaagcagtacaggcatgaaaggaaaaatgacaagctacaaataaatagtagtaaagtgaactctaaacctttaaattctcaactcagtataaatgacaaaacatgttaccaaatctgcatcatttttattgccaccatttaaatctaactgatggtttcctacaactagcacactaaaaaaaatgaagaacagaaatgtatttcccacagtctgggaagttcaagatcagtaagttagcgccttggtcactctgcttctaggatggcaccttgaatagcacaggtgttttaaagaaattttgccttccacacctttgaaataatttgagctgggcacagtggctcacacttgtaatctcagcactttgggaggctgaggcaggtgtattacttgagcccatgagttagacaccagcctaggcaacatggcaaaaccctgtttctacaaaaaatacaaaaattagctgggcgaggtgttgcgcgcttgtggtcccagctactcaagaggctgaggtgagaagatcacttgagcctgggacatcgaggctgcagtgagttgtaactgtgccactgcactccagcctgggtgagaccctgtctcaaaaaaaaaaaaaaaagaaaagaatttgagtgatataggctctttact

SEQ ID NO: 79128 - DNA, 1048 bp, Homo sapiens
aaagaggcagaagagatgtgtaataaagagcatatgaggactgagaaagataaaaagatgggagttgtgtggaatagaattgttaaagtggtacatttcctacccaaaagatcaatttttacttaaggtttcgttcagacttttgtccttctgtgtcgttcctgtttttggttttgttggtacagaattacttttagcttctttattatttttcctaagactggtgatgtttatactactttattaccactcttccttggctttgcctctctgtcctcagctattttctctagctatggttaaggttgtatcccccttcccttcctttatatcttttcatttgcctatcaaccttctcaaatatttcgtttgtgaatgaaaatacattttgtaatttgtgaaacaaacaacccacaataccattgtgctggggccctgggtggtccctgacaccctttcagagagtccttggagtcacagatattttcaaaaaatgctaagggttatttattaacttttcttttcttgaattgatgcatattttaaaaatttctcagtttaaacatctaaaatggtaaaaatataccatatatcatccacataaacaaagctcattgatgttctcagtcatttttagcagtgtaaaggggtcctgagaccaaaaagtttgagaatggctaatgtatttcatcagcaaactaaaaacatttattaagcagctttgtattttcagtcccagtactagttgtgtagaatcggtggcagaactttgcctcacagtttagaggtgaagacatacttctcaaaggataagtacagttggagtcagtaagtgcagagatcttacacaccacgggagtccagagggaagtatacttaacttgtgattatgttactggtgataggggaggggtcagtgagaggctggaaccacatttattaagccttcctagaggaggtgaccactgaaccaattattttaaaaatcagaatgaggcaggtgaaggatggttgtaggaggccttctagacgaagcagcaggagcaaa

SEQ ID NO: 79129 - DNA, 1026 bp, Homo sapiens
tgatctcggctcactacaaactctgcctccagagtttaagcaattctcctgcctcagcctcctgagtagttgggattccaggcatgcacccaccacgctcggctaattttgtatttttagtagagacggggtttctctatgttggtcaggctggtctcgaactccagacctcaggtgatccgcctgccttggcctcccaaagtgctgggattacaggcatgagccaccgcgcctggccttattttttttatttttatttttttaaagagatctcagagtctctggctttggactccggggctcaggtgatcctctgatccttccacctcagcctctccagtagctgtgactacaggtgtgcaccactgcacctggcaagggagactgttaaaaataaaagtccagacagtaagtattttcagtttagcagactatttacaatttcttttgtctattattcttttttaattttgttttgtttttataccttttaaaaatgtaagaaaccattcttagcttgagggctatacaaaaactgtatgagggctcagtttggtttagtctataatttgtttacccctggtctagactttaagcttttgacctcagtgcacatgactacttaacaaaatccaaaccaattgcacatccctgaaaagtctgtagaaaggaccaaaggcatatggaaattgagaattaattgtcatatttctgtggcttttgttgctgtaggagcaatgatataacaaaattaaagaagtaatttaaatcatctgtaattctaccaccctagcacaatagccaaatccaaattactttccaatcctggcctttatgcagcatattttaagaacagtaatttttaatgtattttcagcatgtaaaaataacttcagcatttctaattttaaaatctcattaacattttttatattttaatggaatgttaaaaaatttatcagttgaattccaatcatgcagcttcatgagagctgttgctttcccccctctaatcatataaccttt

SEQ ID NO: 79130 - DNA, 1013 bp, Homo sapiens
ctgtagtcccagctactcgggaggctgaggcaggagaatggcgtgaacccgggaggcggaggttgccgaggtggtgccgctgcattccagcctgggcgacagcacgagactctgtctcagaaaaaaaaaaaaaggaaaagagagaagtattcaacaaatcagttttggcgtatgggtttcctcgtgttgacttttgaaatactgattggtgactgtcaccaaccaatattccctagctccttcgtgcacctcaaatgactaagaatggagagagtactaggagtagcatctatttcttttgcagagattagaaacaagacgcttcttgctctgcttcttcaaagggttccgattgggtgattaagaacaactttaaatgttttggagttgagagaaagttatgagtcctttttcagcctgagacttttctgttatgaaggaatgcatacgcagtgagccttccaaggatactagcagttgctttaaaatattcttagggacattgttttatagacaagtcccttgaacctgatgatcaagagaaataaattgatcgggcccttgcaggagcagtttatcaccctggaatacttttgacaattgctgaaaatgcgtgctggcaggaagttttttaattaccaaaaccatcagatcatttgcttggttctttcagagtcagtgaaatatatgagtgagtaatggagtctgttcaagaaaaaattagctaagcattgaatctggcactgtccctgttgcagatggaaggccagatgttcaggagcagtcacgaatcatcaggttcatatatatagaagcacacacatatatgtatgttacatatatatgtatacatgagagttaaaataagaaaggaaagattttgtagttcataggagaacgtcatatttacagcaggttgaatttctggaaaaggcattttaattaaatggaagtggttttcttaagtttaatttggttttcctttggaagtagcattataatagagttgtatg

SEQ ID NO: 79131 - DNA, 1030 bp, Homo sapiens
tcattttactggatttaggatggaaaggggttcagttatgtgcataaagtctatcatctcaacccagtcttagtttttattattttacatatatgtatctgtagtttcatataatatcatccctatgtatgattgactcaaaatgttattaaagatctgaacattatttctagttttctttactgtaaagaaacgcatttccagctgaagtatacttaaaactatagaatatgttaagtttattttgcaagttgatccaagattaaaagaataaaatgcaatgtgacatatatgtttgagtagtgcagaaaactactgtttttatggagataaaagttgatgttgataacagaatttattactggcttattacatgtattacatgtaacgcatgtagatagtttttatgtatctgtttatgagaagagtatgttgtatttatataatttgacttatgttccaatattagtgttttttatataacataagcatttttcagagttgcagaacagaattcaaactggtagactccaggccagatcaggctatagaaatgttttgtttggtcttcataatattagcttactcagttttttttaaaaagtgaattaattgccaatgtttgaaagtaaagctatttcaggaagagttcctgacttgtagcttctcttgaaaaatcagaagatttaacaactttgggtccacattcctctgtggcagtaaatgaccagtgctgagtagtggctgcccttgttagctagtagttggccacagtcttcgtcattctttataatctctcaagccagtctacttttctctttattgcttctttcctgatcctgtaggtgtttgagtttgtgacccctactatataaatcattattttaaagtattatgaaatattcatggaataagggtactacaattatcagatttctttctttttaaaagtgtatataattctgtgattttcaactttgtaaacatattctttcacattggcattataacctggaagcagaagtataga

SEQ ID NO: 79132 - DNA, 1061 bp, Homo sapiens
gagtgcaatggtgcgatctcagctcactgcaacctctgcctcccgggttcaagtgattttcctgcctcagaccacgcccacccccctgccccaccccctgagtagctgggattacaggcccacgccaccatgctcggttaatttttgtatttttagtagagacagggttttaccatgttgcccaggctggtctcgaactcctgacctcaggtgatccgcccgcctcagcctccctaagtgctgggattaaaagtgtgagccactgcacccagcccgtgcagtcacactttaataaattttgtaaggttacatgaagtttctttgaggatccaagaattctgttttctgagcccaagggaggaatgatgcagacagaaaagattggtaaccaacactggggagcgaggggcataaaggagatagtgctgacccttctccctctctcccaaccctaacctgttgcagacaaccggttccttgtttaaccctttagccagttaatgaaagtgtattatgctggcaacaacatgtctacttgacatcttcagatgcttttgtgacagttttcaaaatgtaccctttctctggctgttgtagccctgtagtcaggacacaggctctgccagttgttaaagccaaagaaatatatttggagctgggtgtggtggcgtccttagtcccagctgccccagaggctgaggtagggggatcacttgagcccaggatttcagagttaaagtgagctatgattgtatcactgccctccagcctgggcaaagagtgaaacagccagaccctgtctcttaaaaacaaaacaaaacaaaactctccctctctctctctctctatatatatataatatatatagttatatatgtatataaaatatatatagttgtatatagatatattctgaaacattattccatctcccctaataaatcatctttcctcctcttccttatcgcactccttcccctggttagcattcatctgagcaactgtcattttgaggaaggctggcaatcaaataggggtgacagaacagggcctgaattatt

SEQ ID NO: 79133 - DNA, 1246 bp, Homo sapiens
tccaccaaaaatacaagaattagtcggtgtggtggtgaatgtctgtaatctcagctgcttgggaggctgaggcatgagaattgcgtgaacttccttgagcctgggaggtggaggctgcagtgagccgatattgcaccactgcactcaagcctgggcgacagagcgagactccatttcaaaagaacgtttattaaatgactatatgaaacatgttctgttctatagaatacagaaagattgttcctctctaggtgtttattatttaaagtgaccaattgcagaatgaacattcattaggatcaaagtacttaaaaaagtatttatagttcatgaatgtagcagtgcccagtgattggtatgagggaagtacattagtttaattagcttaacgttctcttgactggactattccccttacttctagttacttgggaaagtttttatgaaggagactaatttccaaagttatttaggcaatgacaggttggaagattggtcagctgagagtgggaggaacataacgtatgagagccaaaaggaagggtggaacaatgggctggtaaagagaatgaggactagataaattctaatgagggaagagtctagggcctatgtgggagagtatgaagagtagagggtccttggagtgtggcaataagaatgtgaaactcagattggaattggctcctggtcaagaggatggtgtgatgtttctgcaaaggtttatggcaggatcatgtcattgtggatggaagagaaactcagtgttttttagatgctcacattttattaggaactgcatgatacccatagtctctaaaactggcataacacagatcacatacaaacttagattattttaaagatttattgtattagttcatgcatttcagctttttctaaaaatgaagtttgatctaaagtaattactgtggcaaagaagaaggttaaatctatggaaagtagcacctgtcatagggaaatgccattatctcaaacactttgaagtgcctggatttcaaagctgtcagttggagccatatttcttgaatctttttttactcaccaagctggattgtgtcattttaatgtggtaacatatataagagaaaaggagaaaatgatcctggtactgattatctcttgggaggaggttcagagaggtgaatttttaatgagactttggtgtttgtccagcagaatcattgcagtagctgacttcacttatattggtttttttgatact

SEQ ID NO: 79134 - DNA, 1038 bp, Homo sapiens
ttttgtagagttggggttttgccatgttgcccagactggtctccaactcttgagctcaagtgatccacctgcctcggcctcctaaagtgctgggattacaggaacgagtcactgtgcctggcctttcttggatttcttatgagagcaatgatagcatgcaaataatgacatttttgatatttcttttttaattcttgtgccttttatttttcttcttgctttattgtattgtctgggacctccaaaacaatgttgtttagaagtggtggtaacgggtatctttattatcttcttgactacccctctttacacgtttagttgtatttttacaaagttttttatatggtaatttcattgttgttcagttttagtatttcataatatctatttagatttcctccctatgagtttttctagtacgttattttctctatatatgattatttctgtttactttttattattgatttctaatttgcattgtgcataatgtgattagtatattattcttagaaattagttgatactatctttgagacaatagtaaatttttataaatgtcttatgtgcttaaagccactgtatattctttttctgtttagcacagttttatatctatatgtgtgtatatatgtatacacacatatatgtatgtggatatatacatagacacagacatgtattgcatatgtgtatatatttatgtgtatatatgtatatgtataagatcagacttactgttgtgttcagatttgctgtatccttggggaatttttgtccatttagtctgtgagtttctggtaacacagtattaaagtctcccatcatgactagttgtgtcagtctctccttattaattgtatctgccattgcttcatatgcatttgagagcttatattattaattgtatactttcattcattatagcttctttgaagagtattcttttttatcattatgtcatgtctttttttttttttttttttttttttgtagagactgggtctcactttattgcccaggctggtctccaagtcc

SEQ ID NO: 79135 - DNA, 2431 bp, Homo sapiens
cgagtagctgggacaacaggtgcgtgccgccacgcccggccaattttttgtatttttagtggagacggggtttcaccgcgttagccaggatggtctcaatctcctggcctcgtgatcagcctgcctcggcctcccaaagtcctgggattacaggcgtgagccatcgcgcccagccgaaagataatactttctaccatctagtaatgcgttctgatacctctattatagtttgttgggaaatgtaaaagaatgggtttttgtaattaaatactcataatatcttattaatggaacccttggaaagatgccttaagtagcaaaatatttattccatatcatagttcttcatggccagtgaaaatttttggctatatgcccatctccttatatacaatgtctttgtagatagctggtttcttagtccccaagtgaaaagtttgtgtctgaggaccactgagagaaccagatagaagtaagtctcttaggtgctcatgtgtgaattcaccaggaagatcaaatgaggaacagtttcaaagcaggctacatgaaggtagcagaatattttctactctctagtttcagtgttcagggtgtactgtgtctgatacatcctttgtgattaggtgggataggtgccccatgttttcttgggagctgagttttataacttatctggattttgaacacgtttattctttttctttctttcttttttctttttttttttgagacggagtctcgctgtgtcacccgagctggagtgcagtggcacagtctcagctcagtgcaacctctctgcctcacaggttccagcgattctcctgcctcagcctcctgagtagctgagactgcaggcccgcgccaccacgcccagctaatttttgtatattttagtagagacggggtttcaccatgttggccagactggtcttgaactcctgaccccatgatccacccaccttggcctcccaaagtgctgggattacaggtgtgagccactgcggcccggcctacgtttactcttcttttgtgaggaagtacagcatttgcccagttgtatacctgtctgccttctcttaatttaaactatcaaagtaatgtttttgaactctattatccttttacatttatcactctccccatattcctctccaccccagggggctccatttcttagcgttaccagttctttttctgtgaatgatagattttaaagaaattttctggcctgcatattgtggacatgttttttcaatagttatatatttcccatagagactataataattatgttatgaatgtgtggagtctctataatttggtctcttctgtaacttgtgctaatttttcagaatttacttaaaattttttgagtggtttgtgagcatctgagagaagatgtacaagttgtttgatgctaccatgtgttcactaaaatcaagtgatgtcagactatctcacttctatctcacttctttgaaaagctttgtagattggcagatcatggaaatgcaacaagcaaagctaaaccaaaactgagcaggacattttaccttgtcttataagggttttgatggccagatagaaaaatatggactgattgctaatataattaagtggatcagtattaattaagaggacattttctgttatgtctctagggttctctatgtaaaccttcttgatcaacattttaaatcagttatttggatgaagccttctatagaaggcaggattattgattttgtgaatgacatagtgcaggatgggataatgaatacatctgatgacataaagagattatggaaaaggccacagacaaggacaacaagcctaatttaatgacagcaatgagtagatgtaagaataaggccttacacttggagaagacaaaaaaaccctatacaaatgagcccaggatgtgagaggttaggtagctgttaacttagctgttaaatagatggcaagtgcaatgttcatcattccaattttgtagtgaataagtaaagctggtgtggtctgaggtaggttgtgtcaccagaagtctaataacagcacttggaaagtgatgctcacactctaactctgcagcttccgaattacaaggagaattcagttctgggtacagagtgcccttcaggagaacaagtaggacagtttaaagcctagaaattgtatcaagtaagaaagtcaaaggaatcacaatgttataatttctgtggaatgtcctgcagttttgcttttcacatttagggttcttttttcttccatcaattttattttgttatatggtagtgatctaatttgccttatgcatagctaatcctagctccttttattgagtggtctgatttccccctgatttgtagtgccaccattgtctagaaccaaatttctgtgtatgtacttgactgtttctgaattatctgtc

SEQ ID NO: 79136 - DNA, 1001 bp, Homo sapiens
taattttaaattttagtaaactgaaaaggataagagcattctgcttccagaacactttatcaggacaaattcattagtaactctatgatactgggcactggccaggtttcagtcaggaccctttcttctcctatcctgcataccaaccctgcacttaggaccagctttctacacttaggaccagcctgctacagaaagggaacaagcacaggtttcctcaatcttctcacattttaaaacgcttggaaggacttgactcactccgttgcagtttcccccttctggaagaattttgtttttgagaaaatgaatggaaaatcttaagtataacaatggcatatttatgaattatgcaagtgtttgaacatcagtttattatgggaagatgtgttttaaatagatacagtattctaaatggtgatgaggttttcaagctagttcacagaaaccacttagctcagggtgcccctggaaagagaagttgtgtattctaggatcctttggggaccctgaaccacaaagtcctctgggcccaagaccctctatagattaaactcttgtatcacatggagtcctgtgaatgaaatagatggaaactcctgagcacactcctttttctactcactgatttactgtgtccttggctctacccactatccatgcctagctgtcacccagtggataagagataagagggaacattcagaccacaagctgatacagaattggaggctgagttggacttatttacttacaagttccttttccggatgagcctttaactgaaaagatgaagaaatatttataaaaataatacctactctatagatatcctcaacttacaaagcttttgtttttaagcagaagctatgctagaaaaaaagaagacgagaaggaaatcctataatgaagtatgacgaacactggcagatggagcagataaaatttaaaaattattgaatgccacttttttggacactgaaaagttctcagggacttca

SEQ ID NO: 79137 - DNA, 1862 bp, Homo sapiens
atagaaagtagttcccatgttgagcaggaaaaaatccattatatttatgttatttcatcaaattatgaacaaagttttaaaatttactgtctgttgcctcttatcttgctagtgaataggctaacatcattaatttctgttattgtatggtgctatttatgagtatgtcacaatctatcttctatgtggtccctgatccttaggctgattttaatttgcagaatagtgcatctgcaaaaaaaaaatgaccaataatatgtgaacatggtaagtagtcagtgttgttaagtgaatccataaaagttggaaatagtatatttttcttataatgcaaaaaaaagtgcttacaaaaatagtacactattagaatgtaccatgatcaagtagggggaatttcaggttaagctatcattaagtaagtaagggctttcagggaaaccaaagaaaacatgatcggggatagacattgtctggaagggagtggggctgaagaaatgaaaggtggggaggacagtgagaaacaggaaagaacagatgaggattgaaggagagaagcattttgtttgcattcttaggaactggtgcggaggttaaggagcagcataaaatggatctcaggtttgaaagacttccccttgctagaagcaaggcagagacagagaatgtaaagttaaaagatggatgatgatgtctgtcaacatttaatttggcctatacagaatgaagtggaggaacttgactaggcaacattcagggcctctgatcagctgcacactctccccatgtagcaagagaagtggccttattaaaaatcttagaacagagagaagagagggagatagcagtttttaccttttcctgagaccctgcagaagttgttattcattagacgttcactttattcccttttaagtctggtaaagaatgaatacttggacgttttgtttcatgcagatttagttagcaactcgattatcaaatggtagaatatctgtatgcactgaagccaaattctcagtaactcagcttttgttagtcatatgaggatgatgaataataggactccagagcagttaacaaattgatacaagtggtaggaaaatttgatatgaagttatcaaaacaatgtaatgaatctgttaaagctaaagaagtgtaccatgaccacattcattatttatccactcagtcgttcaaaaagtattagaatgcccaacccctctattccaggcactagttatgtacacgggggtacagcagagaaggcagacagacctattctctgcccttgaagagttcacagtccactgaagaagtagacacattgaatataatcaagaagtgttacaaggatttttaacacttccttaatatcctgagagagtcaaacataatataagagctgaaagatgcggatttggggagacataggggtttttttgttttgtttttttgagacggagtctcgctctgtcgcccaggctggagtgcagtggcgcaatctcggctcactgcaagctccgcctctcgggttcacgctgttctgctgcctcagcctcccgagtagctgggactataggcgcccgccaccacgcctgctaatttttttgtatttttagtagagacggggtttcactgtgttagccaggatggtctcgatctcctgatctcgtgatccgaccgtcttggcctcccaaagtgctgggattacaggcgtgagccaccgcgcccagccttgttttttttttttttttttttttgagacggagtttcgctctcgttgcccatgctggagtacagtggcccgatcttggctcaccgcaacctctgcctcccaggttcaagcaattctcctgcctcag

SEQ ID NO: 79138 - DNA, 1019 bp, Homo sapiens
agtaggttttgggaaatctgtatttgagaagaaaactttaaaaaataatatttaaaaataagaaggagcaatttatatgttgatactatctcttctccaggaacaaaagagtatgtagtagttctatacacaggcaataagtgaaaggctgaatattatattcacctctgaatatgtttcagtaataattacatatatttttctataacacatggaaaggagtttcagtagtattatacctaagtatggaaatagttatagttaccatatttttaaaaagtatattcaggtagtctaactgaattttatattctcagaaattatatataaatagctatcatttggggctaaaaacttccttgttttgttattgtatcatattggagctcacatattttgatgagaggtgataaagcaagggtccccagaaatctgctgttgttaaggaaacccatataaaacctgaccccacatcttctgggatttcctggaaatccactgacatttcctggaaagagagatgtgcctgaatattttcaggataactctgttctcataagctttctgcctgttctctctcctttcaactctggtttcttaggagcttcacttctctctactccctttccacctggtgatcttaggtctcagaggttttttttaaaataactatcttctcttaatttttttttttatggaaggattctaattccaaaggaatcatttggttaaaggtcaccttcatgtaaggtctggaggaatggcggagaatctaggggactgttttacattttccttgtggaagatagggtatagcataccctgaagaattacatgcaaggtgagaagaaaaggcgacaaaagcctttacatgcaaggtgagaagaaaaggcgacaggaataattggggaggtgaatagagtaaatctgagtataatacagaagccaaaagtaagtattttattagatgcataatttttatatttaccagcttctactgaataaaattgaagttggtt

SEQ ID NO: 79139 - DNA, 1600 bp, Homo sapiens
tttgatctcaagtttccaaatatagttttctgtatctcctaaatgtaaacttgccttttaatttttttattttatttatttttgagatggagtatcaccctgtaacccaggctggagtgcagtggtgtgatctccgctcgctgcaacttccacctcccaggttcaagcgattctccttgtgtgagcctctcaagtagctgggattacaggcacccaccaccatgcctggcaaatttttgtgtgtttttagtagagatagagtttcactatgttggccaggctggtctcgaactctcgacctcatgatctgcccgcctcagcctcccaaagtggattacaggcatgagccacagtgcccagcaaaacttgccttttataagtcagatttattggggtacaatttacatagattaaaattaacttttttagctgtacagttctatgaattttgacaaatatatgcaagttgtgtaactaccttgtatggaatattttcagcaccctgtaaatttctcttatgcccctttgtgattagtcctctcctctttctccagcttctggcagccacaaacctgatttctgtccttacagttttgccttttccacagtgttataaatggaatcatacaatatgtaatcttttgagtctggcttctttcacttagcataatgcttttttgagatacaatttacataccataaagttcatctgtttaaggtgtacatttcaacagtttttagtatcttttcagagttgtgcaaccatcaagatatctaattttaaaacatttttatcaccccaaaataaaccttgtactcattagcagttattccccaattctgactcccctcccatagctccctatcctaggcaaacacctacttttcatctctccagatttgcctattctagatatattaattaatggtatcatacaacgtggtcttttgtaacttctttcacttagtataatgtttttcaggttcattcatgtagtaacatgaatgctttatttttttaattgccaagtaatttcccattgtataggtcatagatataccacattttgtttattcatcagttgatggacatttcaactttttggctattatggataatgctatgaacatttatgtacaggtttttgtgtggacatgttttcctttctcttgaatacattatgaacatttttgtacaagtttttgtgtggaagtatgtttttatttcttttggatggatacctaagagtggaattgctggattgtgtggtaattctttgttaccacacgagccagcaaactgccaaaccctttttcaaacccttttccacagtgctcaaaccctttggaactgtcaaacccttttccacagtggctcaagggttccagtttctcctggccaatcctcactattgtctgcctttttttttttttttttacatattttattttatgaactttcttttttttattattatactttaagttttagggtacatgtgcacaatgtgcaggttagttacctatgtatacatgtgcctttttttattacagccattctaatgggtgtgaaggagtatcttattgtggttttgatttg

SEQ ID NO: 79140 - DNA, 1092 bp, Homo sapiens
gcactgcagccttgaactcctggcctcaaatgatcctcccactccagcttccgaagtggctgggattataggcacacaccactgtgcctagctacagttgttttacttctctctgatgataacttggagtgaattgagagaactgtgttaaatgcctggcactgattatctttgagaccttggtcaggtaacttaatctctaaaattgcaatgtaaccctcttatttgccaaatgaggaggcacaaatagatgatcccgccagccccttttagcacagatgttctgtagttcaagaaatttatccttggctctataagttgtttgtttaatgtgtgtgtgttccctctgtgaaggatattatttataaatacagatgttccttttaaagaaagagatgtcaaaggaagagcttggtgactgcttccatctatgatctggtctttgagtttgcagaacacaaaatacagctttatatgctcattcaactgatttcaggttctcgggaattgattcatgctaaccaaaattgtaagagcttttgttttttatgtataatccagaatcttagtttgtcaattataatggaatagtgaatactggtttctgccattgtaggcacttcttttaggatcagagactttggaaaaccagattagaaactatttggaaggcaaagggaatcaagtgggtttgaggggtatttttcagattcaaagtcttataaatgatctctgttctgtagtagagttctagtaattatatttggaatcagttttctttctcctttaagtagtagttactaatggctggtagtcttctctttttctcctgcttcatgcagattattgtacctatgctaatatgactttttttcagataggttaatttttccttttcttatttttttaaaggtacatcccagtctacatgatactgtttactttgattagacttgggtatttatttatttatttatttatttatttatttcaagacagagtttcactcttgttgcccaggctggagtacagtggtgcaatcttggctcactgcaacctctgccttctgggttcaagcgattctcctccctc

SEQ ID NO: 79141 - DNA, 3374 bp, Homo sapiens
aaatcaggaccaaatctagctattcttatgcctcatttgagtcattttactatgtcacaattcaggggcccttttccttcagtagaaattgtgaggcctctcaaagcatggaaaatgaaataagggattggataaagcagtggttctcaaagtatggcccctagataggcattatccatatcacctgggtacttgttagaaatgcaaattcttgaccccatcccagacctagtgaatcaaaaactccggggatggagttcagcagtctgtttaacaagtcttccaggtgattcttaggcttgctgaggtttgagaatcactactactgggttacagagatatttagtaggtaaaatggacaagtgttgattgactggatgtaaaatgtgagggagagggagaggtgaagaaggaatctcacatttctaacttttgatttattcctgaattgtcttaatagattctcttcccttgcaaggtaaatgctaggttgtctacagatatgcatacctattttcaagtgggtaggagtctaaagattctgcagtgcgtcattataccagtttgatgctgttgtatttattggttagtattttttgtctctcctgacctaaaaacagtagattattgtatatttgtatattttttaaaaataaattttgttcacaacttgacgcactaggggaaaggaaaagtcaaggcccctgttgtcgaagggcttacaacttagggattgcaaacacgtaaataacaaactataaagcatcatggaatttggagctaagacaaggggatatgttgtggcaatgcagatttgggttggagtttgggaaatggggagggattccaaaattaataattgtttttcaaaggagatgaaatttgaaccaggttatgaaaaattgccaaaagcagggccaggcactgtggtttatgcctataatctcagtgctttgggggaccaaggcaggaggatccctcgaggccaggagtttgagtctatcctgggcaacatagcaagaccttgtctctacaaaaaatttaaaatttaggctggcatgttggtgtatacctgtagtcctagctacatgagggggctgaggtgggaggattttgtaagcccaggagtttgaggttacaatgagctatgattgtgccattgtactccagcctgggctacagatggaaacgctgtctcctaaaaaaaaaaaaaaaattgccaaaagcaaaaatggcatggggatgcgtaaagagcattagaggctgagttaacagcagactacttctaagtggaaaagttaaaaatgtaaagtctttagtttttttctttagtatgtttatctgacttactctggtatagttgagtcaaacaacagaaatctgcttggggaaaattcctgtcagtaaatttcaatcatacttgacatgcagagaggaatcaatctaaactaataatgcataaagctagtgttgaattaaatctaattctaaaattgtataacacaaattaagattcttcacaaagcaatggcattatgtcaagaaaaggtggattcagatttcaatcttcattctgtggctgcagtaactacatatgaattttatttccaagaggactcttctcttcaggatcagtttaatcatctgacaaaaaagagggtatcaaattgtaacatttagccgatgtttgaaaatcctttgatgaatacagtgcagccccaattgtgcattaacagttaagaaatgtgacccatggagtcctaaaaggcacatttcagcatctctgttcccaaacctaagtggccaccaaaaatagcttctcttgaggaccgaggattgcgtctctgaattccccagtgaacccctgacagcttcgaagttcccagccttatacagggtgtacttttagcactcaacacaatgccaggctagagctttggggatgggaacctccaagaaagcactgttcggcatttgggcaatcagtgttcggcagaatgccaatgctaataggttattttgctctggaaaaggagaaaaagaagggatagtctaaagactgatgaataggggatgactgacaatacggacactccactttattggagagattaagggggcttgctgtgaagtggtattgtgggagccagaaaaattagcaaaggcccacaggcccaagacctgaaataaatagtggtacatcaaacccgcatgccctagggcacactcaaatgtctggccactttcagtgaacttgtagcaggaaaaagccaaatcattaggaaccctcatagtctggtactccatccaggcactccttagtcaggcaaattatccttcacctccagacaggtgcagagccttttttctctacaccctgacttaacccaagggcctgtagtctgggcctcagtctaattttgaggatactgagtggaaaagttggcttcaggatttccaaaggattccaaatactctaggcaggaggtgccactaagattcttgttttgttagacttgaaccaagcaggtaagaacattgatcataacacaagaaaggccgggtgcggtggctcacgcctgtaatcccagcactttgggaggccgaggtgggtggatcccctgaggtctggagtttgagaccagcctgaccaacgtggagaaaccctgtctctactaaaaataaaaaattagctgggtgtggtgacgcatgcctgtaatcccagctactctggaggctgaggcaggagaatcgtttgaactggggaggcgaaggttgtgggtgagccgaaatcacgccattgcactccagcctgggcaacaagagagaaactctgtctcaaaacaaacaaacagacaaaaaacacaagaaagcagaattagtgaattcacataaggatctcatgtacttccagaggtaatttaagatggagaaagcatctagcctgccctcttttagattttttgcctctagagcatttttttttttttaagataagagtctcactctgtcgcccaagctggagttcagtggtatgatgtcggctcattgcaacctctgcctcctgggttcaagcaattcttgcgtctcagcctcctgagtagctgggattacaggcatgcaccaccacgctcagctaatttttgtatttttagtacagaaggggtttcaccatgttggctaggctggtttctaaactcctgaccttaagcaatccacccgcctcagcctcccaaagtgctaggattacaagtgtgagccaccatgcctggccttgcctctagaagactctaaaggccccaaagttattatggaattggaggtttgtaggtcagaaggactccatggattggcaatgatgcctggaatgttat

SEQ ID NO: 79142 - DNA, 1063 bp, Homo sapiens
cttacatagttttaattcaataaatatttgttctaatttgtttgtgctacatgattgctatgttaacttcacttcaaattttcttattcctgaaaacaataaacagttctaacacctgtataactctttatagttttaatccattccattacaaaccgttttgctgtgtgacccctctcccgggtgagaagtacagtatgttagtgtggtatttatgaggtctttgaggtatttatgaagtcaatttctgcaattatcctttgttgaattagtggagtgccagttggtatagctcctatgactttttggtttgtctcttaggatttcaaaactttcaggtccccctgcctccatctctgcaagtttagagggcttagatcaaatgaatactgtgtgatgcagtacttcatggagtgttagagttctgccagaattaggattttggatgtagggatcaccatagctacagaagtttccttcacacttttccccttagtaccccataaaagaggagacagacctcctcacagcctcattttctcacctcttgctccaagaggaagtggaccatgcttcccatcctgtttctagttatatctattttaagttgaattcacctttgatagcctcatctataacatcctgtctgactctgcgagttgctcgtctctcaaatgtgtctagttaaggcttgtactaaagaagtgaatatcatggaggattggcagcaaccttatagcttctgtttctcacttctgtagtgcccaggaaggacagtgctgctttcctggaggccaggtgatggttgttgcccctgttttctggtcttgactttttggggcttaggccaaccacctcagtggttttcttatgcagctgggaaatttgaagggtactaaagcatctccattcccatgttgcagggagaatggtgtttcccctaagacagcaaatcgccaattcatatgtctatcctagcaaatgaagcaggtcttccattcctttttaagaccctagaccctggtgaccaataaaactctttggacttttggctagacatggt

SEQ ID NO: 79143 - DNA, 1315 bp, Homo sapiens
ccacactgtagtaagtgtccactgtctagacatgttaatgattgtgcattgtgatttttgcatggaatctaaagaacacagggattgttaagtatatgtaatgttgtcattctttggcatcactttggcgaattgcttttgtttttacccatgtgaggaaatgtagcaaaaagacagtatcttatatgaaattaacattttctgcatgtagcttttttgaacatttagaaattgagcttttcttatcagcttttcccttcatgcatttctgtagtgagtgtgtgtgtatatgtgcatgtgcttatttgttaaatactgggcataggatcttttaaatcagtatggaaaggatctgtgaacttcttattaggttaagcaatattcccaacattttaggcattgtagcactgtatattttatggtgataatttgaactcattttccttaaagtgttgtatgccatatttttgtttaaataaagtatctattttagaatgattttactgccttagcataatcagagactacttaggatattacagaatcagaaatgtatcactgggttggagtcatgatagttccatttggtaaatttcagttataagaaattctgtcaaagtatttgtctatcctttcataatgcagcatttattccgatctggcatttaggatgtaattattaaggtaatgaaaatgccttatatcttttcaatgaaggttgccacagttaccagactattctttcactctttctgatatgcaaatgtatttgtagaccatgagaaatgaaagtatacataggagggttgtagtataattgctcccctgtgaagaacattgttaacagctccctgccagttttgaaggtcatttcctcgtaaatgcagatctggtctactcatctgtttttcattcatctgtttcatttatggagatacatatatatatatatatataatatatatatatatatatatatatatatatttaccacatttatcagcttactttgttatttggagaaaatagggaaaattaaaaaatgaaaagataactaatatctttgaactcagtatactgaaggagtcatttacgtgcttaggcatgtaatatcctaaggaatttttatgtttttaagaaacgggatcttgctatgttgcctaggctggacttgaattcctgggctgaagtgattctctcgcctcagcctcccaagtagttgggactacagaagtgcaccaccatgccctgcttataaggaatagattattttattattattattattatttttgaggtggagtctcgctctgtt

SEQ ID NO: 79144 - DNA, 1011 bp, Homo sapiens
tcctcgagcccgcccgagtaaggtgcacctttccggggcgcccggagggaggcgggtagggcggtaggctcctagcccggccgccccgtcgggggcgcaggctttggctctctgcccgggcaaggacgtatggctggcttttcttatctttcttgggttggaaggataatggtttatgtcataattcctccccccaccatttgtgagtcagagctttcagaaggtagaactgaacgcgcagcccatgcggagtggcctattgaaggaagcccagtcctctgggttttagagatttaggccccctcccgccttttgatccccaaattttattgtgttgggcggttctaggggacgtgaggtaaagatttagcaacaagtcccagcgatttggggcttggaagtggccaggaagaatcggcgacttaggaaaaacgccaacaatacggtaatgctcaacagcatttctttcagaacctggtatttttgaagggatttttacaacctcttgctcatgttccttcgctactgctgtgtgcacgtcaggagtagtagtctttcccgggaatgcagtcacagccctctctcctcccttatgaaaaagtcagagattgaaaacattgacaatgctcccgtgtttagttcatcagccaggaggatcctgcgctcatcgccggaagctgctctttgtggagaagctaattgagctggacccagaggggtctcacctgatcctttgcctttgcagcaggaaaacaggaggaggcttctggctcagatgtgacagacaaaaactgtcggcctgggtcctaccctcagtgtcttcttgccccccgcctccttatttatttatttttgctgacagtgctcaatcgcggaaaatagcggtgtgtgagaaagacactgggtagtgtatgagagcagctggtctctgctgactccgtgctcagttcagccttctcctcactttcccttttctccctcccctcgaaaccagctctgggcataagtgct

SEQ ID NO: 79145 - DNA, 1026 bp, Homo sapiens
ccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggtaaggacgacccttttctcttcaaaccccatggtttcttttctccccggggtctggggcgggatgttaatccgctagctgttgtcttatgccttccagtatttcagtcctgaaggctcctttcacccccaacaaccctgtttctgtcagacttttcccagtttatcagtgccacgttctctggtccctgccagaaaaaaatgactgtaaattctggttctcaagagtggactgtgtgcagatgctgcctattctctaagctcagctggtgagttggcagtagtaatcatctggcctgtgtggcccccttaccttcaaagacacacaaatctggcgactgccaggtttggtgtggttattgtctcatttttattccgtgcacactgatcaatattaatttcgttatttaaagaacgaagccgcctctgactcctctacttatggtagtcatcatatattttttaagctgtgtgacttttaaaatctctatagggtgatgtattgaataactaaataatcagctatgactgcctttttgtgatcaaaatgttatgatagatgggccctcgagctatatgtgagacacacttgtgtcttggacatagttgatccatcattatctactcaatttgaattgttaatgaaatcagccaaaagattagaatctgaaaataaattttaagcagtggaatgtcatgtcagtgtcttcattgaaagaa

SEQ ID NO: 79146 - DNA, 1059 bp, Homo sapiens
gctattagggttggtgttttatgcagatggaaaactatacaaagttttaaatataaaaagtttaaaattgaactgtaatcatacttgctactaaataatccttgttttcattagctcattggtaactatattaatagtttatgacttagcaacttctgtaggtatagtagagttatgaaaatttctgggcaggatagtagatgcctttctatacacttctttggtaatcttcacatttttgtgtgtaaatgcccattataattacaagttttactttgcatatcaaaatcacttaagggtaagtcattatgaattaaactgtctgtgagcttctaactttcctgttgacagcctctacctggctttcttatttcatgaagattaaggccctcagctaagtgcttccctataaccccctcctcttcaccataacatagacatgctatgatagggtcaaggaatcagtacatttatatgtgcgctgcatgcttaactctaaagactgaaaaactctcgggcagagtaggtagaaatccatgaaagtttggagtattaaagtaaggtcttcctacttggcatggttgagcattacaattcacattcttctctctggtctcaaaggaaagtctcttgttgtaattaatactcttgattccattctttcatccattggactttttgttgttgtcgttgttgttgttgttgttgttttttgagacggagttttgtttttgttgcccaggcaggagtgcaatggcgtgatctcagctcactgcaacctccgcccccccggggttcaagcaattctcctgcttcagcctcctgagtagctgggattacaggcatgcaccaccacgcctggctaattttgtatttttagtagagaaggggtttctcaatgttggtcaggctggtcttgaactaccaacctcaggtgatccgcccgcctcagcctcccaaagtgctgggattacaggtgtgagccaccatgcccagcctctttttttttttttttttttaaagagacagggtctcattgtgttgcccaggctggagtgc

SEQ ID NO: 79147 - DNA, 1013 bp, Homo sapiens
accacacctggcctattctaccaatcttttatccagcttctgatccatgtccactatgaagccccctgggacttctgacctggaatatgcttttccttcttttctttttctttttttttttttttgagatggagttttgctcttgtcgcccaggttggagtgcaatggcgcgatctcagcttactgcaacctccgcctcccaggttcaagtgattctctagcctcagcctcccaagtagctgggattataggcacccaccaccatggccggctaatttttttttttttttttgtatttttagtaaagatggggttttaccacattggccaggctggtctcgaactcctaacctcaggtgatccacccacctgggcctcccaaagtgctgggattacaggtgtgagccactgctcccagccatgcttttccttctttatacaccatttacatttattgtttgagcttcattaacttattttgttcattttttactaatagcttattgtttgtgaacttcgttttctcaacgaaattttaagttccttgaggaaggactatgttttaaattttttcctgcgggaaaaattgttcttagtgctgttacaaaatgtacgaggttgatttgtatcccctaaaaggatatattgaagtctaaatcacctgtgaatgttatcttagtttgggaatagggtctttgcagatgtaatcaagttaaaatgaggtcatactggattagggtggcccctattccattataactggtatccttataagaaaaaaaaatagaattagggagaacaccaggtgcatgaatacacagagacacacagacacattgcagagaccgcatggcagataaaggcagagattggagttatgtttccacaaaccaaggaatgcccagggctaccagaagccagaagccaggagcctccccctagaggctccagtgggaacagggctttgccaacaccttgattttggacttctagcctctgaaaccatcctctag

SEQ ID NO: 79148 - DNA, 1118 bp, Homo sapiens
cagcctgggctacagagtgaaactccatatcaaaaataaaaaatatttgtcttacttcccctttccaggaaaatttcttgaaaagacattttatctctgcattttctgctttcatctgcattttctcctcctactcctgataatctcagcatcttttccccagcattctatgttcttggcttcttatctctcagtttacttcttagtctcctttgctgacttcacctgtattcattattaaatgttatagttcatagttttgtgtctgtaatcttctcattctactctcttactacgtcatcatactcacttataaaacttgttacactttatgtgctaatgactccaaatctgtatcctttatccagacttctctcttgtttcttatatattgctgtatctttaggctttacacagtgtctttcacttagcaggtgttcaataaatgtttctttgtgactggctgactgactaaataagtaaactttatagtaattctttgtgattcttcttaacagaccaagatcaaatcctttgtatccctaggtctagcacatagtgggtactcactaagtgctttataaatgactgattgaataaataatgaataagcaccacaataaaataaaatttcttaataagatgaatgagtgaatgaaaaaaaactttgtgctgttcattatagccagtcaagaccaaagaccttgtttattctctttgaaaatgtaactgggggccaggcgcagtggctcatgcctgtaatcccaacactttgggaggtcgaggtgggcagatcacaaggtcaggagattgagaccatcttggctaacacagtgaaaccccgtctctactaaaaatacaaaaaattagccgggtgttgtggcgggcgcctgtagtcccagctacttgggaggctgaggcaggagaatggcatgaacccaggaggcggagcttgcagtgagctgagatcgcgccactgcactgcagcctgggcaacagagcaaaactccgtctcaaaaaaaaaaaaagaaaagaaaagaaaatgtaactgggtaggccgggtgcggtggctcacacctgtaatcccagcattttgggaggccaaggcaggtggatca

SEQ ID NO: 79149 - DNA, 1049 bp, Homo sapiens
acctggctgcttatcagaatcacgtaagatttttaaaattaaaattcctgggcctttcccagactactgaatcagactggaagtagaatatgtcttttttaaagctccccaggtgattctgagcatcagccaggtttggcagttatgttacagaagatagacttgtctctagaaatcatctgagtatgaaatataatcaagaaaaatatttctggtgtggagaaaaaggagtcaagaatgacatctgtagtaagccaattgtatataacctttggaataaatggtcatagttgtgctgattgcccaagaacagaccgtaatgaaaggaaagcaggcacagctgagccattttcaaggttcccccaaatggaaagagaagcagagcaactgagctgttaagagctgccaaaattaatttagagaagccacgtaggatggggaaacatgaaaagaacttcagaagagagctggtagaaaaataaaaatgaagtttttgatattgcaggaagaaagattaagggaaaataaatgaagtagctggggatgaacaagaagtactatagggaagtatcaggaaaaaagaattcttgctgaggaaaacaaataaagagcataaacaaagaacataaaactcaggagagaggtctcaggaaggacagtaaacacattttaagagattcacagggaaaaggccaaacagagcaaggataattggcctattatagatggactcaaaatcccaaagaaacaagtattacaaaaagagagggataaggtaaagcctaaaggcaatgacggcgataacaaggggaaataaatgaaggcgctcaaaagaaaccttgaagaataattaaaattgtgcaaatatggataaagtataacttaaggtaggagagtgtgtagtacaaagagtatgggacataaaagtctaggggatcattgagcaaacatttattcagtgtttatgggtatcaggaagtttatgtgctgttacctgtgtggaatatatttagaaaaaaagtgaaaatattctggaagcatgatcagtt

SEQ ID NO: 79150 - DNA, 1033 bp, Homo sapiens
caggctaattggaagttattacggagcagttctgagtgagcaaactgatcaaatactgtagttgttggtgtcaggttttttttgcttcccctgtagctttccctcagtgatctcattcctatgacctggattaccatttgaatgtgaatggctctctggtcgtcgcccgagctccatatgtccaactgcctactgaagatctcttcttggatatgtcacagatgcctcaaaatcaataggtcaaaatctcaaaaaatcatttccccaattctctccctgaccccaagtctgttcctcttcctgtgtttccctattacagaaaattatattcttactcatctagtcaccccgattagaaatctaagcatcatacttgatgtttctccttttacgcctgtatataatcaattccacaagactattcttcccctttaatatctcacatgtatttacctctcttttctgattctattagtttagaccagaaattgaaaagaccttttctgtaaaagtccagatagtaaatactttaggctttgcaggccatatagtctctgccacaaccactgtagctcaaaagcagccacatacaatatgtaaacaaattagtgtggctattttcccataaaactttatttgtagacactgaagtttcattttcatgtaattcatatatcataaaatcttcttttgattttttccttcagctatttaaaaaaaaatgtaacagtcatccttagcttccttccctacaaaaacaggctcacaggccatagtttgcccacctctgacttagaccaacattctcacctatgatatggcagtagtacttggtctccctccttctcatcttgcccactctggtctactcttcatgttgcagccagattgactttttaaaattgcaaattgggactgggtgtgcgtggcttacgcccataatcccagcactttgggaggccgaggtgggtggatcgcctgaagtcaggagtttgagaccagcctgatcaatgtggtgaaaccctgtctctac

SEQ ID NO: 79151 - DNA, 1044 bp, Homo sapiens
ttgctctgtctcccaggctggagtacactggtgcaatcctagctcactgcagcctcaaactcctgggctcaagtgatcctcctacctcagtcacctaagtagctaggactacagacatgttccaccatgcctggctaatttcattttttattttctttagtttttgtaggtctcactgtgttggccaggctggtcttgaactgctggcctcaagtgatcctcttgctttggccttccaaactactgggattctaggcataaaccactgtgtccgacctagctgtatattttaaacttcattcttcaaagcacccaggactcgggggggtgaaaaagagggaccccctagactccttctcttgcttcacctagaacatttatattttcatctatttatggacaaacttttattttaaatttgaaagtcgtgggctctcagattgaagaatacactctacctgggactgaaagatactccatggtctttttactccatctttctttccaactcttcttttcatgtgctccagtcagacagtatgttggtggagtcttgaggtatacctcatgctttcttgccactgtatcttttcttataccatctcctccatctgaaatgcccctttcccatctgtttaaatttttacctaactttcaatgcctaatacagatataatcaattccatgaagttttcccggatctctggattcttgtagtaattatactgctttagatggtgccttgtctaatttcttgagactactctcatgttttcttagttgttttatactttcccattgagtggctggacatgggatggtgggggactgggggttgggggtgactataacagattgcatgggccaggcattgtgcctcactcctgtaatcccagcactttgggagaccaaggcaagaggattgcttaagcccgggagttcaagaacagcctggacaacatagcaagacctcatctctactaaaaataaaaaaattaacctggcatggtggcaaatgcctgtagtcccagctatcaggaggct

SEQ ID NO: 79152 - DNA, 1522 bp, Homo sapiens
ttcggtggccagcacacttaggaagaagattgcctgtttttcacccttgctcttgaagaggcacctgtgtaccagtctcctccttactgccatcctgcttggttctaacatatgcttacagagaacccaccctgcccatagcacccaggaagatgcccaattttaggccattagggtaacctagagtattcagcaggctgtcttgcagaatcacacacctcagcatagccaagcagagtcacctctgcctaccaaatcattcatttactgtagctagagattttcaaaagtgttattctttgactttttatcaggtataaaaatcacacagaaaataatgtatcctgcatctccaattgttcattatttgaacccatggtatatgttttacaagatgaactgtttcagaacatttaattaatagttgtgtcggtggtttaacaatttgaactgaaaaatattattaccaaattttgtctaacagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaaggtattattgttattattcttttgttttgtattaataggatattgactttttcttcccattttgaagtggatattttcaatcataaagaaaattgtttgattttagttcacacatgattaagtgtctgcattgtttcaaatttggattgtttgatagaagagaaaaaagagtaagttattttagagttacagctatgtccaaagcaagaggtaaagatgttcagttgatgtagcctattacttttagaaactgattgttacattccttcaaaacattttcaaattatgtaagaaaaacgatagaattctatctttttgttacttgggcagaacaaatcaaaagaggtggtgatgcagggatgcctggaatagaagagaatgacctagcaaaagttgatgatcttccccctggtaagtaaaaattgttagagaattcgactaaagtgatgataatacatttcatgtgaccccattctctttttcggtaacacttggaaaagtcacagatatctggatgatcgatatttctacttaattaagtacccattaattgccaggactttttttggatccaacttttataaaattttttgctaagatgtataaaatacttgtttttgccttgataagaatcacctatatttgaatcttttctttgcgactctgagtttttgcttatgacagttgtactatatagagtcatttatgtttactaaaagtatgcatggctcttttctttcccaccaaatgtgcccagattcctgtgttgttggtgtgctttaatatggcatagtaataccctaataagagttatttaattatttagttttgagggcttggcttgtccttttagtgaattaccccacacttttggatagtttgtttaacattttt

SEQ ID NO: 79153 - DNA, 1006 bp, Homo sapiens
atggcagcaactgtgcagagcactggttaggcagttatttgtacaaagattgcgtgtaagctaataattgaacaatgttatatttgtgaatttattcaaggtattttattttatttctttatttttatttatttatttttagagacgggggtctcgctttgttgcccaggctggtcttgaactcctgggctgaagtgatcctcccgccttagcctcacaaagtgctgggattacaggcgtgattcactgtgcccagcctattcaaggtatttttgttgatcttgtaacagttattcaaatttattcatatatgtgaatgtatagtttgcattaatttaattggctttcctttcttttttctttttttctgttttcttcaaataggaaattccttgatattttaaagcatatctgtgtatcttgaccaaagtattgtgtgaaaaacatttttattacaaagatttagctaacattttaaatataatgaaaaaatatttcctcaaaattgggttgggggattggcctgaaaacttacatctcaacaagaagaggtgtacagtaagagcataacaaataaaatatcttaatttgatcacttaagattttcttcttttttttttaaattttttttgagatggagtctcactctgtcacccaggccaggagtgcagtggcaggcaggagtgcagtggtgcaatctcagctcactgcaacctccgcctcccaggttcaagcgattcttctgcctcatcttcctgagcagctgggattacaggtccacatcaccatgcctggctaatttttgtatttttagtagagatagggtttcaccgtgttggccaggctagtctcgatcttctgacctcaggtgatccgcccgcctcggcctcccaaagtgctgggattacagtcatgaactactgctcccggccaagattttcttctaaacttatatttattctatacatttttttaattgttgccttacctgtatatatttttttaa

SEQ ID NO: 79154 - DNA, 1034 bp, Homo sapiens
tcctaaagtgttaatttagtcatacttatattagagaagtcattggttattaggaaaacattcctaaaaatggtgcccatttctttaagaaatcattcaaattttaagtggcaagcactaaaattaacacaaaagagaaattcttaataaaaattacatattttcagagtcttccctcttatatacttttgtcttggataaccttcacaaaatgtatccttttatatccagtaccccaaaagttgccagctttcacttgtttactttctggtctgccttccgtatagattccttcttttcttctctctttactcttgaattaatcctctacctacttcacaggccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgtccaaggtgagcgtgggcctggcctccatgctataaccatgaaacccacctctaagttttttggttgaatttgtgtagaatttcccccacttattagtggcagtgtaacctaaattttttgttttttctttgtgacggaatttcgcttttgttgcccaggctggagtccaatggtgcgatcttggctcaccgcaacctccacctcccgggttcaagcgattctcctgcctcagcctcccaagtagctgggattacaggcatgcaccaccacgcctggctaattttgtatatttagtagagacggggtttctccatgttggtcaggctggtctcaaactcccgacctcaggtgatctgctcacctcaggctcccaaagtgctgggattacaggcatgagccactgcgcccagccaacctcagtattaatacaaagaggttctgtggagtttttcagttttattttgaaaacttttataatagtggaatttgtaaatctgtaaattattttaatttttaaaaattttggtta

SEQ ID NO: 79155 - DNA, 1062 bp, Homo sapiens
ttttttttttgtcgcccaggctggagtacaatggcgtaatctcagctcactgcaacctccccctcccaggttcaagcaattctcttgcctcagcttcctgagtagctgggattacaggcgtccaccatcacgtccagctgatttttgtatttttacaagagacagggtttcaccatgttggccaggctggtcttgaactcctgacctcatgatctgcccgcctcagcctcccaaagtgctgggattacggcgtgagcaaccacacccagccatggtagcgctttctttaatggaggtggcctttcttgacttcagagggaatttaggaattatttaataaactatggatatctttaaaatattcctttaatattcattttaccttgatgaactatttaaaattttgctgcttcctaaaaggaactaaaatattagttcttataattatatttagtggttatctgttattctacattagatttggttaggtgatttcataatcatgtactactgctttacagataaatgcaaagaggttgttggtagaaacttgaattctgggtagaatagctacactgaatatgaactccagttaatttaaaagtcctatgaaattctgaaaacaatgtgaagataccatattaaaactttgctaacaggtataaattaacaaaaaaatacttcatatttattgaggacattgcaagtaatgactgccttcatgtatattattttgaggtaggaaacacagttgttatctctattttcctgagaagataattacaggtccaaataattttaggaactagatcatgtttgttaagtacgtgagctgggagtacatttgtttttctgttcctagacatttgctcttatcctgatttcgctttttatttgttcacttaaaaattccaaaaagggccaggcgcggtggttcactcctgtaatcccagcattttgggaggccaaggagggcagatcacaccctcctggctaagatggtgaaaccccgtctctactaaaaatacaaaaaaaattcagcccggagtggcggcgggagcc

SEQ ID NO: 79156 - DNA, 1021 bp, Homo sapiens
agtttgagaccagcctggccaacatggtaaaaccccgtctctactaaaaatacagaaattagccaggcatggtgacaggtgcctgtagtgccagctacttgggaggctgaggtaggagaatcgcttgatcctgggagacagaggttgcagtgagccaagatcgcaccactgcactccagcctaggcaacggagtgagagtcggtctcaaaaaaaaaaaaaagactacatttatataaaaatattaactcctcaatatttgtgcgttcctaaagttttactagttatgtctatctggctctatttctgtttgtctgtcatctatgtctattttctaaagatttgttaaaattaatcttgcaaaatagttccacatacttttcactctttagccaagcaactaagaaatagaacactatttgtactaggtgtaaaataacaagcaggaaactaccttaaggctatgaaaaactgagacattaattggatttctgcagtgatttaaaaaataatatgttgatacaaaattattttacttacagatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttt

SEQ ID NO: 79157 - DNA, 2215 bp, Homo sapiens
acctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaaacttgtttcactgttttgctgattctaatacatacacaaacatcacacccatgatgtaaatacattttaacactaaaatctgagtaagtttagcactcattttaagttaagctaaactaaaaaaccaaatttttttttttgaaacggagtctcactctgttgcccaggctggagtgcagtggcgcatctcagctcactgcaacttctgtctcccggattcaagcaattctcctgcctcagcctcccaagtagctgggattacaggcacgtgccaccacacctggctaatttttgtatttttggtagagacagggtttcaccatgttggccaggctggtctcaaactcctgacc

SEQ ID NO: 79158 - DNA, 1083 bp, Homo sapiens
gtcgggaccatcgccggagcctgaggacacttctctgtcgtcacagttaggtaatccccttcgtccagacgccgccgctgcttccaatctcagtcctcctcctcttccagggccgtctgccgggatctcctccccttctaaacctggtcctccagcggctctggcgccttggtaggcatgcactctttggcgcctcgtacgtccactgtgcggagccgctcctgtctggactttcccctgggaacagaaagggagctcacttcccgccagcttcacctcttaggttgcggcctgcgttgtgatttctggggttagatttcactttgctacccacccccactccgatctcaagttcctagtccccaacctctgggtaattaagttagaagtttagctttttttaacctttttggcccacctcatgttttcagcatttcattctttggagtagggtgcttttaggggggcgttgctcttatctcagttcttataaacaccttttcagaatctggaagaagggatttgactaagttctgtttatcttttgtactgttaaaatctcgagttgacattgttactttttcaaatcgggagtggtagtaaagaacagtccatgtggaaggcgtctggtttccacagtggtcagttaaagagtgaaccttattatccttaatattctctgctttctttggattttaaatgtctgtatgggtgtttacttttgcattcttgaccagagttctgtggtaaataattgcataagtaaatcttgtttatttacttctcaccctagtggtggctggatgtgtgaatgatgttaaacacttcagcgtaccttagggaaacctaaagagatctaagagctcgtaaacttacctgagatcctgaaatgaaacgtactcagtagatgttcctccgaggcagggatttatcttcctaatgctggtaacgcagtaccaagatgaatttcttcagtgggtatacaaattagtgacttgaaatgatggatttatctgtgtaattttcaaattgtagattgctttgtctccccattcttcgcccagttttaaattttcgttcctg

SEQ ID NO: 79159 - DNA, 1024 bp, Homo sapiens
actttaaaaattgtcttttgttgacaatattagcacagattgactatcaaataagcttattggtaccacacacaggttgagggttcagagataaggaaacataggagagttaagttttttgtttgtttgtttgtttgtttgtttttttttttttttttttgagacagagtttcgctcttgttccccagcctggagtgcagtggtgcgatctcagcttactggaacctctgcctcctgggtcaagccattctcctgcctcagcctcccaagcagctgggattacaggcgcccaccacgacggccggctaactttgtattttttttctttagtagagatgaggtttcaccatgttggtcaggctggtcacgagctcctgacctgaagtgatccacccgcctcagcctcccaaagtgctgggattacaggtgtgagccaccgcgcctggccaggagagttaagtttttatgcactggctgtgattagaaggggtgtagaatataggagcattgtctcggaaagatgacaggcatggtggggatagaattgtggtgggaagctttggctgcttggagtcctttgggatcctgacagtaaggaatagtgagactgagtgtggccccaagaagaattgtaagaccttaaagacaaatattttaatgaaggtcacaataggccagttgactgtactagggactatgtattttgtgatatccatatgttcctatattattattttattattattattattattattatttgagatgaagtcttgctctgtcgcccaggctggagtgcagtggggcaatcttggctcaatgcaacctccgcctcccgggttcaagcaattctcccgcttcagcctcccaggtagctaggattataggcacacgccaccatgctcggctaatttttgtatttttttagtagacatggggtttcaccatgttggccaggctgttctcgaactcctgaccttgtgatccgcccactttggcgtcccaaagtgctgggattagaggc

SEQ ID NO: 79160 - DNA, 1103 bp, Homo sapiens
gttttaaacaatgaagataatagttaattgaaagaatgaggtaaaaagagcagaagcatgtatagagcacagtgtgggcaggaaactattagtactgcagtgctaagaatgtggcagctggctgggtgcagtggctcacgcctgtaatcccagcactttgggaggccgaggcaggtggatcacgaggtcaggagattaagaccatcctggctaacatggtgaaaccccatctctactaaaaatacaaaaaattagccaggcgtggtggtgggcgcctgtagtcccagctactcggaaggctggggcaggagaatggcgtgaacccgggaggtggagcttgcagtgagctgagatcgcgccactgcgctccagcctgggtgacagagcgagactccgtctcaaaaaaaaaaaaaaagaatgtggcagcaaatagcaatgaaaacagactgggaagtagttattgtgggtttcatatgcaatgctagagtttagtctttattttgaaggcagttgatgggaaacctgggtgagaggaacaggcaagtttgtgcagtgcccaggatcgatttaaaggggacaagaagaagaaatatttcagaggtaaaatcatcaggatttgatgattgactatataagataagggagaggaataataactgtgatgtttaggatggcttctaagtttctggcttggctagttaggtagatggtagtagcattacttgtgatgaagaatatattaggaaaaatacggtaggaagagctggttttggtatgggggtggtatgggaaaagtgaattcagttttgggtgagttgaatttgaggtaccaagtaaaagtgttgagaacgtggttgagtgtgagtctgaaatttagaggcagtagagattcaagcagaattaatgatgcagtttataatgaacatttgaaagaggctcattctccaactccaacccactacctctttaatccttttacctgggctgcaggcaagtagaaaggaaattttattgcccagttttgaattgctgggcaattaactttttgtattcctgaaaggagatcttgaaccagatcacaaccagtgttgtgaacaagtagg

SEQ ID NO: 79161 - DNA, 1031 bp, Homo sapiens
ctggagttttctgtgttggaggttttttactacagtttcaattttagaaattaatggatatggggctaattaggttatctaatgtgtgagctttggtggtccatatgttttgaggaatttgattttcatctaaattattgagtgtacaggcataaagttgtttttttgtttgtttgtttttgtgttttttttttttttgagatggagtcttgctctgttgcccaggctggagtgcagtggtgtgatctctgctcactacaacctctgcctcccaggtttaagcgattttcctgcctcagcctccggagtagctgggattacaggtgcgcaccaccatgcctgactaatttttgtaattttagtagagatggggcttcactctgttgcccaggctggtctcgaactcctgacctcaggtgatctgcctgccttggcctccaaaagtgctgggattacaggcatgagccactgcgcctggtcctgttggtaatactctgtaaattctccttaaaagtatataggatctatagtgatgttcactttttccttcctaataatggttatttgcgtctttttttcctcaaactgctgaaggtttatcaatttactcatctttgcaaaaaatttaatttctggtttttaaattttttttttaattcatcttgatttctggtctgttgaatgctttgcctcttgaggttgtaatttattccttttttgtgtgtcttgcaatattttactgaatgctggatattgtgaatagggtagtaaagactgagtaaataatatttatacctggaacattgcattcgtggacttttagggtagggagttgagtcagtgtactcaggagttaagctgagtttctgttttgttgttgcagagggtaccttaagtgcgccattggcttcaaatttctctcgtgttactttgtgcttagattggtagttggcatgtgggaaggtgtttctgaattttcctgatcagttctcagcgtttggcttatgtgccttggcctcatgagtgggact

SEQ ID NO: 79162 - DNA, 3636 bp, Homo sapiens
tttgggaggccaaggcatgttcctgaggtcaggagttcgagaccagcctgaccaacatggtgaaaccctgtctctactaaaaatacaaaaattagccagacgtgattgctggcgcctgtaatcccagctactcaggaggctgaggcaggagaatcgtttgaacccaggaggtggaggttgcggtgagctgagatcgcaccactgcactccagcctgagagcgagactctgtctcaaaaaataaaaataaaaaaaacacagagattgctgagacccatcccctcccctgagtttctgatcatcagaagtgaggttaacatttgcatttctaactagttctcaaatgatgtttattctgcttgctagtccaggagctatacctgagaactagtgactttagaaactcctaccccaaattgctgtgccacatatagtaatatattataaatgtaaaattcaacatatgaatgggtgctttagtgttttggtgattaaggataaaagtatcctttgaagtttcttttactatcttgtttcattcaatttctgttttttattttaaggatgaaacactagtgcattgtagtctaaatgagctagaagatgcagcacttacttttccagtccttttccaagatgtcatttatcaggtaattaaaatttttttgatgatttttggcctgataggtaacattctgataaaaaaaacttttgtattttttttgtgtgtatgtgacattaaatgtgtttttctgtagaagtataatggatttcatcaacattttaatgatttattaacaaaattagcatcatgctagatattacataaaacaacattaatttgttactccaaaaatgctaactttcttaccttgagatctcagctagtttcataatctgtttgccagcaggtggaggcaggagcactgacatcatagatcctcaagaggaacttgccaggttaactcctggtgtttttgtttttgttttccaaaaatccaattaatacaaagaaaactcattccttgttgatcattttatttcctatagtagtaatgtggtctgtgaaaattacactttagtacatctcttttataattaatcttagaattccaggacactcttctagttattgttttacttagggcattttagtttgagcatttctctctcatctgtgctgatggacaggtaacagtgcaaaatacaaatatcattaacatttcactgtggattatgtgtgctggccatagtttttactttaaggtttttccattattataagattgagttaataatataagtgaatacactttgaaaattgcaaagtacgtttctgttttggaggttgttatttaactagcattatttgcattatataatagttgaaagattgggaatcgaaaagtttgttgtctgtcaagagggagccagcctaaagattaacttagtaaagtcacagagtgcttgccatgtggatgatgaaaatgtgtttggttgtttatgtgctcttaaaggcagttagaatgtggttatagttttcttggcagataatagttgatgtctcacagaaaccgtgaaatttaagagttaaatagaagtttgtggttcatggctactttaacctactttgtctagtaatgagttgtaagaggatttattttagttgtcagttctagttttaacctagggtaggtattgtagctatggcaataaatatttgaatactgaattcactttttatgtaagctgattttagtcctgatgtataatcgggggtaagcaaaatgtacataaaattaaaagatttaaagatttttctgttccctttcaaaactgatgattatttggtttaaggcaagtatttttcttaagaccttttttatcaaatttgttgttcttgtttagtggactttaaggacaggagtccttgtggcagatgtaaatagtatagtgatatcttagttttctcttttaagctcgataaccttgttggggtttttctttgttttttgcttttgggtgtttttcgtgattgcatttgaaaaaaatggctttaaggctttgaatttggaaaggaaagctattaattgaaaaatatagataaacaatgattttgagatgacttcttaagcttctaggtttgaaattgaaatttatttcttacagatggtttttgttctgtttatgtaattcttagtagtgaataagaaacttaagtaggtaaatttgattcttccctttcatgagcgtttctcttcagtatgatcataaaattgaatttttttcttactgcttctaccatttctgctttaactctctttttaaagttcttattatttcatgtggatctggatagttgtcttattttgaataaaaagcttctagcagcatatatgactaattaaaatactgtatgtatgtactgcatctacctctgtggaattcagacaactctttttcttatgtattctgagttacactttctgaaactgaaaaataaatgatctagcctaaatgagagcacagagcaggtagtttgaaccttataagctatagagatgattgcactttaatacgatttagttaccatatcacagacagagtttagttactttttagtaaatttttgaggatatccgtagttaatattgggtacattcccttggatttcttattttggcatagccattctgtcttttaaaaaataaatgaagaaatctttgggttagggttcccccagttttcagaccagcaagctccctttaaacagggaatgatgtcttttaaactttcagtggtgttgtctccatctactggcaaagaagaaatatacacaagggtctgagatgatctaagagatattggagaaaccacattattaggtaagatgtaacttaaatctttaaccactgtactatgatgtggcccacttaaaggtagaaatctgtaaagtactgcatatactcttattttttaaaaaatttattgaggtgaaatttacatgacaaaattaaccatttttaaatgaacagttccatagcgtgtatctgtattattcttgaatgttagttttatagcatttacatatatatgtatatatattttatatgtaaagatcaaatttttcatctgaaagccagatggagtgtcctcttgggacttattttacgttttttttctttctgtggtatatttgttatggttgacctataactaattttaactctacatgttatttctgtttcatttcaaaataatttaattgtattatatatgttttaataattgtctatatcaggggttggcaacctttttctataaagggccagttgtaaatattttaggttttgtggtccctgtcatgactgctttttgtgctattgcagcatgaaagtagccatggacaatacataaatgaaaaagcatgactgtgtcccagtacaacgttatatacaaaaatcagtggcaggctgcatttggccaccatagtttgctgattcctggtctaataattatgagagtatatacagtaaatttacatattcaaattgtaagtagaagtaagtaatcaaatgttcatcaaaattcttgtaaatgtatgtagaaaatttaaattagatccacagtaatctgg

SEQ ID NO: 79163 - DNA, 1066 bp, Homo sapiens
attaaaagaaaacagatgtcatactctaaagtggatgattccttggattcatcattttttaaaacctattgccacaatgtagcaataggttggaaggatgtcatggaaaaagtttcaaagatgtttctttttgaaagttatggtctgccgggcgctgtggctagcccctgtaatcccagcactttgggaggctgaggcgggtggatcacgaggtcaggagttcaagaccagcctggccgagatggtgaaaccctgtgtctactaaaaatacaaaaaacttaggcatggtggcggagccctgtcagctgagctattcgggaggctgaggcagagaattgcttgaacccgggaggtggaggttgtagtgagctgaaatcgcaccactgcactccagcctgggtgacagagtgagactccatctcaaaaaataaaaaaagaaagttatggtcatattatctgggcctaaaaatcatttagaaatgtttttcctaaaaagactcacatgtaatttttgggggggtcatactgttaaaattatctatgatattagattaaggtttgataaactagtagaaattactaagtatataacttgaaattatataattcgatgtgagttttaatttagactttaccacataatatgtagaatcagtttataagtggattatcattttaatgactgccttttttatttttattttttttattttttaatttttttgagacacagtcttgcttgatcacccaggctggagtgcagtggtgtgatctcagctcagtgcaacctccaccttcgctgttccagtgattctcctgcttcagcctttcaagtagctgggactacaggcgtgcaccaccaccatgcccagctaattttttgcatttttagtagagacggggtttccaccatgttggccaggctggtcttgaactcctgacttcaggtgatccgcccgccttggcctctcaaagtgctgggattacaggcgtgacctaccacgcccagccaatgactacttttttaaaaatccagctatgttaactattaatagcctttcagtac

SEQ ID NO: 79164 - DNA, 1055 bp, Homo sapiens
acaacacctttttttttttgagacggagtctcactctgttgcccagactggagtgcagtagcgcatcttggctcactgcaacctctgtctcctgggttcaagcaattctccggtctcagcctccccagtagctgggactacaggtgcatgccaccacgtccagctaatttttgtatatttagtagtatatttagtagagacagggtttcaacatgttagtctggctggtctcaaactcctgacctcaggcgatccactcgtcttggcctcccaaagtgctgggattacaggcgtgagccaccatgcctggcaccacaacactcttttacagatattctgatagattttcattttaaaagttttgcataatgaacatgttcataaatctgtatcttcaagtagtagtcaatcttgaatagttttttaaatataattatttcttattatggctttaggcattatttttaaacttttgacattttccacaatatatttggtttactgagaaaatattaaaattatttgtactataaataaaatattatcgatttgaagaaacatgtatactagactgaaatgaagcttttggcctttgggagattacataattttgaagagctgcaagtttcaagaaggtaaaatactaagtagagaaaggagtggattaaggaaatgtagaaaatgggaagtaggcagctcaggaaaggaatctttgtatgagagtaaaattagaagaaaaatggagctaatgctatttgtagaatagattttgaagcatttggaggcatgtctatgtgtgcatctgtctgtttttgtatctctgacctaacacaataaagtaatggtagtctcaagagttaaactcattgtattatatgtacctgacagatgttctttatttgttcttaccagacagtacgtagtgcttcttgacttatatatttctgttcacgcttacctatatccaaataacttagacgctgctggccttatgtctcatctctacttctgtttctgagattttcctttgcatcacatggcacaaccccatgtgg

SEQ ID NO: 79165 - DNA, 1045 bp, Homo sapiens
aaattacataccagtgaagtactgtatgctgctattagtaaaaatgacttgatcatcagtgattattattatcccaccaaagagattggtttaagtgatcgcttgtatgtgaaatatacttggtttgagtggtacttagttaatatttctatactttaaaacatgaactttttcattataatcaaagttagaatacagcacatcttaaaaagaagtggtttcccattgtatgtttatttgctgaaacttatctttgtatttccttaggtttatgtgagattaagaccatttttcagggaattcctggaacgaatgtctcagatgtatgaggtaaacatgcttaagctaattacatatgtatttttattttattcaatatagtacccatatttagaccatgtataatgattacttcttttcccctgaatttatagatcattctttttactgcttctaagaaggtgtatgcagacaagttactgaacatactagaccctaaaaagcaactggtcaggtaaatttaattaagaaatagtggaaatgtctgtcacactgatctatgaaattactgattctatttcattttaatggccattttcagttggctgcatatgtgttgaatggtgaatataaatgaattttttaagcccctaaactctttaaaagagttcctaatgatggaactccagacagacgttctttaaaggatacaaagatccagtgcctttattcactgtgacatctatatcctcatttcttttgggattggggaagacgggggttgggggggttgtgtggaatttttccacgttgtgcatgatgtttcatctccatatgtctctgaggtaatgcatgttaatttactttttaatggcatagagaaataaaaattattttttaacagaaaggatcaaattaagcccttgctttttttgaaagcaaatttatcttccatggaaagaaaatgttacatgaatctgattggaaattacagtgggtttagtcactcaggttatcctgactggactcagttccttgtgtgtgc

SEQ ID NO: 79166 - DNA, 1260 bp, Homo sapiens
ctccatctcatatacaacatttagcctaaattttaaaacattttatcccagagattattcaccataaaataaatatggcttgcattcttgtttttaggctcctcttcaatgaaataccattaatttgttaagtttctactatatttcaagttatcatcctactcgatgggaatagaataatgaatgggagatatggtcactgtatttaaggggaaaaaaaagtataggcttttctatattctctttagattggcagtgtcccatcattcacagtgcctacctagcattgtactaattgtaactatttcttgaaggaataatggaatattttatttatattaatgatccttataaaatgtattttaatggaactttcttgtttagttttatatactctgagaagaaatgacactgaaaaaccaataggcttcaatttatttccttatcctctgtctcttgcactattgagttgtcaaagaaaagtctggtgacattacttttcaaaggaacttttagatcagtgtttacttaataaatctttgtttattttttaactttttccaaactaggtaaaatataagtaaaagaggatttaattacttatttattgttttagctttctaatggaatccctatagaaagttggtttatggataaaaatgacaatgaactcctaaaattgattccattcctggagaagcttgtagaactggtaagtgtagcttatctttttctgttgtgtttttgttagctcaactatattgaaataaatatttttaaatgtctttgctttgtgtgtactgacttataaagtcaactgtgagccaggtcacaggtgccatcataggcgcctgtagtgccagctactttagagtctgaggcaggaggattgattgagcctaggaatttgaggtcatactaggcaacatagtgagactccagctctttaaaacataatgatgggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggggaatggcgtgaacccgggaggcggagcttgcagtgagccgagatcgcgccactgcactccagcctgggcgacagagcgagactccgtctcaaaaaaaaaaaaaaaaa

SEQ ID NO: 79167 - DNA, 5418 bp, Homo sapiens
tagccaggcatggtggtgggcgtctgtagtcccagctactttggaggctgaggcacaagaatcgcttgaacccaggaggcagaagttgcagtgagctgagattgtgccattgcactccagcctgagcaacagagcaagactctgtctgaaaaaacaaaaatttaaaaaagaaatcttcaacgaaattcttttcaaaatcttaaatttaactgcatctgtgtagtatctctatttggcaaataaaatatgtcataaaataaaaactggtatgttttctctgcaaggtaagaatgtatgttatgaggatcatatctttgaaattttatgcctttttaaaaattgtcttttttccacgcagaatgaagatgttcgaccacacatcagagacagatttcgcttgcatgatttgctgcccccagattaagtacaaagacttgtcaaatcactgaagggggagagaatgcaggacccttttggactaagacaaaaacattgccattactgttgaaattttgcatttttgtaccccgtcttgcttttcttatctttggtgcccaataataattaagggttacagaaagagactttatctatctcagatcgaatacatatagtaggtaggctaaaacagaagagtctttagaactagtgcaactccagtgaaattttttatgtacaggacatctgcagtttataaagaattctgtttctgccaccagcagtttgacctgtagtcacacaggattttatgataataacagagatgaaaatggacttttattttctctctgtttggtgctctaagtgggtttgtagccacttttctgttactttatgattctcatttcaacaggaatggccagtaaaagttgttttatttttcctgttaaggtttataacctttttacatttttgacctgtattagattagaatttcattatgcattccttttagttgaggcgcttcatagttttctggagatagtcaatttttagttttttattatacatttgaatggccgttttcctgctttgtctgcctgcacattgtatatttgtttaaaaatattctctacttttagtctatgtaagtttcatttagaaagacatgcatttatattttgtttctgtaatattctactgtaggtgaaatcttttcaaaaatcaagagactgggtagataagaatatatgaatgactaatatacaaaagatttaaaccattgtgatggcgtatattctcaaatggtaatatcttgcaatggcacacagatttaatggataaaggtatacctcagacttcactgtgctcacaaatctttgaggagaaagtttggtcacctgtttggcttgatttagttactgctgcctttggttttctccaggaatgaagtattcagcacagtgactcagtatttttagttattttgcatgggctggtagtacctctgttatgctctcagttacaatcaatttaaaactgtataacagtcttggtacctaacagtagctatgcataatcctgtggcacagtacactcccaagccaccaatgcagttaatatgctctcatagtggtttttctatgctatatgaaaatagtcttcaagccttggttctctaatgcagctaccacaagaggttgatatttttatagtggcgtgtaatctccttttcgggaggctttttatggaaggtagaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatcaggttgagtgttttcttactatattatctgttgtgtatgtagttagcatattgtgtcactgaactgtttaaaaatctagcatgtagagcaagcctgttttgtggaaaatccttattcattaaaaaaataatcatggcagattttctgcaaaaaaaaaacaaaagcatttgcaattcagaatactgatttttttaattttatttaaagaaaggtattttgcttgcaggaaaaaaatactacagattcattttaatgagaatctttgaaatgtatttatctttagggcatctgggcatctttatgctgtttgtcttctgtctttcttgaaataaaatgtacatacgttacctttacatatgctcttgctcaaaattgtgaacctagttacatttctccctgctcccttcctttttatgctcaaacagcgaaacccaaaacttaaaagatctgaactttcagcatgcattctgattgctgaaagatttcctgatttagtgcattctcaaaagggctttcccataatctaaagggaaatgtaagcacctatactcttgtgcctgtgggcacttcaataataaaaaccaactttttaaactaatcatcttttatcaatgataaagttgttttcagtcccacactaggagagttcctttaagtcagctgatcaagcataagatacttccgtaaagaaataaactaagaaaattttttatggcttgagaaaattccttgaggccaaattaatatatttttctttgttattttatttgagtcattttaaatttgttaatacaaaatttaagataatttacagagacaatttatccagcttccttctaccttaatacaatgttttgtcttcccattatcctctcttttctttatctgttggtagatgtaaaaaacttccatttagttaatcggaggtgtgtattttttaaattgaaatgtgcccagccccttcagctcacacaggaaacatgaactcttaaaaaactgactagtaaatgcaggagaggtggatacctgatgagacacagcgaaagtgacctgtatacacattacaactctggagtacatattaaagtcgtgctatttccagtggtaaatgtctgacttttaagacattcttttaaatatttgtatcattgttaggatgttttaatcagttgttttttaattccatgtaatatatgtagccctcatcagatttatatcaccatatttctccttgtgtcctaagagaattgatgacaattcgtaaccataaattgttttatattagctagtatgtatatttatttttacccaatggctttatctgtttcccaaaatttgtttgggatttgttgaaagcattgtgtaacttctataaacggctattttcttgtaactgtcagtgaaatgaatgtgtacattgttttcttgtatttctctgggttgttttttgtttttttttccaagggttaacatagaatgttttttttaaaaaattatctttggccaatgactttttcatctagatcttactttcattcaaccttctaaagaagttcgtttctcattgttttgttctgtcaacttgcctgaaaaacagagacttcatctcatcaatgaagaaagcatttcattattcctacagatctttcctgcgagcacagaattcttcataaggaccagatctcttccatgtctgtgtcaatcacataaagctaaaatgtaaaggacattgaagcctttatttaattgtactaatatgatggtgttatatactacatcattagctagttaaggttttctgacctgacttctctttgtcttcctaggtatttatttgttatcttttaatcttgtgtatctaaattaacttagttaatagttacccaccgaataactatgccaagcaactagtaaagaatgtttattttatttccccttataggggaagagtggactgggaacaaaaatgtatgggccaaaaggccttagggttgtcattcattgactttcttattcctctcatgagctataattgagtatagtatttttttagtgctgatgtcattacttctcatgtcttcccctgagttgaaagcctacgacaaacatgtataaaatacatttaagaattttcagaatatgaaccacaaaactcagtatcttatatttaaatgctacttaagttattattggaatccaagtctcactaactagggtacatttttataaaatgtttctctgtatcttgaattgaaattacttgcccagaggcaagagttctggggatataacatgatttgagatcttttttaaaaaagggtggggcggcgggggagagagcgacaagtttatactagtttatgcttttgatattagtattttaagatacatcagttgatcccgaaacctgaccattagaattactctgaggagcttttaaaatagattcctggagcctacccctggaaaattgtctcgctggatctcgagaggggcctgagagttctggctttttttttttgtttggttggttttgttttgttttgttttgttttttctttaaagctctcctggtgattctaatagccagtattgggtaatcaatgttttagctaaatgtgacactggtttgagagtaggcaacaaaattaaagttcaccagacatctctttgtggtagagtttttttttttttaaactgggaccagatttcacagagcttattcaagatacatggaggaataataaagaagattaaggctactgctcattatcatttttgtctttcatattttttaagggtttgcatttctaggacttggaatagttgaccatatacatagctaaaggacatgtccctgaatgagaccattatatatattatctgtaaaatatttcactatttttttattttataaatctttgtagaaataagcaatgaaatactactttcatcttttgaaatgggatttttcaaggcagtgtccttttggcattaaggtaggggggagttaatattctctctgccttgtttccacgtgaatcaatattaaagtcatggacattttaaaatctcaatttaatttcttcttatttactatgcagtatagccgtgaacaagtaatgtagatttagttttctcatcttcaaatgccctgatcaccctacctcacagggttgttgtggggataaataaaacttttatggaagcacttctctttgatgatattttatcagccatcagaaacaatataatttctaacaacatttgtacagtgcttttttttgtttagaagcatatctttttttcacattactttcccttttgatgttgaaaaacat

SEQ ID NO: 79168 - DNA, 1545 bp, Homo sapiens
tcagccccctgtgcccctccctctgctctttccgcccctccctccgcccccctccgcccccccctccgcctctccctcagccccgcagcgccaccgaccgcgttccccgcccacttcttacccgcgcgcgtcgccgccgccgcctgagggggcgtggcctcggctcggcgcacagtcagccacggtcccatcctgctccgcgccggtcaacgagagcaaacccagtgactcacctccgccgtgctaactcctcgctagctctccctctcacacacgctcacacccggctcgagatggcggcggcggcggcggcggcgggggactcggactcctggggtgaggagaagttgctggggcagggcccgggccggcgccggccccacgcagtggcaggcactaacacggctcgctttcttccgtagacgccgacgctttctccgtggaagacccagtgcggaaggtggggggcggcggcactgccggcggggaccgctgggaaggcgaggacgaggacgaggacgtcaaggtgggtgcgggctagggcgccgggcagcgcggaagcgggctggcgctgttgccggccgactctgggccccgggtcgctgccggggcctgcgggccgtgggtccaggcgcgagcatagggcctggcggtgctctcttcccctccgcttgccggccatgtgtgggccgaagactggcagcgtggcctcccggactccctcgccggttgagagtctgctctccggcgtggatcccacccgccggctggcgacgaaaggtgacagcatcggccgggtcggcccacgtgcaagcttcgcggtccggagcctctcgcaggaatgagaccgggaagttgggaattgagccttgtagcttatccatatggaaagccttgagactcgcctgtcttttcgagctcaagtcagcccagggccagtaactcatttatgaccctgaggtctacttatacagtttgttcgagggattagatgagtgaaatattgtagttgaatttcaacctttttttcccacacgagacagctagaaacagtaaagggaaataacttttggctctcccttcccccaccctgtggtaaaaagaatgaactgaccactgagatagcccgcagttagtggacagaaacccaggtagttcacaccgtgacctgagaaatggagagacgacagttactcaactacacacatacgacacctaaggaaatattgaagatttggtggtggttgtagatgacgggcccgtggttttttgttgttgttgttgttttgtctgtgccttgtagataatcatttttacctcagtcgtttgattttgaaaactccgaagggttcattatacagctgtaagtgacatttacttctacatggtttttttttttttttacagtagttacagaagtctcaaatccaaaatgttaagactcttattaacaaagttctcaaaatcttgttatatttgtgcagataaagttttgtgtgaaatggaaaatgatttttttttgtggttttgcctaatttagtgaat

SEQ ID NO: 79169 - DNA, 1059 bp, Homo sapiens
attttgtatttttagtagagacggggtttctccatgttggtcaggctggtcttgcattcccgacctcaggtgatctgcctgccttggcctcccaaagtgttgggattacaggcgtaagccggccttgattcttttttttttttttttttttttttgagacgaagtctcgccgcactgtcacctgggctggagtgcagtggcacaatcttggctcactgcaacctcccactcctgggttcaagtgattctcctgcctcagcccccaagtagttgggattataggtgtctgccaccacgcccagctaattttttgtatttttagtagagacagggtttcactatgttggccaggctggtctcaaactcctgacctcgtgatccgcccacctcagcctcccaaagtgctgggattacaggcatgagccacgcacccggcctgactcctttttaatagtgggctttagaattatatagacttaattcattaaccaggcttatgttgtatggaatactacttgaaataaatgagctattggccagagtataggatgctttttacatttggggggaagtaagaactataaagttctctcagtttttatttattaataactgaatcactttcagagaggctattgatttcagctaggttgtcctaactgctaatggagaagctttcttatgaagttagataagttgatatgagggttcatatggaaaaacaaaacatgcaagaaaggccaagaaaacactaaaaaatctgaaaacctacaaggaaggactagctctagctgacattaaagtaaagcctctgtaattaaaacagtaccggctgggcatggtggctcacgcctgcaatcccagcactttgggaggctgaggatcacctgatgtcaggagttcgagaccagcctggtcaacatggagaaaccccgtctctactaaaaatacaaaaattagcccggcatgatggtggacacctgtaatcccagctactccagaggctgaggctggagagtcacttgaacccaggaggcagaggttgcagtaagctgagat

SEQ ID NO: 79170 - DNA, 1056 bp, Homo sapiens
gatcaaaagcccagaaatagaccaagtacatatgaaaatttagtatatggtaagtcacaaggtatcttaaaatgttttttgctgcaatagaatgcaatagactgggtattgtataaacaacagatttatttcttatggttatggaggctgagaagtccagtatcaaggtgctggcatctggcgagggccttcttgctctattatcctggggcagaagggcaaaagagcacaaaggattgcaggaggtgtcagaactcatccttttatcagatatctactcctaatataaaggtattaataattcattcatgagggctttgcctctaatcatttctaaaagaccctacttctcaacactgttggattggagatttcatcacatgaactttggaggacacattcaaaccatagcccagggaaaaaaaccattatttattaaagggtttttaataaatgatgctgtgacaactgggtagccatttgggaaaaaaatgaaattagatccatgttgcatatcataacacaagaaaaaaactccaaatcagagatctaaataaaaaaaaaaatgaaaccctatacattctagaagaaattgtgggtgaattcttaggtgtaagaaaagactttctggctgggcgaagtggctcatgcctgtactcccagcacttcgggaggctgaggtgggcggatcacctgaggttgggagttcgagatcagcctgaccaacatggacaaaccccatctctactaaaaatacaaagttagccaggcatggtggtgcatgtctaatcccagctgcttgggaggctgaggcaggagaattgcttgaacccgggaggtggaggttgtagtgagcctagatcatgccattgcactccagcttgggcaaccagagcaaaactccaactcaaaaacaaaacaaaacaaaacaaaacaacaaaaaaacaagaaaagactttctaattgacttgaaatccatccagaggcaatgaaagaaaagactggggctaggcacggtggctcacgcctgtaattccagcacttcgggaagccgag

SEQ ID NO: 79171 - DNA, 1028 bp, Homo sapiens
aaagctatcttttgtttgcagataaggtagcatacctgtaaaaccctagagaagcaacgataaatctaacttaagtgataaatgaattcagtaaggtagcaggatattaacatataaaaaagccaatagtcatttttgtttatttgttttgagacagggtttttatgatagtgagttgcctaggatagagtgcagtggcactatcatagctcactgcagccttaacctcctgggctcaagtgatcttcccaccttagcctctcaagtagctgagactacaggcacatgccacgttgcccagttaattttttaattttttttttttttgcagagactgggtcttgccgataggtttttatacacaaataatagccacctagaggacataataggaaaacaccctatttataatagcaacatacaagatgaaatacttaggaataaatctaaagagaaatgcgcagagcctctaatagggaaatcactttaaaacacttctgaaaggtacaaaaatgtacttgatcaaatggaaagacagttcttattcttggttagggcagctcagcattataagatgtcaattccccctacattaatttataaatttaatgcagtacaaaaaaataccaacaaacatttctctggagttagtcaagttgataataaagttcacatagaaaagcaaacatgcaagaattattaatggaagtccttttctttaggataactgggatgacgatgatgatgaaaaaaaagaggaagcagaagtaaaaccaggtgagccactggggcgcctccatttttgtttttatgtcttgctgagcatttgtgacttgtattaagacaaatgacagaacgctcacaaaatggaacattttggtatttagaaaccaagtgtccttccattcccactttattctgttttccctgcaacttttctctatcgcctcaaaatataatcagattagatacttgctgtatttctgtatgagtgcttgttagtaggaaagggtagaggttctggcatt

SEQ ID NO: 79172 - DNA, 3871 bp, Homo sapiens
ggaggctgagatgggcggatcacttgaggccaggagttcaagaccggcctggccaacatggtgaaaccccatcactgctaaaactacaaaaattagctggatgtggtggtgcacgcctgtaatcccagctactcgggaggctgaggtatgagaatcacttgaacccaggaggcagaggttacaatgagcgaagatcatgccactgtgctccagccttggtggcagagtgaggctctgtctaaaaaaaaaaaaaaaaaaaaaaaaactaaagtgtttagaagaatgcctgaaacagtaattaccagtgttcacttttatttgttattatatacgcttatttaagaattcgtacaatacagaaaggtactgagtgcatcataatccctgtgctttttaaaaacttttgtctcattttagttagaagaacccgaagaacctaaagtgctaacaccagaagaacaattagcagataaactgcggctaaagaaattacaggaagagtcagacctcgaattagcaaaggaaacttttggtaagacgggattatgattgcaatacagtattaaactgttacaggtgaagacccagaaagttcagaaaacatctccttttcttaaaagaaacatactggctaatgtagatattagaaagcagtttttaatctctgtgtatatttgagatttcattacatgttcagatttttgaataattgttttgagtaaaagattattaagataagtcatttatagcaatgcaagaagggcaaaaaggagtagactcagatgaagtacactactgcatagaatatttttatcagctggatgaaatttgcatgaaatgtgaggtctgtagctttgaaatggactgtagggctgtcctgttgtcttaagacttagacagtaggatgttgctccaggtgagaggcatgcagcttttgctgtgccttcttgtgctcagtgtcatttccttctgcaacccttctttgcccttaccatgccctatctttagagggcctccatttctttgtgcggtgtctgcagctgtggttagtgcgtgagataaaagtgcaggatcctataaatagataaattcagagtgttccagagtaagagacatggctagagaaatagtcaaagccctcgcttcatttaaccaagttatcgttacctgttgagtacttttcagagtagaagatcatgttgaaacagttaaatcactgaaatttataaccaagaaggaaagctctagttattctgatacccctcccccactttcatactttctctactctgaaacagatcaacaggctgactgtagtgattgttttccttttcatgaggaagtatgaccttatctgtcagtggatctgtacaaataccaggagttgatgtgaatgctcctgtgcaccattgtatgcttggcaggtcttaactgcactcatctaattatagagagctcttggctgttaatatgtgtcttcctaggatggtaaaagctgcccatgtgtttattaaagaggcaggtttatgaagtgtgcataaagcctagcatgggacacctgttatagactaaaaggtaaaaacatgcattcatatagtcattgttaataggattttactgttgtgtttctcatactaaaataccacatgtaatattgttaataactaatctacttgacatggaggatacagaagcatacttatcttagtgtaaaactcatctaggccagatttttttttttctaacagggtctggctctgtcatccaggctagaggacagtggctgagatcggctcactgcaacctctgcctctgggctcaagccatcctcccaccttagcctcccaagtagctgggactacaggcgcatgccaccacgcctgggtaatttttgttttttggggctttttttgtagatacaaggtttcaccatgctgcccaggctgttgttgaagtcctgagctcaagtgatctgccgccttggcctcctaaagtgctgggattacaggcatgagccaccatgcacagcctaggccagatttcttctattgggatttaacatgtttacccccgcttagcttctggagttagacaaatactttcacaggatccatctttgtttcttattctttttgttccctctctccccactttactgtgggggtgttcttggacaagaacagagtatcccttttgtaatgtaatatgttgtgttttgtttttagagaaaggttcttgctcagtcatccagtctggaatgcagtggcatgaccatagctcactgcagcctcaaactcctgggctcaagcaatcctcccacctcagcctcccgggtagcgagggctacaggtgaatatcaccacacctggctaattttatttatttttttgagacagagtctcactctgtcacccaggctggagtgcagtggtgcagtctcggctcattgtaacctccgcctcctgggttgaagtgattctcgtgcctcagcctcccaagtagctgggattacagatacatgccaccaccatgcctggctaatttttgtatttttggtagagacagggtttcaccatgttggccaggcttgtctctcggactcctgacctcaggtgatcggcctgcctaggcctcccaaagtgttgggattacgggtgttagccactgcgtctggccacacctggctaattaaaaaaattttttttgtagagatgaggtcttgctgtgttgcccaggctggtctcaaactcctggcctcaagcgatccttcctcttaggcctcccaaacaaaacactgggattacaggtgtgagccactgtgtctggccttgatatattgtttttaaatgaataaaatacttatttataaagaaaacctgttatatataaatagatgtcaaaatactaaaatgacaaatttgtgatacagaattatatgcttccttatcgatgcattaaatcaggtgtagtggcacgtcaaataatgtcatttgagagtaattatgactgaacaatattaatattgtaagatatctgtaatggcaggagagtgtgatctctcctggtaagtcaagttttgctaataccactgtgatttgttgccagtcaattgaaactgaaggaaatgctgaattagaggttaataaagatgtaactttttttctgatttaagtttgtaacccccctcccccctcacccagccattctatccagtgactccagtggctccaggttcagagcccctgctttagaatgaaacgacagggttattcagatagctattggctttgtaaggtttcatttttaaaaatcctaacctcctgatacttttcagtgcttcttttctcctacaggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcatgtaagtaattctaatttctagcccctctgggtagatttttagtaggatgttctcttcaggaggttgaaggttattttttattttcaaggatactataatacagactcatgatttgctgtttttagcaattaccttgtgaatgttgttctgcagatacagtgaatttgagtgctggatctttttgtttgtttgtaggggtaagaggacttcttgttttacaatggcttccctaagagatacctgggcttgtcagcaaagcagctaataaaacactggcctattctttttatctgattatcacttgagaggggctgggaagtatcttttgagggaaaaggtctctggcactgtaggat

SEQ ID NO: 79173 - DNA, 1074 bp, Homo sapiens
cttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaagagatactttttgagagtatagaacacagctcttgggagtacagttctctacgttctctactaaatcttaataaatgcttgacatagttacagctttaaaacatgagtgatttgccaggtccttatgttgtcaccatagagcaacaaaggtatagggctgccttcctcttatttatttggggacattattttgttatttagataccaaggcctaattaattaagtacctataagaactatttatttggagtaactga

SEQ ID NO: 79174 - DNA, 1044 bp, Homo sapiens
aaactctccactctaaaagccctcaaacaacctcagagctagacaatccactttcagcctggctcagggtttttgcccctgccagagaaggcatttaagacagtagaggcaggagacagaggctgaggtggaggaggacaaacttattttcttcagtatttagcatcggctgggcacggtggctcatgcctgtaatcccagcattttgggaggctgagatgggtggatcacctgaggtcgggagttcaagactagcctgaccaacatggataaaccccatctctactaaaaacaaaaattagccgggcgtggtggtgcatgcctgtaatcccagctacttgggaggctgagacaggagaatcacttgaacctggggggcggatgttgcgccgagatcacgccatttgcactccagcctgagaaacgagcgaaactccgtctcaaaaaaaaaaaaaagaaaaagaaaaaaaaaatatatggcatcagcatattcacggactgatctgaaccagaatctgaagccactggtgacagtgtatgtcttggggaggtccctaattccttccctccattttcccaagagtctaccctgactgagattattcctgagaaaagctgaggctcctgaattatcagcagtacaccccatcctggagctcattactttgcacctaccggatccaacttcttcctcattagcacttcaaagtagtgctttttatgcagcaaatcaaatatgtatgtcatctcgttgtaccttccaatgccagtgaggagccgtacctgtgaagtgggaggacagctcgcatcagcatcacctggagtctggagttctctgagccagacaactaccatcagtggttgctttcagatgccaagctccaggaggagaagggctaatttccaggctaccatgcttagctccctcccatgtacccaacagggggcctctggaggattcagaaatgtcagtcactgggccaccactggctgttcttttttttttttttttgagatggagtcttgctctgtcacccaggctgg

SEQ ID NO: 79175 - DNA, 3119 bp, Homo sapiens
cagagtagaaaaatagttttttttgtccgggcacggtcgagagcagcctggacaacatggtgaaatcccatctctactaaaagtacaaaaattagccaggtgtggtggtgtacacctgtagtccccactactcaggaggccgaggcaggaggatcccttgaacccaggaggtgcaggttgcagcgagcggagatcacaccactgcattccagcctaggtgacagtgagactccatctcaaaaaaaaaaaaaaaaaaaaacagctttttatttttcctttaaccacattactatgttaaacacgtatattttccccctgatatgtattactcttgaaatgctgtagtggcattttattgactaaatgtttatatccttttctctttggcacaggtccagatgtgaaaaagctttgcatcctttgccagattttgaaggatacatccatagccattaatcatacaattattaccagctacagcattgagaatcttcagcatgaatgtagatctattttggaaagactgcagacagatggacaattcgctttggccaggagggtagcagaattagctgagttacctgtggacaacttggttattaaagaggtatcatcggtctttttttttttttttttttttagatacggggtcttgctctgtcacccaggctggagtgcagtggcgcgatctccgctcgctgcaagctccgcctctcgggttcatgcaattctcctgcctcagcctcccgagtagctgggactacaggtgcccaccaccatgcccggctgaatttttttttttttttttttttgtatttttagtagagatggggtttcactgtgttagccaggatggtcttgatctgaccttgtgatccgcccgcctctgcctcccaaagtgctgggattacaggcgtgagccaccacgcccagcctcattggtctttttaagttatttaaaatcttagcttttaaaatcagcattaaacagtaaatcaaatgagatgtataatttataggagataagacttttttttttacttttgacacacacattactttcagaaatggatgagcctacaattcccatgattgagaaatgtgtgctgcaaatgtaacattagtttgtaggatatgctacaactattttcctttgaatagaattaaatataagggggcttccacttaaaccccattccatgagatcaatcaagaattgtttttcataccataactttccagataaaatatctagggtcatctgtagccaaatctctgttctctgatttgatttggttttaacaagtatgataaggccaggtgcagtggctcatgcctataatcccagcactttgggagggcaaggcaggaggattgcttgagcccaggagtttaagaccagcctgggcaacatagggagaccctgtctctacaaaaaattaaaaattagccaggcatgatggcacacacctgtggtcccagctacctgggaggctgaggtgggaggatctcttgggtccagcaggttgaggctgcagtgtgctgtgatcgccaccactgctctccagcctgggtgacagactgagaccctgtccaaacaagtatgatatacttagggaacattagcatttatgatacttttttatccaagaaaggctaaaatctgctttgttaaatttcacagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcagtaagtgaaggagatcagatggcccagagtcttaaatggcactgttagcactgtctccaagaaggaagggacccttgtggcagaatagttctaccaagttaaggggacaacaacttttttccaggtaatctgtagactagccaattaactaggcaatgaaatagaaagatctatgtcttttaaactagctatgtttcaaagttaaagggaatctatctgatttgtagctagttcactgaaatttattctacatattctatacatctgtaaatttaatcatttccagtcttacattgatagtatatagaaatatggctttttgtttttctttttggttttttgttttttgttttttgagatggtgtttcattcttgtcgcccaggctggagtgcaatggtgtggtctcagctcactgcaacctccgcctcccaggttcaagtgattctcctgccttagcttcccaagtagctgggattactggctaatttttgtattagtagagaccgggtttcaccatgttggccaggctggtctcgaactcctgacctcaggcgattcgtccacctcggcctcccaaagtgccgagattatagggcgtgagccaccgcacccggccagaaatctgttttttatgttacctttatatgactttgttaaacttgcttattctaggagatttcttgtagatt

SEQ ID NO: 79176 - DNA, 1032 bp, Homo sapiens
tctcatggcattttttccagaagtcaattcttgcttgttttagtgaccactgttcaatgtgttttagggtctgcatttcctgtgttatctgtgaaatttaacaaagcagattttagcctttcttggataaaaaagtatcataaatgctaatgttccctaagtatatcatacttgtttggacagggtctcagtctgtcacccaggctggagagcagtggtggcgatcacagcacactgcagcctcaacctgctggacccaagagatcctcccacctcagcctcccaggtagctgggaccacaggtgtgtgccatcatgcctggctaatttttaattttttgtagagacagggtctccctatgttgcccaggctggtcttaaactcctgggctcaagcaatcctcctgccttgccctcccaaagtgctgggattataggcatgagccactgcacctggccttatcatacttgttaaaaccaaatcaaatcagagaacagagatttggctacagatgaccctagatattttatctggaaagttatggtatgaaaaacaattcttgattgatctcatggaatggggtttaagtggaagcccccttatatttaattctattcaaaggaaaatagttgtagcatatcctacaaactaatgttacatttgcagcacacatttctcaatcatgggaattgtaggctcatccatttctgaaagtaatgtgtgtgtcaaaagtaaaaaaaaaagtcttatctcctataaattatacatctcatttgatttactgtttaatgctgattttaaaagctaagattttaaataacttaaaaagaccaatgaggctgggcgtggtggctcacgcctgtaatcccagcactttgggaggcagaggcgggcggatcacaaggtcagatcaagaccatcctggctaacacagtgaaaccccatctctactaaaaatacaaaaaaaaaaaaaaaaaaaaattcagccgggcatggtggtgggcacctgtagtcccagctactcgggaggct

SEQ ID NO: 79177 - DNA, 1071 bp, Homo sapiens
aaacatctggttaattttacagtgactcaaagggctattaatttgacagtcactaagtaggaatattttacattaactctgtagttagcattcagtctttaggactcttgcccatctttttcacacatgcagctctataccagaactttccacaaagagacaatgtgcaaagctgctgaggagggcttgtttttgccagtcctctgagccccattaccagttcctgccatttggaaaggaactgagtaagtgcctcatgacaggcgatggcttttgagggaattttagctttcttagaggttcccagatttggaggttttgatttgctattctcatgaaactgctttccctaagcttctctttttctttcatagcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtaagacaatccttacagttaagttgctattaagaagttagctttcttaatcttgaaaatactttagaggggtagttaggaaattaaaatgcatgtaacattaacttacagtctacaactgggagtaaacaagttacagagaactttaaattgtggttaaaatattcaagaaataatacaacagcataaaacataaatgatataaccaatcatctcattctaagcagttaccaaatagccacatttcctcctggctggcttctacattaccctgttgtgggggtccaacccacagacgctgacctagcaacagatcaagacatacactgacagagatattttgcctgtcagtccagctaaggggctctgctctgagtctggagcattgcttcataagctggcaaagtttgcatttatttagtacagattaaatggcaaaggttttgagtaaacaccattagacggtaattaacattgccgatcccctgagtagagagcaattatgtacccgcggttgatcaaaggttggtctta

SEQ ID NO: 79178 - DNA, 1057 bp, Homo sapiens
agccttggtttctggttggcagtcacagagaaagacgctttggtggactgaccaccactgtttctttagtgccctctttagcagggaagagggacattccagacagtcctttaatcagcagatcagtggagggcaatcctactctcttatgattagtacttccctgacttttgcatatacccccttctgtctgcttcttggtcttgtgacctgcaacactctgcaggacagtttagaacagtcccttggttgctcattagtttgtttcatgtttgaaggcttttcaagccattttaactaattaagttgggtgacttattctaaacaggaaatatccatctgtagtatttgtacatttgccaggtaatccaggcctagttgttattttatttatcccgtggcagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggtagtgatagttgcttcacttctttccagagcttaagagattacttcagcatatcccttcttggctttttcttatttccatccctggatttttttttagccaacaacagataatgatgataatattagaagtaccacttactggccaggcgcagtggctcacgcctgtaatcccagcactttgggaggctgaggcgggtggatcacttgaggtcaggagtttgagaccagcctgttcaacatggtgaaaccctgtctctactaaaaatacaaaaattagccaggcatggtggcgtgggcctgtaatcccagctactcaggaggctgaggcaggataattgcttgaacctgggaggtggaggttgcagtgagccgagatcgtgccactgcactccagcctggatgacagggcaagactgtctcaaaaacaacaacaacaacaaaagtaccatt

SEQ ID NO: 79179 - DNA, 1046 bp, Homo sapiens
aagcaattctaagaaacaaacacatgcagctcctattgaaggtatgtggaaggaggagagccctataacataggcttcattgcctacttgctggatcctgaaaaagaaaggaatcaaaatcacatcagcacatgaaaattatgtctcaccaggaaaagcaaatggaattaaatcagtgacagagggagtgccagccatgtgatttgtggcctcctctcccttaccttttgccccttgcacatacccgtttaggttcctggtagcttttcagttgtcttttggcccaagagccccccgcttcccttaagctgactttctaaaacgcttagtcatagtctaaactattcttgcttccaacttcatcaagacatgaagtacaacttctgaaagactgccaacttgtgatcttatcaattatgagtacgtatacaaactacgaagaatatcaatgccacttaaatgtaagtttgacatcatgaagcacatttaaaaaaactcatataggccttttataggaatagaaaatttgggaaagacacaagaaattactattttttatttttattattatttttttgagatggagtctcgttttgtagcccagactggagtgcagtggtgtgattcttggctcacttcaacctctgcctcccgggttcaagcgattctcctgcctcagcctcctgagtagctgggactacaggcacccaccaccatgcctggctaatttttgtatttttagtagagacagggtttcaccatattggccaggctggtctcaaactcctgaggttgtgatccgcccaccttggcctcccaaaatgctgggattacaggtgtgagccatcgtgctcagcccacacaagacattattaaccatgtttttaccatgtggaatgggaagctgagggctatctttcattttcacctttctgaactacttgaatactttaccataaaaaaggtattactttgttaattataaaacaaaccaataaagtaaatctatatttagctgttcattatagtaaatgctcctctcaatt

SEQ ID NO: 79180 - DNA, 2318 bp, Homo sapiens
ctgcctcccaggttcaagtgattctcctgcctcagtctcccaagtagctgggattacaggcatgcaccgccacatctggctaattttgtatttttagtagagacggggtttctccaacttggtcaggctggtctcaactcttgacctcaggtcatccgcctgccttagtctcccaaagtgctgggattacaggcgtgagccaccgtacccggctgaagcatcatttcttaccagagtttttatgcaacttctcaggtacacatctttgtataaaatgaaggctacctctatacactgaagtaaaataaatcagattttggtagattcaaagtgatacgtagtgatgcaaaataattacagcaaccagttttatcattagagagttccatgtgcaaatctgaaattaattatggtgatatacagataattaatattgttttactttccccctagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgtgagtatttaaaatataattttgtctgggtacagtggttcacacctgtaatcccagcactttgggaagcaggaggatcacttgagcccaggagttcaaggaagcagtgagctatggtcatgccactgcactctagcctgggtgacagtgaggctctgccactaaaacaaaaaaagtaaaataaaatataatttgtattctaaaaaagggcatatctgtataatgttttacatgtacattgaaaaacatactggaaacataccacagttaacagtgattacatttggatggtgattattgttgttttcatttgtgcttccctgtgtgtcctaagtttttggcatttagtgtgtgtgatttttgttaattggaaaaaacataaatatgttttgaaaaataataaaatttaaaatcatacaggagtttgtcaaatattagcagttaaagagggaattctaagggagggagaacgttaggacaaatacctaatgcatgcggggcttaaaacctagatgacgggttgataggtgccacaaactgccatggcacatgtatacctatgtaacctgcatgttctgcacatgtatcccagaactttaaaaaaagggaattatatgatgagatgtgaattctatatttaatgtctttaataattcaattattcatttttataaggcacagaattgagaggagcatttactataatgaacagctaaatatagatttactttattggtttgttttataattaacaaagtaataccttttttatggtaaagtattcaagtagttcagaaaggtgaaaatgaaagatagccctcagcttcccattccacatggtaaaaacatggttaataatgtcttgtgtgggctgagcacgatggctcacacctgtaatcccagcattttgggaggccaaggtgggcggatcacaacctcaggagtttgagaccagcctggccaatatggtgaaaccctgtctctactaaaaatacaaaaattagccaggcatggtggtgggtgcctgtagtcccagctactcaggaggctgaggcaggagaatcgcttgaacccgggaggcagaggttgaagtgagccaagaatcacaccactgcactccagtctgggctacaaaacgagactccatctcaaaaaaataataataaaaataaaaaatagtaatttcttgtgtctttcccaaattttctattcctataaaaggcctatatgagtttttttaaatgtgcttcatgatgtcaaacttacatttaagtggcattgatattcttcgtagtttgtatacgtactcataattgataagatcacaagttggcagtctttcagaagttgtacttcatgtcttgatgaagttggaagcaagaatagtttagactatgactaagcgttttagaaagtcagcttaagggaagcggggggctcttgggccaaaagacaactgaaaagctaccaggaacctaaacgggtatgtgcaaggggcaaaaggtaagggagaggaggccacaaatcacatggctggcactccctctgtcactgatttaattccatttgcttttcctggtgagacataattttcatgtgctgatgtgattttgattcctttctttttcaggatccagcaagtaggcaatgaagcctatgttatagggctctcctccttccacataccttcaataggagc

SEQ ID NO: 79181 - DNA, 1526 bp, Homo sapiens
ttgatgtaaaaggccaattgctcaagatctgcttctatacaactaataaaaatatacgtgactttttggtaggtaaaggtgagactacatagtatacattttctagaaagcctgggtgaaaaacttggaagaaaaccttggaagaaaaaccttaagtaattttaatgttcaactaatatctaataagtaaaagtgtgacaaccccttcatctttttttccccttcatctttcttcaatgactattttacatttgtggcaaaagaaaatttgtgttaacatacattaactcaaatgttcaaaatataattcttgaatggcatattatctcatgactttttttaataatctttaattcccagcactaccttatttgataatctcatgacattttttgcaaaagtgcttgattttttgtaaagtcactgctttaattactttttattcaaggttgaaattttaaaagaaaaaaattatttttctgaaaaagagaaaagaactatagacttcgtgcatcaagttgagaagctttatttgggacatttccaagaaaatatgcaaatccagtcatttcccaggtagtctcattagtcctcttttgataatattagaataccgttagatagtatttcatttatagttgttagtgaacacaagtttcttatgtggaactgagcctgcattctccttggagataaaacttgtatcagacagaagggactcgagagttttctgtcattttaatatttgcataatcagaattatgtgttccccaaaagagtggatgttcttgagcagataaaaaggaatgatgcctttttctccaaaattaaaaaaaaaaaaatttatatcactgtttttaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaaggcaagtgtgagagagcctgaaatatgaacatactgaatgaggattaaattgggtattgatatttgaatattttgatgtgtctcaattttagaattcctttcgggaaataatattcaggttctttaaaatgcaagtcgttgcattaagatctctttcttatctcagagtttctgggagggatttataatgtgctaataaaagaaaaaaatagttaattgagatttcaaggctgagttttcattccagcttcaaagtgacaatctgttttttcaaatagtcttgagcttcttgtgtaaattggggatctatgccatctgatatgggggatctgggtcataactaacagtggtaaacagtagcaattcagagagtaaaattctggcttactattatggctgaagtttttgtttgtttattatttttaatttatttttttcttttcatccttccccatctgaaacaaagtttttatttacattaagggaaaga

SEQ ID NO: 79182 - DNA, 1101 bp, Homo sapiens
tccctctttttggaacacttatcctcttatctcagtatatctacggaacacttactggtctttaaattttttgcccatcagttactagttacttctactagcaagcctatgtggggggacacgggggtgggggtggtcatccttcttatttaggtgtttctcttctagaccttcctctctagcaccctgggttacttttatcacagcccttatcatacagtactataatcggtgtgtcttccactagctcctggagtgtagggtcttagttttactcaatttaatatcccttgaacctaactccaaatctagtaatagattttaaataaaagttcctttgttagatgttacataaatgtataatcccatgttgataatcataataaggaaatgaaaaagaacttaaaaggcaaacgtttttcttttcctaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggtgagtggtgtaatccataaagtcttaaaatgtatttaatataatttctagttattataaaattggtttgtattcataattatttcataaactaagaaatttatgtagtaaataatgacactaagaaataatgacattaataacactgagaatggctgggtgtggtggctcatgtctataatcccagtgctttgggaggttgaggcaagaagatcgcttaaggccaggaattcaataccagcatgggcaacatagcaagaccctgtctctaaaaaaaataaaaaggacgtggtggcttacaccttgtaccttgtattagtccattctcatattgctataaagaagtacctgagccgggcgtggtggctcacgcctgtaatcccagcactttgggaggctgaggtgggttgatcacctgaggtcaggagtttgagaccagcctgaccaacatggcgaaaccccgtctctactaaaagtagaaaaataagccggg

SEQ ID NO: 79183 - DNA, 1013 bp, Homo sapiens
cgggaagaggagggaggtcctagagcagtttatgttctcttagattgaagtgtagaatgactataccaggtcaactaaactgttctctacttattcaacccttctacccccaccattgtgggtaaatattattgcggatatagaatataataaatctaaactttttttcttagctttctatgggaggattctcgtaacagcagcacaccaactgaaaagcccaaactgctcgctcttggtgaaaattatgaactgcttatctatgaatttaatttgaaagatggaagatgtgatgcaaccattttgtatagctgtagtagggaggcattgcaaaagctcattgacgatcaagatatcagtaagtatctacaggtggtctttcagcatatttaaatttgtgacattaccatgtagttacatacttcaggaaaagtcatagaggtgaaatcaggtctacgctgtctgatatagtagtcactaggcagatggggctattgagcacttgaaatatggttaatatgaattaagatgtactttgtgtcatatacatattagattttgaagacttaatactaaaaataaaatatctcaattttttgtatttaattacatttcaaaatatgaaatactttgaatataagctaatgtatattattaaaattaatttcacctgtttcaatgtggctaccagaaaattttatttatttatttttattttattttatttttttgagacagtctcgctctgtcacccaggctggagtgcagtggtgccatctcagctcactgcaaccttcgcctccccagttcaactgattgtcccacctcagccttctgagtagcttagactacaggcgcccgccgccacgcccagctaacttttatatttttagtagagacagggtttcgccatgttggccaggctggtctcaaactcctgacctcaagtgatctgcccacctgggcctcccaaagtgctgggattacaggtgtgagccacccctgctagaaaa

SEQ ID NO: 79184 - DNA, 1047 bp, Homo sapiens
atttagaagaaggaagtagtgaagcaagtaacagaacatagattgggcttgaacaaggggctttgaccttgtttctgccattacttactccatcctggcctccagctgctgaaccaattgtttgtccacgtggtgacagaacaggggaagtaggttgctggggaaagctaggggttctgccagagaggctgtaggcatttgggctatctcccaggcaatcagaaccaccatgtctgtcctagagagcataaatataaatataagcaaatagatttgcttaagaaacagactcagggccaaggtttcttattatctttccgttactactaccattgtcccccacccccaggtagcaattcagaggtaacatttgcatgtttggtacgtgccaagcaatgcttagtgctttacacatttcccttcctatttaatcttaagaactatgaggggttaataccatcatccctagtttgtagataaagaaacaaactaagagaagtgagaagtgaaagaacttgccctaaagttatattgctagtaagtgatacagccagaattcaaacgtaggtctttttaaaatctaaagcttgtccccttaggtactatgttatactgcctcctagaagaaaccgaaactctagggcactatagaaaaaaagcagaacagctacaacactgctactactttctctatccaacctcttcctcagtacttgaaaatgcctcaggaaatacttcacctggctcagtctgcacatcccgagggtactagatagtatttacaaggcctttatgatcttaccaagctgtatggtcactgttgggttcctctagggaagaatgcagcgataccagttgctccccatggctcagcagggcatagagcaaagatattccaaactgcaagggacatatatatattccagagcaaaatgagttcacactcggcatttggtgctttcctgactcttatcttcccaactaaaggacaggttcacatttagagatagagctcaaaatatccacaagtgctgtcaggttttacac

SEQ ID NO: 79185 - DNA, 1061 bp, Homo sapiens
taagaaaaaaaatggaaggggtggaaacagagtacaataacatgagtaatttgatgggggctattatgaactgagaaatgaactttgaaaagtatcttggggccaaatcatgtagactcttgagtgatgtgttaaggaatgctatgagtgctgagagggcatcagaagtccttgagagcctccagagaaaggctcttaaaaatgcagcgcaatctccagtgacagaagatactgctagaaatctgctagaaaaaaaacaaaaaaggcatgtatagaggaattatgagggaaagataccaagtcacggtttattcttcaaaatggaggtggcttgttgggaaggtggaagctcatttggccagagtggaaatggaattgggagaaatcgatgaccaaatgtaaacacttggtgcctgatatagcttgacaccaagttagccccaagtgaaataccctggcaatattaatgtgtcttttcccgatattcctcaggtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggcacctgctgagatactgatgcacagcatggtttctgaaccagtagtttccctgcagttgagcagggagcagcagcagcacttgcacaaatacatatacactcttaacact

SEQ ID NO: 79186 - DNA, 1081 bp, Homo sapiens
gcacaatcttggctcactgcagcctcagcctcttggactcaagcaatcctcccatctcagcctcccaagtagctgagaccacaggtgtgcaccacccattcctggctaattttttttgtgtatttttttgtagagatgggggtctcactatgtttccctggctggtcttgaactcttgggttcaagcgatcctccagtctcgcctctcaaagtgctgggattacagagccaccacactcagccatttcctataataaaaaaatattttgtctgtgatgtagccatcaaagttttagggggaaaaattggcattgtctttccctggagtctagacctataggaaaaaaattgaaggctaatatttgggttctagataacgcaaaataaataataaaacatctgtgattaccttgattgaaaagtttgtgcatagaaattattctggtactttggagagctacaagaaggcctaacagaaaaaaaaactgataaatacaattaaaataacagtcgagcatatattaaagcacttactatgcactaaactctatatatctcctgtcattagttggatgcaattattagacatctttggtcctccacaacataggtgattaaaaagcctaagaaactgaagcgttatctatgtctttggtaagacacacaggcccaagtgaagcctgcaatgatgtgcaggcttcccctcccccacggaccacatggaccacttcctctttttttttttttttttttttctttagacagagtctcactgtatcgcctaggctggagtgcagtggcgcaatctcggctcactgcaacctctgcttcctgggttcaagtgattctcctgcctcagcctcccgagtagctgggaatacaggcatgcaccaccatgcctgactaatttttttatgtgtgtgtttttggtagagatggggtttcaccatgctggccaggctggtctcaaactcctgacctcgtgatctgctcgccttggcctcccaaagtgctgggattacaggcacttcctctttttactgttttcacttagaaaaactgagaggacttttgctgccac

SEQ ID NO: 79187 - DNA, 1103 bp, Homo sapiens
agtctgatcaaagagcaattaaattactatatatgtgctcactttgacagcacatataccaaaactggaactattcagaggttagcatggcccctgcgcaaggatgacaagcaaatttgtgaagcattctatatatttttaaaaaatcactatatatattgcctggaataagttcttacttgtaaaacaaatccaaatatatacatatgtggtatagtatactatagtaaaggtaattatgtattataaatatttatttataaatatactttaatataaatgtaatacatatagacatatatatactatgtatgtgtgactttctgtatgctttattttacagcccagaaaagcattttataagaactccagttgtagaaaagcagatgtacttccctctacagaattacccagttaacaacatggtaacaggtagtttaaaataaaatttagagtaaactcaggtaggaaagaaacaagggaatattgtgttgaataaagctgttgtacttcagatacctagagagtagagccttctctagtaagcctggtaatggaggacacatcacttaaatattgaataaattacctgcagaattgacccaggaatatgcttttaaattttctgtgctaaaacaatggtatcaaggtagggtgaccacatgtccctatttacatgagacagtcccagtttaagctgttgttctggcattagtttttaattctcaagtgtcccagtttggaagataaattatatgaacagctccaatcagagtttcttttgagaatctgatgaaacataggcccctttccttagcatacacacatagaaacataacacacacactgccattccattcaatatcaaatatataaatattttaaaaaccaaacaaaaacataacacacaaactttgcatataattgtaaaaggctcacagatgcccagaagcctatacatggattacccagatgtccatggactccttatttgggtttcctatcctagtgctgtacataaagagaagacaactaaccacggctgacattgagagggtagaaccaagggaaccaactgaaaagtggccattgggatttcaact

SEQ ID NO: 79188 - DNA, 1071 bp, Homo sapiens
tcccagccccctcccgaagccccgccccgcctccgggtctggaggaggctgggaagccccgcccctccacgctagcgccgcccaggctggcacaaaggaggaagcctagtcccgcccctgcgtgcggcgcttctcccaggccccaccttccatccagtgccctggaccctcggctgggtagcgccaccagagcgaccaaacgtcccgcgccttccaggccgcactccagagccaaaagagctccatggcggcggcggccaagcccaacaacctttccctggtggtgcacggaccgggggacttgcgcctggtaagctgggaaggagggtgggaagcataccgatcctgcctcactctcctctgagcccagccatagtcctggcttcccacttccagcctggcgccggccccgcaccttaagcgccctggctgcccagatcccagctggttcccctcggggtgtgggggcagcaggtagtggctgttgcgaagggcagggatctagtcgtgtgcctcccggaacctagccccgtggctggcacgtggccggtgcccaggacggttgcaaactgtttgaatgaagctttctctctcctttgccagctgcagattcatagtccagcctcttgtcattgacctttccaaaggaaatgctaaggctgtctgaattatcggggcagaccgtgcagagcagagaaaggggggccagaggacacttagaaacagcagaacttgtatttaactcccttgcttgggactgataaacctcccttgcaggattatgatgatcacaagagtactcagcacttagtacgtgctcaggaagtgccagctccttctcctttccttccagtctaggcctccatctccagaacccctgctgttccccttgcctgtgccagacttgtggatcttgatagctcccttgtctgtaaggatccttctctccctaagaccctgtctggttcactttccagcagtttttctttccaatcccgtgcctctgtccctttaggagcattctgtatgtgtgtcctctgccttagaccctgccttttgctccctggcttg

SEQ ID NO: 79189 - DNA, 1038 bp, Homo sapiens
gtggttttcttttatagttaggagaacaaaacgaaacaacaatctgagacttaaggattttcgcttttcccttcattttgaatagagaaagtttgagagttggagggaggaaaagggactgatgaccaagttgatgtataaagaagcaaacagtgtcagcttgctggggttctctctaaatggaaatagtacgaagttcccaaaccaggctggggagccagagtggggtttagtcccccttctactgctgctagttgtatgactcaacaaattattttccacttcaacttccccgtgaaatggggataatggtagtattcatctttggttgtatgaggattcagtggaaccaattgtgcgtgtgaaaggcctagcacagcatttagcacactgttaatggtatgtgctaactgtggagataagcaggaagccagagcccctgaggacggacacttaaaccatatcagcttaaaaagaggtggatggagaccagggccttcaaacacatgaacagttttcctaaccaaattattataatgtgggcccaggcaataatcttgctttccactgtatttaccagtttaattactgtatgcccctttgatcagtctattgagacccagaagcttttaattaggaaatgaattatggattcatgaagttagaatataaaatagtcaaattagtttttaccccatagaagctatgtttggtggtgggggtggtggaaagcttgtttttacaatgtagggttcactcgaatggtaaggaaatgcggggaattaatatattgactgcctactgcattccaggcatgtgctgggaactttaatacagggctttacaaactgtccacaatgaagggccaattttactttttccagtcggccatggactgatatgtttgcatcaatatatttgaatgctgtgtcacgtcaaaatgctataaacagccaggcacggtggctcatgcctgtaaccccagcactttgggaggccaaggcgggcagatcacttgaggccaggagtttgagacca

SEQ ID NO: 79190 - DNA, 1028 bp, Homo sapiens
atggcaaaaatcctgtctctactaaaaatacaaaaattaactgggtgtggtggtgcacaacctgtaatcccagctactcaggaggctgaggcacgagaatcacttgaatggggaggcagaggttgcagtgagccaagatcatgccactgcactgcagcgtgggtgacagaacaagactctatctcaaaacaaaaacaaacaaaaaaattatataaacatttctaaatgctcctctcaatttctgtacattgcattacaaatcagttcatcaatcaccctctgagtgcactttatctcccttcttcctgaaagctggctcttccttcaggcaggagcatctgaacagggagaagtataggaacaaaacaggctccatttccaggaaacaacaccatggaggggatgtagtcagatttttgttatgatcagctatatgaggagacaataaattaaagggaaaaataataatttcagaatgatgggttaatgttgtttaattataaagggcagaaaaattaatatattggcatcaagtttaaacattactcggaggtccatgaagatatttcttgagtttttgtccattgaggcaacgtattataccttaggtcaaaagaattgctttgacctaagcatttttaaatactcttatttatttttaaaaataagataaatctatatctgtaatacagcacattcaaaatgtctatactttactgttaagattttggggtgagaagcggatggtataatgagagggcatgaacatgggcagctcagatggtcctgtgcatcatgtctgtttctctgagccagctgcttctatgtgatcagattaaaggggctgatagtcatgaagcaggagctggattaaaccagattaccctgatagtgatgagatgcaggctacttaacccttacaagtcagagacacttgagagtgaaaagagaatgtgaaaatcctccagaaaaagagaaattgggtagcagtaagtagcccaaagaaccatctttcttgcttttatctt

SEQ ID NO: 79191 - DNA, 1094 bp, Homo sapiens
cagatgttattcaagtaatgaacattttttaaatgtggcatatagatatatagtggaatattattcagccctgaaaaaagttttgtcacatgctgtgttaaaaataaaccttgagaatattatgttaataaaaacaagccagtgacaaagtgacagatagtgtatgattccacttatatgaaataagtagccaaactcacaaaaagtagaatggtgtttgttaagggctgctgagggggtaaaatgggcagttgttacttaacaggtattcagtttcaggtttacaagatgtgaaattctagagatctgttgtataacaatgtgaatatagacaacaatattgaattatacacttaaaaagatttaagatggtaaattttatgttatgtattttaccacaatatatttttataaaacaataactagaaggaaaaaaagactccattttgagacatttagaatcacaaaacattattatatatcaatagccctacctggatgtcccaagacacctcagtcccagcatgtccaaacctaagtgtctcgtaattcttgtaggaattcagaagtcatcccagatgcctcaattcccacctcctgcgggatctgaaagaaggagagggattaggcaatgggaaatgggtgtagttggaagtgagatgggggtgtggtggccaccaggtgaggggtttaggagtctccagggtcactggtgacttgatacagatttgcatttcagcaagattgttatcagcagaacaaagttgaatggagccaggagagcttgggctggagaccagctcactggaccttgggaggaaattctacctcctactttgacctcaagtttgccaggaccaacacagctagaacaaagcctctcatgacaaaatagccaattgggaaacctttgaattttcctcccacccttaaaacacgcttcaggcactcaagggaaagggaaaatggaagaggaaaggaagaaaaacagggtctcttgcgccctgcaggtgtgcagggcagccctccacaggcccacaggaggcttggcagcagggagcaggtgactgctgtgcatctgggatgagaccagc

SEQ ID NO: 79192 - DNA, 1077 bp, Homo sapiens
gctttctatcttccaaacagatgaagaaaaaatgcccgcaaactccatgtattagctaccccttttccagcagtgtgagatgggaatatacttggcttgccttagctgggaagtggctgtggagatagagggtggcttggcttgttgcaggagctggaaaaagggcaggccacactgggctgtggaggagggggctggtccttttcccccagagtgactctgtgcttcatcccaagtttcctcacttgcctaggacaccctgggtccccagggaggagggtggctcgttaagctagattctctcatctggcatctgcccatgagcatgcaagccttcataacatctctgcttctgctgttttcaaaggttggaaaacaaagaaccagaccaaagagcgggcagactctgctcccaccctcggacatggtgccatctttgttttcctctccaggtgatcgtgttgccatcgagcctggtgctccccgagaaaatgatgaattctgcaagatgggccgatacaatctgtcaccttccatcttcttctgtgccacgccccccgatgacgggaacctctgccggttctataagcacaatgcagccttttgttacaagttagtgtccacagtcccactgggtcacctgggacctctttcccttcattagcttggtgctgtttcctgtggttatttctttattcttttcagctcataattccaaacatgaggcatcacctggacaggctactcttcttggtggcattgagagagggtagcctccctaggaataagactgactcacagtggttggttttagtctttcagtttcagtttcccttacttagagcaacaatagaaaattattgctgaaatcactcaccctctgcagacatcctggagggaattcctgtggttcatcctctgttattagtttccactgcaaccaccagaaacgtcataacaacaatgacctcggccaggtgtggtggctcatgcctgtaatcccagcactttaggaggccaaggccagtggatcatgagattaggagatcgagaccttcctggctaacacggtgaaac

SEQ ID NO: 79193 - DNA, 1026 bp, Homo sapiens
tcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttagacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctgactcatgctgctgtttatggtcctgtttagtggggaatggactcaggttacccatttcccagagggaaggatcccaggatttttgaaggttacatattttctgtaccaaatataatttcattgacatgaattatctctaatcctcatgacaagccacatacacaatcattttgtagataaagaagatataaatgccagaggagaccttaagattgtcttacaacacaacccttcagttaacgagagaggaaattgaggctcagattggggaagtgacttggcaaatcacacagtgggttagtcaatggcccaggattagacagaacccaggaatcctgacatcaaatcctttacaacatgctgcctctcataggcctgaggtgtccagtcctagaggacaaatgatgctccccatgccaccacccccaccaagcagctcctactgatgagaagatgcactaagcagtcttggtggaaacatcttcctcacgccctgtgccccctttcaggtgcccagagaaggagctccagtgtct

SEQ ID NO: 79194 - DNA, 1068 bp, Homo sapiens
cccccgaccccgttctcttccccagccaacctcctccagaagcttccacaccctctgtttctgcccctcctgagcaggctcaccaggcctcacactagtggctgacaggccctctgtcaggaagggcacccctgggccggggaagggattgctagctggggcactttgccttgggccagctcctttactcaggacactgggcagcttgagagatgtctgggccagcctggtgagctggctgggttagtggcttcctctccccatgccccttccggtcctagggcagaataaagaaaccctgaaggcagaaaagtgatttatttggaagggagactactggagcagggagaagagggctgaggagcattgcatacataggtattgggccagggtctgatgaaagaacgtgcttaaaaccttgggtgaaattagttgtggtgttagactggggtgccgagtgggtttctgtaaatggcttgccatgggtccagcctctacctcctgcaaggcatttgccagcccgtctgacagtggggagcccagaagaggaggaggtatgggagtagggagggttctaagatgccagcatccatgctcccactgcatccttacactcaccgccccaacacacatacagacatgcacacacatagtacttgtcaggtcagcttgtcttctgagatttgtttctgaagtctggaagcagaggtttcactttgccccaaatcagtagctcccctacttctcactctagtccctagacactgcccccccaccatttctccaggctgagacacatcctggtcctgggggtccctgagcccacacatggtgactgactatggccacctggaacaaggttgggaggtgggaaatcagagaaggctgaggcagccagaaataggaagaacagaggtgaggtgtgggctcaaacctctgctcaactgggcagtgggcagaacccccgggcaggggcctagaagttctcataatggtgggagaagtgagtccggtcctgcctgttgatgagctgacaggccttttccacattcttggtcatgccagggg

SEQ ID NO: 79195 - DNA, 1022 bp, Homo sapiens
attagttgggtgtgatggtgagcactggtaatgccagctactcgggaggctgaggcaggaaaatcgcttgaacccaggaggcggaggttgcagtgagccgatattgcgccattgcactccagcccaggccaacaacagcaagactctgtctcagaaaaaaaaaaaaaaaaaaaagaaaaagataatagaaaaagtgccggactatagtcaggtaacctgagttctattcttggatttgatacactagctatgtgatcctagggaaatcacttaatatctccgagcctcggtttctacctttgccaaatgagttgatagattatcgctttttttccagctgtcatactctaggagtctgaattgtaaaatcaaagaagcatttcccagaaaagtttttgtcaaaaatttgatttacataacctcagaaatgtgtattgctttaaaaattataaagttcatggagcataccaagcagcctgtataccatttctaaaccaactactcccctgcaagatagatctcttttttatagacagaaaataaattcaaagaggtttgttacttgcccaaggccacccggtaataaagtccccaaaccaggatttgaacccagctctgtctgactccacaaactatggtattccagggctccaccagtgccatattattgtttggtacaggccaaggtaaggggagatgccaggggtctggctcccaaagtggagccctgccagcctgccttagcctgggaggtaaaatggcaaggcaggcctggagacctgctcccaccctggctgacctggctccgcatctgtctgccagagcctcgtttgcatataaatggcttctctgaaatagaattatggtttctcttctctcactaatggaagagctttcactggtaattaaacaacttcctcaaaaaggcttgccagcctggtcctgcagcccagctggtcctaaccccagtaccctgagggtctggcaagggctttgctgtgtcctaatggacccttgggact

SEQ ID NO: 79196 - DNA, 1016 bp, Homo sapiens
gggcacccaagggtgtgtgtgcagaggcatgagcatctgttcgtacatttgtgcctgaatgttgtattttaaaatatgggatgaaggagggtgtctgtccgtacgtgcacgtgcgcatgtgtgcctggggacccacgggggctcagccttcccttatgggctcagccatcaggctcccctggtctgggagggcagaggtgctgcctctgggcctctgtgggttggggaggggagccagtgggcagcaacgttgggggtcggggagggacaggctggctggtggctttgggcgggattagcctgtcaggatggcaccaaggggaaccagataattgttctcagatcgataagtcatttctacagaatggcttggcagggtgatttggagaacggtaatgaactctgaggaggagaaagaaacaatattatcagtgctgaagccaccctgagaggatggactgggggaaggcagtcagctgctttggagggagaagcgtgcatggtttctcaggttgctcctctgctctctcctcccacaatgtggggactgcaacaccctgtgtggcacagaaggctgggcccacccccaccaggggatagatccaggattacgtccccagagccagtcaggcccttcagcatgggctgccctcctagagcattcctttgatcctttctggggctggaagaagtaggggttgggcactggctattcaatagggacctctgaggacctctagggtccttagagtccatgattgatatgttccccacagcccagtttgaaggaccggagaagagctgcctgtcacctggccgggaggagaaggggcggctacctccccgactctctgcagggaaccccaagtcagccaaacccctaagcatggagcccagcagccccctgggggagtggacagatccagcactgcctctggaaaaccaggtgtgagtgtctgtgtccagctggggactccctccccactcctcccctcctggcactggcttccctacag

SEQ ID NO: 79197 - DNA, 1065 bp, Homo sapiens
agggggccccctggccccgggagtcccgcctgccagaggatgatgagaggccccctgaggagtatgaccagccctgggagtggaagaaggagcggatttccaaagcctttgcaggtgagtcctggtggagagggcaggtcagctggggcctctgagcagctttccaggctcaagagaatggaaggagtggaccccaggaacccagagaggcccaggatcaggactccagggaaatgtagttgagttctgtaccatagggggtggggttggcagtgtggacacagcgctgtgtgcagggtcaaggaatgggtacaggagaaggatgaaggcattcccctgcatcaccacctcttggaagctaagaggcttagactacttctctcttttggggactgggtatatttaaaaataaattccaaaacaaacttatgaaactcgtgacatatgttaaaatacttacatttaacaaaagaaggcacttacttcaaacaataaagacagctatgggtgtaacctgaattctagggctctgcctcccagtggtaggccctggcggaccaggggtgtctggccccaaggagatttctgaggagcagagtgaggctgtgagaaatctcttgattgccaaatgaagatcaggtttcttctgtccatcccaagtccaagtccaccatggaaaagttcatgttagtggtctgaggtgggtggagcaagagcctggagtagggagagggcttttgctcctgggtccttgattcagggagaacataaagggctcaaatgccattcgacttcactcctgcctgcatatgcccctctcccctgcttgggcaaggggctcatcctggagctggacccagccctcctctgccctccccaccctgacagccagactggaaaaccacaggattctaatattcttcctgtaaagcacacaccattgaggatgggccgtttatctccagaagtctccttggagaatcaatactgtttggattgcttaatgggaaaatctatgctcgtcattaggaaacctcgttagcagtccagcagccgccagtggca

SEQ ID NO: 79198 - DNA, 1102 bp, Homo sapiens
catgatgaattcttgagcaagagaggaacaggatgaaaatgtcagctttattactgataaagttgattagagaacattacttatgttcactgcaatgggcttatgtgtcatcacaatgggcttcttaatacttcaccacagaattaaacttgcccaatcaggcttgggcaactcagtaggcctagtgggggaaccctgcaaaagaagagccagagcttgtccccatccaagctcagagcctgcccttgggtacctggggctctgggtcaaagacagcacaggagcaggccactgactgcatgaaccagaatgttctttctcttcaggaaaagagagtgtgcattcactgaccaatacaataaactgctcttcctacttgggagaggtggtaagggaggcagagagtggtcaagaatatcccaggactattattccatggagctcttggaaacacaagcctgcagaatggaggttcaccctagcagtaatctatatacggaaagatgagggtgaaggtcactgggtattggcaaagaacagatgggatttgaagaatgaaggagggccaggtccaaggagaacagtgtagtagacagaaatggagaaagtgagaagctgactaccccatttaggtcagagggtgtggaacccaggaagcccccatgaatgccctgaaattatatgtgaaaatatgggagcacattttttgggggagtagctccatagcttttatcatattttcactggggtcagtgatcccaataaaagaactactagctttggagaaggtggtcagtttgaaacaatggtatgtcaaagcgaaaggtctttatggcaatggacccaaatgactggaaatacagatgcagcaagtgccatgaggctgggcatacagttcaaggaattaggatagggaaaaatgcataagacctagtcttgggaaagagaggccaagagaggatctagggagaggccaaatgggggtgatcagaaagaaagtctttgccgggtccgtggggaggatggtcactgcctttccaatagtcattttggagaagcagatgtgacttgtgtgacctgaagtggtacaggaggccacaca

SEQ ID NO: 79199 - DNA, 1192 bp, Homo sapiens
ctcgtagggtttcacaggccccaaaatattaagaactttaaaaaatagatgtacttcatagatgatatccacaggacttgggtcctccaggcacagatttggaaaggagtaaacagacagagataggaagagtaaagtgagggatacagtcagggcatctaaagttgaacaaaatattcctgccctgaggttaggaggattggtaggggctgccagtcaatgtaagaccatctcttagccagtgttcattaagtgtatgtcattaggcgctgaaagggacacagcacctggaagacctcatacttgcctttttggggtttgtttgtttgctttaatgtttcttcttaagacttccacagagtctgtagatccagtctgcttatgttgcagatggagatagagggaggaggagagtctggggaagggagggaggagaaggtaggagtccaggtgaaggaacttttgtagactagttaaacctcttaagcctctgtggcccaggctggccatctgtgctgccgttgctgctttgaggatggctgaggcctgcagctactgggggattggatggcaggcctgtccactctacccagtgctgtcaccccacattgtggcaccaactctgtctggaagacatctgtgcttcttaccttggccagtgagtgactcaatgacaactcagctctggcactttgcctcttgggagccaggaacagctgggaccctgaggaccatgggtgggagctactggctaggctgaacaagccctggctggggcccaggacttggaggatacctgctgcccactccattagccctcaccacagagtcaacatattatgtgagagcaaaagtggggcccaaaccctgcatacggtgggcctgtgggtgcccccagagcctggtgcctagccttagggcttcacaacttggagcttattttaggtctatcactgtgggcctcctccagaaggactcagaaatttggtctttttgtctttaataatatagtggctaacatttactaggcacctaccttgtgcctgataccattttgaagcagctgacatgtgttagaccaactgatccttaaaacaatcctgtgaggaagattctactactatccccagattataaatggggaaaccagagcacaggaatgctgagtcacacttgcacggtttctcagcca

SEQ ID NO: 79200 - DNA, 1032 bp, Homo sapiens
actcctttgtcagctacagggacaggaatgaaatccagcaggctctcccaggagccatacaatctgtggtttctttaatgggtgtgatgagaaagacccaggatgccatctgagttggcccggggcagggatgctatctctctgggccctgacctggggcctcccaccatttagagagagcagctccccacccctttaggagcagagtttggggtctgagtcttcccctaggaaaagctcaaacaaggtacctgagtcccttaccctaaacctaagagatgctgctcctggatgtgagctggcgcatgcccctgtggcccagtggagctggtgtttatgtactatgtggccgctttctccctgttttctgttcctccttctctcaggccttctggcttgctttgaggtctcctcctgacatgtgatgaggcctgggaacagggatgtgctttgtgctggcctattctctcctctggagcccagtggctggggctgggggagtcagaaccctctgagaagggatgggtcatgagatttgatgaaatgggtggaggtgtttctatgacaagccagagggattgagcagaaacccagttagtatgggggcaggagagaaccaggtcctcgacagtaccgagaggcccagggggttcaggaccattagccttctccccatgtggggttctggctgccagcccaccctgggacccactgccgtagttggcaggggtgcaggggtggccatctgggcaggcctggcagggcaggtgtgggagcagcaggagccgcgccctgcaacgggcaggcagggccttgccatctggccagaggaagagcttcacggtgctgggccctcgtctggcccccaggccatgctctggcagtgggggctagagagctgggccccttgctttgctcccttttctcagacctttagcaggaaaaacctggtgtaattagggaaggggatggatatgggaacagggctctgattggacaaagctctcagctgcctgtgaccatctgtgcagt

SEQ ID NO: 79201 - DNA, 1076 bp, Homo sapiens
caagtggctccgggagcacctgggcttccgcggggggggcggcggcggagggggcagcaagccggcgccccccgagcccgactaccgcccccctgcgccctctccggccgcgccccccgcgccgcccccggacatcctggccgcctacaggctgcagcgggagcgcgacttcgaagacccctactccggggggtcgtccggctccgccgccctcgccacccctgtcgcccccggacccacgccgcccccgcgccacggctctcccccacaccgccttattcgggtcgagaccccggggcccccggcgccgcctgctgatgagcggatctccggaccccccgccagcagcgatagggtgagtgccgcgccgggccgggatggccaggagggaaggcggtcaggggtctggaggctgcgagagggacaaaggtggcctggcccgggcccctcggtgtctcagcttctggcagacgcgagcccctgaccccggggttccgagccttcacccacctttgttcagattctcaaccgactaatctgagacggaagccccaaactctgcccctctgccctatcctttgtaatggccccagaactggtgaccctccccctcccgggctggctctccacttcgtagccccctctagcctgatccatgagccttttgctaacgggaattgaggcgcacctcccaacccccactggttgatggcctttctgcccctctggaagcagcggctcagtgccctttgatctctgacccttccccctgggcatagccagcacaaagctcttccctcctgttgcctctttgcttcctcctcctcttcctcctcctgtttctccagcctaagcatccttgcaggtgctgaagccccagaaaggaggtgaagacgggtttctccttgcggacacagcacgagctggcctttgccctataggctgttgttctcaggaggcgaagacaggcagcttacagctcttgccaagggggcttcgtggggtccaggcccactcctccctccttccctcgtcctctcaggtatgaggatagtcagtgctcaggacctgttgcc

SEQ ID NO: 79202 - DNA, 1050 bp, Homo sapiens
caatttaaaacttacgaattatttatttctgcatttttctatttaatatttttggaccatggttgaccactggtaactgaaactgctgaaagtgaaactttggatgaagggactactgtgctacctaagcttccagagaaaaaaatcaggccttcatctcattgcatgcatttgcttctcaaccatgtataaagggtcttctctcgctgctacagaaaaagaggtgaaacttctcaccaactctaatccacacaaccgtcctttgatcctaatctttctcttttttcagaatttgctacatcaattatcatctttcttgtaactccagcaccaccaccgctctgtgtgtgtgggagggagctttccccctcagaaaatagtcatgctcaaaacaatccacagtgcggtctacatccctgatccgtgatcaaggccttatcatgacaaaatgatcactcctagtttgagagctaccacttgctttgcaatatcatataatcaaatagataatcaaaatgtacatacagattccacacatttttaataaccagttggtttggacttatacagatagctcaaccaaccaaaaattctatcataagctttctcatatatttgaactaactttacaacaattcatttgcctacctgatctgtagcagtgtgtagtatgtatctgttgagtgattacaaactataattattgttgctgaagtcaaaatatgcttcaggccaatcctgctccatagggataatatgctgaagggaatttagttcaatatcccaatatatttgattgttaatatcaatattataagttttattagcttctaaaatattaattttacctcatgtggtctacccgccccagcctcccaaagtgctgggatttacaggcatgagcacgtggttttattccttccaattttctattaacccattactttgaggatgaaaagtaatctgataagcctactaaatgtgatgttttggcccctaatcctgtggaagtcttatagttaattataaatggtatcataaaggaggaga

SEQ ID NO: 79203 - DNA, 1024 bp, Homo sapiens
atggaagcaggcattaactcttctggatttattcattccttgtcataacaccagcatcctattccacaattgaggaggtacccacaactgctccctgagttgtcagggaggttgaatattcagagctgtcctattttaagctttggtcctaaattgacttgaattctaaagaacagtttgaaatttagtgactgatatttctattttgtgataggattcaaaagagaaatgataattacacacttttagctcagttagttcaggacttgagtggatttcttccttgcactatctagtacctgtgtccttaagggcagggacctagctatctatacctggcttctagaactttgtgtgttcttaaaaataacaaaaacttgttaaatgacatagaattttcattgtgcaactttctagccagtgttactcctctggaatattaggattttcgtatattcagaatctaaagtatacgtaaagtgcacggtactagttccaaagtggttcactaaattgtcgtacatgtttgtcaggataaaaaacatattattattttggccgggcgcggtggctcacgcctgcaatctcaatactttgggaggctgaggtgggtggatcacctgaggtcaggagttcgagaccagcctggccaagatggtgaaaccccgtctctgctaaaaatacaaaaaataagccgggcatggtggcacatgcctgtagttctagctactctggaggctgaggcaccagaatcacttgaaccaggaggtggaggttgcagtgagctgagatggtgcccgctgcactccagactgggcagcagagtgaaactgtgtctcaaaaaaaaaaaaaaaagaaaaaaaaaatatatatatgtatacacacacatatataaaatttttttggaagtaattcttttttaattgatctatttttattgatacataattgtgcatgttttggggtacatgtgatattttggtacatgcatacaatttgtaattatcaaatcagggtgcttagg

SEQ ID NO: 79204 - DNA, 1976 bp, Homo sapiens
agctcctgggctcaagaaatccttccacctcgggctcccaaagtgctgagattacagggtgtgagctaccgcacccagccatgaaaacttctgtaaatcttaactatcgtgttctgcttaaagtgaggtacacataaagtttcctgtgctttgtttttgtaggaaaaagtacatagtttgtatctttaccttacggagtctatgagatttgagaatttgatttcactttttgtaacttaacccacagaaaaggacattaacttagcagataggaccaaggactgaatgacttctgacaaaaagcgtttggtctatccttcacttgttgagctacaaccatgcattacacttctcagctgagctctcaaagagctctatgccctgtgaaaagcagtggctgagttggatgaacacatagcattattaattttgcactgggaaaacagattatgacaggaccacagaccacaatataaaaacttggcagttctttggtgtgatatattttaattagtatttgcaaataatcagagttacttgtgtacataaacgtgtgtttcacaactatggccagatgcaaccttttggtctgtttcaggaaaagacctattattccactaacaattatgctgccttagaaacataatgggagtgtaattgaagaaagcatgtctcagaaggttttgatatgcagaactggaagctattgtaattcctacatacatttccattagctatgccttatgtaatgtgagtgcagatttttacaacttagagttcccatcagtgtttttttgccacatcaccgggtttcttattttactgttttcttttcaactttgggtgctttatttccattctctaaaactaagtttcttgctcttacgagacttagtgttccttttgaacccaggtgttccacctgacagtgtttgtctttcatagactttccagaatagacatagtcaagatcagacacgtgagcttctctctcattttaatgtgaggaaaatcatctttcagagacaaggcaccgcttagaaatgtatgtccaggtatgaaagaacctttttaaaatggctggttgttccagatccagatttctctgcacactggacttcgtagagtaagtgtggtagacaaagagactacactgcacaaccaccagtgaatatcattgctaagaagactttgggtcgtgtttctcagccactctcacagcttttgtagacttatttgattttgaaacaagcagttagctaaatctattttccttttatgcatatatgttaattggctcaacttaatatggtgttcttacagaatatgagcccatttgaaataaggttttaggcaattttgctgttggctctgatttgtatatagcaaatttaaagttacagagtgtttcctagatagaagattagttcatttggttcattttgtctttgaagcaagccaagctcatgagccagttggttatttgtcataaatgaacacccatcactatatgctatgttgaggggaggcaagtctgatcttcgaataattgataaagtttaatatctttgtagccaaaatacaatttgcaaaccctaactccagatgtgtcgtatgaatcttgacaaccaggtcttgagatttgttttactgattgccaatcaggtatattatttgtgatgttcgtgggagcatgcaaattagaagacagtgttgtgggagttcctcagtattgaattacatgtgtgcactcaggcctgccagtcactgaattctgacttgtaaagggtttaacctgctgttccaatcattgaggaccaatttgctttttgataagattggaaaacatttatggagactttcccagttaaatctatgacagtgtccacttaaatagtgcaatttagtatattctcagataactgcaacacaaaattgaaatgtgccagtatgtcatctttctacctggaagatac

SEQ ID NO: 79205 - DNA, 1090 bp, Homo sapiens
tagaataatgagaagccattaaggatgtgtaaattgacctacttatctaacagaatagcttagagagggtagaaatcagactaataaaaatatattcccagtatatttcagttgtttttttccctgtatcttattcaagatgtaactgtacaatggatagtaatgatattttcttgacattgcagttcctggaagttcatctaaatgggaggaagtacagtccaaagcaaaccatttattattgaacacatttggcatgtatagatgtactattcagcttcagagttacaggcaagaagtggacagaacttgtgcaaattgtcagagttctagtccctaattttatgtattttgggaactcctgccttatttatcctgcagtcacagacttgagagcaataaatgcaaacctaaatgagaaaatggaatccctgacagctgtgtccgtatcaagcatcagtctctcaaacagttgccccagcctgacagtgctagtctctgtttaatggtaaaaggagactttgccataattttcagatgaagatgtttcccaaacactgtttacagaatgagatgtgactctacagatacctcatagaagacaatccaagatcatacttcattaacttgacagagtacgtgtcttaaaggaagcatcaagaattcaatatttgcatttaaaaatactttttaaggccattttatattaagccagtgctggaaaactgaattttttttattatgtataataatctcgacacccagcttctggaattgctgctttctttttacagaaattactacccaacagatttcaggaagtactagtagttatcccaaaagtggaataagcatgtattcctaagtgtttcagaaatgttttatttcacacataagtcttaatgttattgttatgattatactttataaacaaccttttccagatgctacagggttttgaatctcaaagttaacatttttcattatttgtaatcttagaaccaaatctttatttattgtggtcactgttattaaatgatttaggaaatactttcaatattattctgaatggctgaagttagtcttaaac

SEQ ID NO: 79206 - DNA, 1109 bp, Homo sapiens
taaggtcatgttgctaataaactgtggcactaggacaaaaatgcaattctagattatgtattaattccttaattcccacttaacttgtgactttgttgtatttactgcattcttcccttactgatattatgtgtaagcatgaaaataaaagttcttaacaataggcttattatcattatatgttcttttcttttcttttttccttttttttttcttagtttatctgttaatgaagtattctggtttgattggcattcctttttagtgagaatgaatatgtttttaaagtatgtattaccctcttgtatatatcttacatttttaataaaaatatatgtgtacatggtttatcttgaagtattaatattttaaagtatttgtttaaagtgaatttagcaaagccatttgttttctttgataaatgtcatcggtaatgtaaaagttcctttatttccaaaataaattttacttagaaattatatattcctaataggtgtgccaagccatttgaatgtagactatatcaaagaagccttgatgaaaatagaagatgtatattcagtcgaagatttaaatatctggtctctcacttcaggaaaatctactgccatagttcacatacagctaagtatgttgctggtagtaaatgtgggcctggggttggtggacttctgcctttgaaactaaacatccctgcttataattatgtaggaagacttttctgctgaaaagatttgttttaagacaaaagcctttgtctttaaaaaacaaaggcttttgttaacagccttaaacaaaaggctctttaaagggtaagttgcaggtcagtattgataccagaacaataattttctatctctttgagatattacaaactgattttaaccttcagattaaaggtattaagaatatttcctgactggcatggtggctcgcacctgtaatcctagcactttggaaggctgaggcgggtggatcacctgaggtcaggagtttgagaccagcctggccaacatggtgaaaccccgtctctactaaaaatacaaaaattagctaggcgtggtggtgcatgcctgtaatcccagctacttgggaggctgaggcaggag

SEQ ID NO: 79207 - DNA, 1050 bp, Homo sapiens
aatatacataatttgaccctggagagagaggagtggagggtagggagaggtaagggtaaattagtggaggatccatatcagtcaagctgctaaccactttttttttctgtaagtgctaaacacattttaaataagaaaaatgattagccaggtgtggtggcatgtgcctatagtaccagctacttggaggctgagatgggaggatcacttgagcctgggagatcaaggctgcagtgaaccatgcatgatcaggccactacattccagcctgggtgacagagtgagaccctgtctcaaaaaaataaataagaaaaatgacgtgacagaaacaatagagggcttttatctccttagaggaaagaatataaaaaagactatataatatttagttggtatgaagtgtagtaaccatgctgaaaatgtatttgttatatgtgtttttccctctagaggttttgtcagctatgattagtgtgctgttggtgtatatacttatgggattcctcttatatgaagctgtgcaaagaactatccatatgaactatgaaataaatggagatataatgctcatcaccgcagctgttggagttgcagttaatgtaatgtaagctctatttttttcacattaatattttcaagtactgtgaactcagagactattgcatatgcattcagtaatattcagtgatattttgatattttaaaaatgatataactcattaacttttctgataaatgaaacactatggacgttataaattcctcattagtttgcccaggtatattggagattgagtcaaaatcatgaatttaagtaggacaaagttttttgttcttgtttaacttttagaatacttttgtgttaactagattttttttcttaagctatcaatttttttcccttaaaactttttagggaagaaagttttgaaagtttaagttaggccacatacagtggttcacacctatagtcccaacaatttgggaggccaaggtgggaagatcacttgcgctctagagttcaagacagcctggccaacatagtgagac

SEQ ID NO: 79208 - DNA, 1060 bp, Homo sapiens
cgagcccgcctcgctgagccggccgggggcggggagatgagttgcggccccgcggcagcgccccaggtattaaatagatgtgccgccccctcgcggagccccggcggagcgtcggggtcggccctgcgacccgccgccagcggcttcggaacttgaggacagggttgggcgcctttaatttataacgtgtttcgttttccacaggatggggagggacgcgcggcactgccctcgagaactggcgctccggtgaagtaggcgccgccggccgtccgcctcccccaagccgttccgcaccgcggccgctcagcctctgccatggccggctctggcgcgtggaagcgcctcaaatctatgctaaggaaggatgatgcgccgctgtttttaaatgacaccagcgcctttgacttctcggatgaggcgggggacgaggggctttctcggttcaacaaacttcgagttgtggtggccgatgacggttccgaagccccggaaaggcctgttaacggggcgcacccgaccctccaggccgacgatgattccttactggaccaagacttacctttgaccaacagtcagctgagtttgaaggtggactcctgtgacaactgcagcaaacagagagagatactgaagcagagaaaggtgaaagccaggttgaccattgctgccgttctgtacttgcttttcatgattggagaacttgtaggtgagttgtgttgccaactcactttccgtttacctttcctcgagagtctttgtcaagctgtagttacacaggctttgaggtttaacccatcttttcaggaagtttgtatttatcaagacactgatctcatgtgaaaaggccacacggttccaaagtgcagctcaatctaagtacaatataaactccccgagataactttgactttctcttctagttgttcaaccactgtcatctaccgtaaagttaaggacgttatcttcattgtatgtcatgtaacttcctctttttacaaaggtctggtaaaataccaggttaattttcgcaacgtttaaaatagtaaatgatcgtaaa

SEQ ID NO: 79209 - DNA, 1022 bp, Homo sapiens
ccagctgggaacacagggaagaagcaaacgtgtggctcgtcagaagcaaggcggcacctaacgactccagcggctggccggacagaagagattgtcgcacccggaagtgacgggggcgaaaaaactgcgggcttcgatcacgcgctcgagagttggctctgccccatggcgttgtggggaccccgcgctgatatcgtcgtctggccccggacgcagtgtcagcggactcagcagtgtggggctcgagtccctgcgatccgattggtgggagctgggggaggacggtggtcggtttgggctgctcacggggtgggtcacgaagaccggaagagcgttgtctttgttggacgcgggggagccgtcaggctttcttcactgaagctagggagaaaacaggactttcagccctcacgcggcacagctttttagtgttgtctccgtgtttagggaaaaccttcagaacagggagtgctcgctttccctgcgatttggaccattaaaaaattcgatgcctaggtctctgcgagcctcagccttgctaactagggttttgccacttttccgggctccccttgttaagtgtagatgaaagatttaagccctccgttgcagcagctactgaacaaattcggccaagttatcagaaactgcacttgctgagatcctgtggaatgatctcatgaattctgttggaaaacacttagaaaagggcataggcagctttggaccaaagaaaacgatttagctctgccatctctagcttataccctctcatctcaactgtaatggtggcctcctaatgttgctccccaattatgcctgttcagttttctcagctgcaaccaaagcttatttcaaaaaaataagaatttgcaagactcagaaacttgcactggttccccattgcctttatcagtgcattcacacactttcctctttgggcctcttttcctcttagtattagctccttcttattaactctggtaggcagaatactagcccctcaaagatgtccacagcct

SEQ ID NO: 79210 - DNA, 1068 bp, Homo sapiens
gtgagccactgcccctggccctcagactcctttgataatccagtgaaaactataagtcctctgccctgaaaaatatataaagatacagaattttgtgtatgttaatgttcatttatcatagactttaccttatagtagtaacttaaaaacattttttgaacattcatgactcattttttagaggaagctcagaggtaaaagtttaaaaagaaaagaaggatacctgtggttgggagactgtgtgtgtgccctcaaccccatttgtgggctcctttctacctgctactccccaacctccttttattagctgtgtcaatttgaaaggttccggctggtcagagtgcagtggtgtttacaactaattgatcacaaccagttacagatttctttgttccttctctaatcccactgcttcagttgaccagcctaaaaaaataaaataaataaaaggttcctaaatttgatttttgctggggacaggtttaagtgacacttctccagatgaagggttaatagaggacttgactatagaagacaaagcagtggagcaactggcagaaggattgctttctcattatttgccagatctgcagagatcaaaacaagccctccaggaactcacgtaagctaataaaaaaccagatatacactcatttcctctgtggcatagtcacaatttgtataattgtatactgtgttaagacataatattttttaacatgcaattataattgagtatgtctatatctttattgatagcagatgggaatagaggagtacatagtattctaaatgtaaaaagtgaaatgaatactcctagggtgttcgatctcttctaagaagtactcctaaatcttacctagaatctgtgattaggtttggcatttatcattattttatgaaagtattgcctattggggattgttcaggtggagatacacctgtttctgagtagagttgaaaaattgcctccataaaagtcacgcttgttttcagttgctggttcaaataagttgccagagatctgtaagtatcttttctgagatgatctgtttcattcccagtaga

SEQ ID NO: 79211 - DNA, 1058 bp, Homo sapiens
ctgggctcaagcaatccttctgcctcagcctcccaagtagctcggaccacaggtgtgtgccaccacacccagctcattttttgtgtgtgtgtgtgttttttttgtttttgtagagggtcttgctttgttgtccacgctggtcttgaattcctggcttcaagcaatcctccttccttggcctctcaaagtgctgggattataggcatgaaccactgtgcccagccaagagacaaatttatgacctgtagggtatgccagactcagtgctggatagtagagatgttgtaattgccctgagcctgttcgttgttatttcttttttttttttatcattattctctagatagcacagttttacaagcaaatgacatatttttctttgtagcattctttaaaatattcaggtaggtgacccttttaatgtcacttattcctgtgatcctaacattgattgatgtgtaaagaaatatcaaggaagttggcttctcttcctcaatgagttttgaattagaattgtaatgagaaacattagaaattatctggtctgatcttctcactttgtaaatgaggagatttaggccagagaaataaactgaatttctaagatcatatagctaactggctgttggccggggaaagctatgatttccagtcctgtgcttttttcatcttactgcttaattattctttttgacttactatcccttgatacttcatcttcctcacctctaatctgaaaaaccattgttcctcatttcctttatgggaatgttgcaattttaagatatataaaacattgaacttcttgggcaaaatactataaaaaacttcttttttggaataatacagagagttgttaaaagtaacaagtaataaaatacttttaaatgattggattattttagttattagaaattgaagcaagaataaaagacacatttagttatcagaatgtggctttagaatattattttgaaaaatcttattctatattaaataaaccttagagagttaatacatttcctacttaactaactgttaccattaaccaagatgaa

SEQ ID NO: 79212 - DNA, 1699 bp, Homo sapiens
aaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcgggtggatcatgaggtcaaaagattgagaccatcctggccaacatggtgaaaccccgtctctactagaaatacaaaaattagctgggtgtgggggcgtgcgcctgtagtcccagctacttgggaggctgaggcaggagaattgcttgaacccaggaggcagaggttgcagtaagccaagatcgtgccactgcactccagccttggtgacagagcaagactccgtctccaaaaaaaagaaaaaaaaatttcttgaagtggaatgatgtacaccaaatacccactttatagataattacagggatggtgaaaaattagtaaatagcttcacaaaagaggcagcgtgatacctttagtgttttctagaatttttttctggatattatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatc

SEQ ID NO: 79213 - DNA, 1054 bp, Homo sapiens
accatcagcccctatcaggcattcttagccacataaaagattgctagtaaatagcctttcttgttcttagaattatttgaatgcttacagttgttctgaatctgccttcttgctttcttaagtcaaagcttatttaataacatacttgatagccctcctgggaccttgtctaatgaaactcctagttctcatcaaagaaacatagactacaattcaacctttagatgacatactaaagaaaaacagcaactacaaatacataggataaagaaatcattttttttttcctcaagtgaaaaattgtacttcatgttttggatatacaataatgtgtcttgatgtacatgaaatattcaccactacagtaaacaagttagagtatggatttttcctcatacttaagggacccagtaagcaagctctaattttattcttttacagtcttgttttgcagggacaggtatgtgtctgtgccttggtggtggggtttgtctaaaacccaccagagtttagcatttactgtttccaagtgcttttcttgctcaaagtactaaataatactaaaatcatttaaagatgacagttaccattgcaaccaggcataatttgtttgtccataattgacagacaaagaactcacgttttctgcttatatctaatataacaaaagctcagagaatgattctgtgagtcatggaattttgcaactttattaaattttaaataggaaatcagtgaaggcctagagatgaaaaatatctgaagcagcaaatggcatgtatagaattaataaattgtcatgctactcagtgtatttgtttagagagtagctatgctaactaggaaagtgcactcgaaacatcctctgattagaagactacctagtgactatttgccaatacctctaattcctgctggtaatcgaaaatagatgtctaacatggaaatttaaagagaaggattgagaatatatacagagccgtaagatattgcatacatttcatgaaataagaaaaaaaaaagaaaattagttttgaaaagaaaaaattaattg

SEQ ID NO: 79214 - DNA, 1024 bp, Homo sapiens
ccccatatcccacagcctgtcttcctagatatactttatgcttaactggcttgatacactttcctcaccagatttctcatctttggggtcacttcgtttatgaatcctgctctgagccaaataacaggatggaaacttgattaatgaatttattattatacaagaacataggtactaactggttagcatattgccctttcctggtgatacacatgcattgaaaagactttttacccttacccctcaaaaaatgaggttgatgacacaaatgtggagacatggacacatcagaaaatcaggtcattattgacaacatagagctttgcctattgctcaaatgactcaatctaaacaattactagatggtgtaatacaaaaaatatatgtgtaaaccatatatctgaaaaggggttagtatccaaaatatataaggaacttatacaactcaatagcaaaaaataaataacctgtttttaaaatgggcaaaggacttgaatagacatttcaccaaagaagacatacaaatgaccaacaggtctatagaaagattctcaacatcactaataattggggaaatgctaaccaaaatcacaatgaggtatcacctcacatattaggacagccattatcaaaacaacagaaaataacaagtatttagaggatttagggaaattgaaactcgtctgaactgttgggaatgtaaaatgttgttgccgctatggaaaacagtatagagattcctcaacaaactaaaactagaactactatatgatccaacaatcccacttctgggtatttatgcaaaggaattgaaatcggtatgtcaaagagatatttgcactccaatgtccactgcagcattagtcacaatagccaagatatagaaacactgtaaatgcatatgaaaatatgaatagatggatttatgaatgggcagagaaaatagtatgtacatacattgagatattattcagcctacaaggaaggagatcctgtcatatcctgccatatggatgaaccttga

SEQ ID NO: 79215 - DNA, 1393 bp, Homo sapiens
gaaccttgttctgtagtctgctgggacggcatttgagcttactgattccttttgtgtttcttggtgtggcagattgtatattacaataatagttatggtatttttctgctccacgtagttttccagaaccctttaatcccctacataaaaggtgatacgacttccttactatcatcacaggacatttcccttaagctacgacatggtaagtcctgctactttgttgaaacccccatactggagaaacctcatgaaaagcccatatagaaatagagatgtctaaggaattgctgctgtttcagtccccagattttgaaaattcccagcctaggcaccagacatatgagagagtgagctctcaggtgattctagctccatcctctgaccatagctgcacaagagaccctgagtgagaactacctagcttagctcagtaaacacccaaaaccgtgaaagtaattgttgtttttagccactagttttggggtgatagttaagtcatctggtggttcatttatttgttgtatttattgagtacttactatatgccagatgcttttttaatgtgctagtaataaggcagtgaacaaaatagacaaatattcctgctctcacagagctttacttttagtaaggggaagcagataagataagcaaaataggtatgatgttagagataagttgcaaggagtaaaggcagggaggggagagagagaaaaatgtcagagaggaaggattgaaattttagattggataaccagaaaggacttaattgagaaggtaactaaagaccttgaaatgagtcatttgtatgcctgggctaaaagtattctatgcagaataaatgactgcaaaggtattgaggtagaggctagtctgtgtggtgaagaaacagaagacctgcatgtctagaatgaagagtgtcaagggaaagcagtaggtgatgagattaaaggtaataggcagatcatgtaaggtcttgtggatcctaataaggactttggctttcattttgaaagatgtgggaagtacttagaaatctgtcacctacatactgtctgctgatgataccagctccagtcattaattttatcccttggggtaatttggtctgagagatccaaccagccctaatccaagctattttgacacctgaaaaaccattgtgaaaagttctcttggggtggttagaattatttaggccaggccctctattctgtttgcctttggtcatgttgcttgttgaacatctacctgcagtgactagtgaagggtgagaaataaatgatttttgtagtttacattgtatcctagtgcattttgtgtgtataaaggaatgcctgagactgggtagtttataaagaaaaaaaggtttatttggctcatgattcct

SEQ ID NO: 79216 - DNA, 1307 bp, Homo sapiens
gccagaatcttcataaaatattccactatcagttcttgattgccgacgaatgaatggttgaccttcatcttcccagcccatcagtggctgttgttcacttctctccatagctttggcaagacaggcgcagcaaggactgcatttctttataatatattggttaattttaatgtcaaaacacagcaccaaaacatacaatccatatatcaaaagcagtaaagccccttcatacctacaaaagagaaatttgtgtttttaaattaaaagtgaaagtcattttagagttgatagcttttgggcagtatctattgaatgattttctaacaaaagtagccatagaacaatcaaacatttctagatattttttgttttgtagatttgtccagacttgattacagcattattatgtttattgataaaagctggacacttctgtgttgtttttttttttttaaaaacaagatcaacaaactcgtttttacttgtagattccttccaaatgataggtataaaaatgcaaggaaaatgataattggagattttcaaaataaatgtaaaattaataaatagtggtgaacattttctgcctcagctcattggcataatacattccccaacatacataataattataaaataatatagtaactgttaagttatttcaactgtccaagttttctggtataggaactttgtgtaaaatattactcagatatgggaggcttaggctgggatttttcagtttgtcatacagagcatttttaatgatttgaatgtagctgaatttggcttacagtcacaagaaaacaagatgttctaaaatataaaattatacccttggaaccaagaactgtttccctgtactctggcagttagctaatgccatcacatttgaaccttgcatttaccttttatagccagtgaatctctgtctgctgtatcttaaagaacagttctgatttccctaatggaggaagaattagcttggatactctcacagtcactatcccttacagacaactgctgagttctagaaggatttctattctaccaacacagtgtcttagggagacggactagaggacaggatgattagtttagaaattatgcttctggctaggttttaagtttcttgatagcaggtattacgccgtgctgcaaggttatggttctccagatggacaccattacattttttttttttcatatttttctggtgtcctctggagttatgcaatgtatataacctgtgtagctgtgttttacatttcattatcccttatgatatctagcatagtgagaaggac

SEQ ID NO: 79217 - DNA, 2014 bp, Homo sapiens
tagtccactttttgctagcatactattctgagacttacattaatttgggaaaagtcaagggtcaacaaatttttgtgtctgtgaggggccagatagtaattatttaggctttgcaggctgtgtgatttctgttgcagttattcagctttgccaatgtagtgtgaaaacaatcatagataatatgtaaaaccttactaataaaaacaagctgggttatgttggcacacaggcagtagtttgttcacctctgctgtaagttaatttgggttaacctttgtaggagaaattacagattatttttgtctttgttcatagtttttttgtttagggactgtagtggattatggccaagcagcagtagctagttaagtcttaatcatgaaggtagtagaaacctagaataaaattattatgcccttttcactcatttcataatatgtttgtattgccgtgttgaaaagccaaataaaatacaatccagttaagcagtgagcacccattgttttcccaaaaatagagctccttgctttgtttttgtttttttgttcttttttttttttattatggaatggaattcaatataaagagtttattgtggaccccatggaatgtgattaaattattagcataataaaaagacatcctatgaatttgatttcatttataagatctcttgaattgtaccccaggctaaataacagtggaaaatacagtttatatataatatgcaactcacaaactccagtgatcttgttatagtaatacttaatcattttgtaaatggtactaatcttcaatcttgctgaaaagaaatttgctgtgtagctagactactttgagtgaacatatgcaatttgttcttatatgaatattttcaagttgtgctattgtacttaaaatacataccagttattgtgaccatccaaaccaggatatatgtaaatgcggatatccatattgcagacatgaaaaaggttatcacaaagtagtttttccaaaacttttttctacaatctggtgtggttagaaaaagtaatgtaataataggaagggataatacccaaaaaattctttttaagtctgcttcaggcatgttgaaaacacttggtggatctgttgtggaaaaagtaaacacttttgagttttctcaaatggctaattaagttagaaatgcctatttagaaagttatattgaaataaattagctgtatcagtttttaaaaggctgtttaaaacatttgagtacctcattactgatattgctggtgaaaagaaactaattgaaactttagggcagacaatgtaagatgtgatactccgcatttctttatttggggccttaaatctataaaaatgtcttgggccattcgttaaatatattgtagatagtgtttatgaagtgtcaattggacatctcctgtggattgtcttcagtaactttttgcttaagggattaacctggtttctaacctagctactccagttgtctccacttcataatattgatgatgcctctgcctgccctatgtaccagataatgtatacttaaagaatataaaataatcatagcataatttttttattaagtcgcatatcctaattcttagtggaagtggtttttttgtcctatttcattactattttatttattaaattcagactttaccacagttcatagaaataaccttaaagtaggaggtagtatatcatctaaagtacaatttatgaaaattgagtatatttctttattcaatttaatttagtagaaggataatgataatatattggataaaaattcgaattcaaaaatgttcaaaatttgtatggcatttacaaaataatgtaacaattggatgaaatcatgttaaaactaatgttagtacaacaactcataaaaagtttgccaagcttcaaccaatgtgccattaagtaatattagatataattttaacataatcaaagaatttggattggttcttttgcgtttcttattataaacttaatttggagaggc

SEQ ID NO: 79218 - DNA, 3405 bp, Homo sapiens
aattagatttctggtcagttgcacttgtttgcaggggataaaggagtgaaatgaggataaaagggaaggaagagagattagggagactgagcagtaagcaaccgtttattctaaaaataattttgtttaaatatgtaagtttgttatagggcatggtgagttggcggcattttgtgctagcttgacttattgcttataaaattaacctcaggaattagggatttaacataaataaaatacattaaatcctaagaaaatctttcctgattccaattttgtatattctaatatgtatatatttattactttgtatgaattgtattttagtccaaatataatgcttatattatttattttaaataattaatgtttttaatcaaattaattatcacaattggctatgaggaatttcaaacctataaagtgaaatagaacttatttaaactgactagtaattctgtaacttttattttacaggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggttggaacattcctacatctgttttgctgaatctcctagtaaaagtcatttttttaaagtaatattgtatgcttacaaaagctgtaaaaatgaacttttaaaactcccaccagcttttaacagtataatgttaaaaatatactgtaatttttgttaatctcaagtttgggtttttaaagacagcaagtctggtcattcagtttaaatgaatggttatactgtttttaatgaaataagccattttcttgttgttttcagtactacatagttggatttgtttgttctagtttctccagtttttgtcaacttattgtatggtaaaacatagattttttccccccaaacttctgttttataatatgtaatttttcatgaaaagaaagggctcagaaaaattaggatgtgattttggttggttttaaattactgtaagttttagattctaaggttcaagatttttaaaatttgatttaaatgaagaaatggatttttctctctgcccctccctgccattcatattttctgcataacactattaataatatcaacctccacagccccttattttattatttccaataattccaagttcatatagaactgataatgtagcaagccccaagtatgataataggcagactattcccaactttctgtctagtttccagccattgaagtgaactgctaaaaaaagaaaaataattgaaatgttgagagagatggttatgtaagttagtcctctgctgtttacttctgcaggagctgatccatttataaatgcagttttaataaaccatggaataccaaggcacaacatatcaaacacattggatcccacgatgttagacatagccatatctcctttccctacaaaagaaaagcatactgttaaaatgtgcttaccaatactgtgttttattaataatcttcataagaaaagaaacactggatacttttttgttgttgattcgttttgaaaaattgttgttagagcaaaagtcttactgaatttgtatttttaaatttttcttgggttagtatttaaagtcttaacatttatttaataattatatttattaaaccatttttcaataaggtatatagcttatttgttgcttttcattgtaatttaacatggttaatggttaattactatttaacacacatttcaaatgaatattatttgggggattagattgagtgaaattaacctgctattaaatagtaaacttttcctctggagtcacttttttcccccttcaaagtatgttactgaggaagtaaacttttttttttttttttggtttttgttttttgagacacagtctcgctctgttgcccaggctgctggagtgccgtggcgcaatctcggctcactgcaacctccgcctcctggattcaaacaattctcctgcctcagcctcctgagtagctgggattacaggcacatgccaccacgcccggctaatttttgtatttttagtagagactgggtttcaccatgttggtcaggctggtctcaaactcctgacctcgtgatccacccgcctcggcctcccaaaatcctgggattacaggcgcgagccaccacacccggctggaagtaaacatttttaaagctacttttactcattctagccttgtagaatgaccattgcagcttgagggacctagttcttaccttttcttgcaaccaacacacttgcaattgtgtctggtatgcttgttcctgctgctaataaagtaaggcccattactgtatcgggaatttctagtgtttcccctgtaataaacagatatttcaagttacaaatcttaaagattcactaaccatcctttgcagttattttggatatttccttcgtgaacaaaaataaaataggcacatttagaattcagagccaatatgtgcttgcttattagttttttagctagcaacatatttgaatcaggctggtaattcgggtaacccaggtagcacagatttttaatgacatatctaaagatacgtaacagctaaaattctgccagtgagaaattttcctgtttgatattcttacaaaagatgtttatgtccaccattatctcatcagggctgtgctgaatatttgataatgagactgatcattccgctttttctttcttaaaaatattagtcagagttaagcaaattaattatagctatctttaagctataaatgtgttaacatgtatatataccatttattatgttctactttagtgatataccttaatttagtgggctttggcagggcgggggagggggaacgttcattaatctctgaggaaaacaaaacctgttttctacttgagtctaacatatggtcccaatttattaatacttctgttaaatttgatgtcaggtcaacatttttcagaaatgtatttattctcagaaacagaaccagagagaagttaaacaaaaggttatgtaactgttcctttaatgttgtaattgaaaacttggtttagcgtcttttttttctttctctttttttttcttaaaatgccaactaaaataattagaaagtagcttatttattgcatgcttatacattgatattggaattggaattggttgttaatttctgttactggctttgctagaattcatatgtgcataaataacactaatatttatcatcttgggggctgttctgtgatctattacatgatttttgctctctttttatttttctagtatcaaatgtgttctggctgagtgaatttg

SEQ ID NO: 79219 - DNA, 1049 bp, Homo sapiens
aactgtaaggtgctgtcatttaccaacagcttctttaattaaacttgctttttttcaggtaccagcattcaagatattaagaggactctggaaattgtgctgcatttatctttaaattgttttaaaatgtgttttccagtttcattttatgatgtttattagaaagtgtgattgctatgtttttgctttttttccccatttcattccagttgtgggctaaatattatttggatctactttaaccattatcatgtaatttctctggagattagcctattttataacttttcagaacacatttaaagactatctggcctgtgtaacaagatactggttttgtctcagtatgacatttattatcctagaccatttaattagtgtttagtaggtgagcagttgactaccagttggttttcaaaaagaaatgcagtaatagggagtggatgaaaaagtgaaagtataaagtagtccatcatgttataggtaagagattattcagatcaagatttcaacagaaaaaaatcttccttatggattgatattaaagtttgatcttatcatctggaaagggcttatgcagtttttcgacaggtcctcttgcttttacctttctccttttttttctcctcccttcctagaactaaatatgtctggctgtctgatttggttgccagactaaaattagcccatagtgatctggcaactataatatttaaagtcttctaacttgatttgttttgacatgtacatctagtggggagggaaatattttggtaagtagtcacaccctaaatttatgacctgtttggattgagtgaccatgtattccagtttgcctggggatagtctccctttacatctgttacttatgtgtaattattgataactcccccttttactctcaaaagtgttctattgtagtgatgaattcttatggccactttttattttgataaatggtattgatttacttcaaatacgagtctctagagttagcaatgatattataactgcataaggacaggtttctggttttcttcctctttcct

SEQ ID NO: 79220 - DNA, 6625 bp, Homo sapiens
tcagctatttgttgaatcgtcctttctttataagtaatctgtccttcctgtgcagtttgtgcagtttgacagcaaagaccaaagtcttaaaatcagctacatgtcattatgcaagcaacctaaggtctcaaaaatttcctcttctatggacaatagatgtggaaacacttaaggtgccatataaatataaataaatatttatatcaatgagaaaactaggtaatataatatttgccttattcagtgttatactttcatggttattgactttttagtttgatttgaaccatttaaaaagtaattatcaaattttaagtgggtctacaaatttgggcaagatactcattttcagatatgtgtgccatatataaggtgatatgatattattcaaaatcctctaggtattttattattcctctcagtgtacctttaagtggggtataaggtgtactttgtattatatcatgttttatttcataaaacacttctcattaataaatggttttatagtcgggcttcagtgtgctactttctagacaaaaacaagaaccagtgcttttatatgaaaatttgcagaaattttacagatactactacaggtatatagctttttaaaaaattttattgccaattagttaatcatatatggatctttgtaatgattgttctcatttttgttttaggtggtcttggaggcattgggatgggacttggtccgggtggacagcctattagtgccagccagttgaacataggtggagtaatgggaaatttaggtccaggtggtgagtattctaacttcctcttttctttttaaatgatacatatgctagctaataaagcctccattgatgtggtctgtaataatgtttaaaggactctaattaatagttagatatttacggtgtcacttcattctgaaaaaggaatgaaaccttgagcacagctaacatgaaagagataggcagaagtcaggagggtttctttggggccagctatgttgtagctagccttttagcattttggattttgaaatgtcttgaaggcagaaggagaatatatcatctatgaacagtatttatggagtagctgaaatgctaccatatcataggcagctaaaatctgtttatccatttgggaaggtggcttttcaggtagttatttggctgctcacctggaagaactcacagttcatttttagagattggtttttaaactttggtgttaggacccttttatattttaaaatttgttgagaacccgaaaatgctttgtttatgtagttataattaccagtatttactgtattataaatgaaaaattagaaattaaaaaaattacatattaaaaaatgataaactcattacatgttaacatacataaaagttttaagaaaataaactatttttcaatgcaaaaaagaaattggtgaggagagtggcattgttttacctttccacacatctttttaatgtttggcttaatattgctgttatatctgtttctgcactttagttttttgtgatattgtacatcatatagtgtttggaaaattacaccttaaactcaagagaatgagggtaaaacatcaaataatgtcttagtagtatttggtgacttaaatagttttgacctattgaaccctcaagagtccctggaccatactttgtgaattactgttttaattgatggactaataaatgctatcagattcctattttgtcaagatgctgtagtcacactttaaattatgaggctcattatcataatcattctgatccaaacaagttttctcccttacccttagactctcacacctacctaccctctcctaaatacatactatttatattttgaaaatttttactgctcttttaactgcgatgtttagagagtccttacattctggcctgatctctaaatctgctgtaatgctatttctgtgtctatgctggaaaaaaaaaatcattgatagtagtatttctgtgtttattgtggaaaaaaaagtgaatgattacctagttcaagatattctctaactgaatgttgtgggtgttactagtgaattttgctttcttgtctgataaatgttcaaagaaacccttttgaagattcatgattagacagctgctatggcatagcactttaaaccatgcctcctgtaccctaccgcttctctagtgtttcattgtggttataccagtggtatctattttgctataatgcattatatcatcttttagtcataaaaataaaatatacttaaagtacatactgtgtattttatttgaggtatgggaatggatggtccaggttttggaggaatgaatagaattggaggaggtatgtataaagatttgtttttttgtatgtacccatcaccatttttaataaactagaaactgtgttgagaattccatgaaaaaaaagtcatggtttattgttggctcatgttctaaaggctgctagcagaaattgagcctggtacatacttaaaggaaggtgatgtgttaagaagtagctgcacaaggtagggtggatgaagagcttactggtgagatttaacatttacaaaacgtacctttcagctacatgactgacagttggatctcaaaattaatctttattccataggaatagggtttggtggtctggaagcaatgaatagcatgggaggatttggaggagttggccgaatgggaggtaggtaaatgtatgcagtgggaagtgtgtgcatatttagttttccctattattaatatttcccccctataacttaggaatgtgtgctaaaaatgtcttcagaaggcatataggcactaggggataaggacaggcctggggaatggggatgatatgtgtggcatgtgaggtaaattgggtaaatgacagactattttatatttgtgacttacgcgtcttttcataatttagatacattcctgaatgttttcaacatgtattgatatatttgaaaaggttaatttgttgcacaattttttcagagctgtaccgtggtgcgatgactagtagcatggagcgagattttggacgtggtgatattggaataaatcaaggctttggagattcctttggtagacttggtagggctggctgcatacttctccttttctttttgtaggctataatttttgaaatttggtttctctttttttgtgaaaaatcagaaaatcataatgttttatacaacttattacctgaagaaaacactttaaggattttaatatgctagctctctttttcaacatcttacatatttgaactctattttcagaagactttatgcttttcatttattgtaaatcagagcacatagtaccttgggaattttaaagtatgattatttaaaattaattagtatattatctttccatccttgtttaggcagtgcaatgattggagggtttgcaggaagaataggatcttctaacatgggtccagtaggatctggaataagtaggtttaaattttactagaatttattcagtaatatttgagtgcttgcaaagactttgcaagagtagttatcgtagtatagtaatactttgttcttatacgttaatgtgtcttgctataatttgagaaaccttgataattgagcaaagcctttctgtttgattattgtttgaaatttctaaattaactgtttgaattttacttttttgatatttctaaactatgtgttaacagccaatccaggaaccttctttccaactaaggaatctggggatttctctgatcatgtttcaggagcaacttttgctttagcaccaactttgtttccttgcttattttctataatagctattagtgactagcttattttatttgtaaacatctatgtcttttggtaaatgcagatatagcactcttaggcatctcctgagcttgagtcaggctaaggttgaaagaggtacttaattcttttcctcttgaacctttcccgtaatagcatcaagagtagttgcaacactggggaatgctgaatctcccatccgtctatttccactcctaccttttaggccttatattaagcctgaatacatggattatttatttatttttttaacctcttttgcttactgggacatgtctctgagctctccatactttattgacttcctttaattgatcaaatttcacaaatagaaaatacaacctatttaaactattctaaaagtaaattctaaaatcctgtcagcttaagacgtctacttccattgtatcttgctccttttattcctccttccatcatcttttagcctcagccatttcctattagtcctaacttccttaccttcctcttttatctcagtgtttgtacttctgtttccctgattttatattggttattcacaaaaagccaatttgagggtgatgttaatttttagaatttccatgtttggggatattacatacaagacaaaaggtttgataatgagtaagatgggagcaattgaaaaggacaggaaatcgagtcagtgcataagaatgaagtaggtatgagttcggagctaaattcttaagctctggctaacgggaagtgatagcattttttgttcccttgacaagttccgtgtaatattgagattaaaagttatgttttgctatgagtattgaattaccatgagaataaaaactgggaaacagaggtgaagatgctgaggtgaaagataagctaggaaaggagtatttacttgtaggagagtatgatgagagcggcttgagtgctagagttgtaataatttgcatttatctctgtgtatctttattttagcaattattatgcttgatattattggaaaataaaaataaggatcagaacaactgtcctgttattggaagcagtgattggtagaggatttatatatttatatgatatatttagtgatcagaatacaattttatacagttatatatgcataatgtatttatacagtggctagaatttctcagctaactaaatgtatatgtaagcaaattctgttctttggaaagttgttatctgtatgaaaataattttatgtttttatattatttaattatataaacaaattaatttcccccttctttctcaaaaatgtttatctccttttcctcctttctcctcttctccttttccttatgtttttgaaacaaaaacacaaaattcccaaatccccccgtcctttcttgaaaatccaggtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatgtaagcaaataaatattaaggataattcaaattcttttttttcttgtatatatgttactaatacctcttttcattctagctaccttttgacttgacttggcagaaactaaaagagaaattcagtcagtgtggtaagtatgcaaatgactgcagatatgttgatattgattatggaggaaaattggttttaaacttttatacactgtgtttagacctttgcctgtccggatgcctattcctggatagtcttgatagcgtgccaggtctaattccacttcaaataaatgaattatttcactatcttttgacttagagcagtgctattactactaggtaataacaaggtttaggtaacaaggtttaggatataccctatcattgttttctgttaataaagatagggcttattttattacctcattttaaaaagataaatatattatcattctttgcattaaactttttttctcatgagaaatattaataaatggtatatttatttccttgtttatagtatagtgcaggggattatcagcataaccaactgagatgctgatgtccaattgataaaggagttaataggtgagacccattctacatacactgtattcctacccaacacaggaaacctagctggtagcatacaacccactgtcaggaatgccttggacatgggtacattttggttgcccttcttattcttttataaactgttcttaactataatgatactacttatacaaccttaatgtgttccacaggtctgtggaagattaggtggtttatcacttttaaaaaagagctttttatataccatacttaacttttgttacaaatatcttaattgactaaattctcactttttctttcttttgcaataatgagagaattcatgtgagtgttataaagtaaaatattttttgctagtattaatatttttctgctattgcatggaatctcagcgactgtagtcacaataggaaattacataagatagcatatatataatttctgaggtcatgaaggaataggtttagtgttctgtcacaaaatagcctttgtggccactacagagataatattatctcatatttctttatatctaactcttttgtagcttttattatattaatagttatttgttcaagttttcttccatcctacgtggaagctcttgaaggcaagaattgtctttttatcttagctccttt

SEQ ID NO: 79221 - DNA, 12066 bp, Homo sapiens
ttttaattatgcttctaattaagggaggagaaagttctgagaagaaactattaacctttaagagatgaactttttcagagtatcactgtgtaagttagtttttaaaaaagtttttaatgatgcccagaaagttaattctccatcaaaggtggcagttttagataccttagaagtaaaattatctgctcttccctctgttccagtctaatagcatttattaattaagtagtgtgatgggaaaaactgggtgattgtttggatgcttacaactatttaatgtgggaaaaaaatgaggactgttaaatgagaaaccaaatccttgctttgaaatagcattgggtaatttcaaagctctcaggctgattctccagctactttgctgaggtctagcttagtggagagttttgtgaggtgataaatatggaatacttatttaatatagacttccattcttataagcacaactgagggtttttgtttgtttgactttttttaattcacagggagaatgatgaatcagcaaaagaagagaaatctgacttaaaggaaaaatctacaggaagtaagaaggccaatagatttcatccttattcaaaagacaagaattcgggcgctggagaaaagaagggtccaaatcgtaacagagttttcattagcaacatcccatatgacatgaaatggcaagctattaaagatctaatgagagagaaaggtaactatctctgaaataacccactgttggataatcttcatataggcaggggagggaactacacaaacatttttattcctctgagccacacagactcaaaaaattgatttttatttcttgacatgtgaattaatcttttcctcttctttctcttgacacaatttcattacaaggtagtatggatatttttctttttgccattttagtgggatagtagcgagccagcatatgcatgccaccaagaattttgttaaagtgattgctttgtctagttgaagtttttatagattttaaaagggctattgcattagttaagcaatacatttagcgtgttaagaatgaataataaggtctgattatttattttttttccaaaagctgttttgttactatcttggtggagtctggaatctggctgtggaatttattttgtttgcattgtcatgactgccatgatgctgtctttgcagttctaaattaaaattgcattactgctgttgcagttttgttttcagaataatctgaaaaccttcatcttatatacatggttggttttggggaaaaataattttaatacttgatcttgtaaaagttagttttgttatctcttgaaaaattgagtttcaacagtcctgcaaactatgtacttggctttgaggctgatctcttctaataaatttttttttttaaattgcattggtgtatctgttgtaaggtgacaactatttgattggttttattcattgactttatttagaaagtgtgtggcttgctgtgaagcatgatttgtaaatttagtttactgatggcaaacatgattgaagacattcaggtagaaagtcaccttaaaacagctgttgtgtgtaggctgaccaaagttatttgaaaagtgctaatgttgatgttttttaatatgataggttaagggaccatttgtatgtatatgtgcatttgttcaccaactatatcatgctggccaaaatatgatctgtagtatgaattaggttaatatggttgttagcttttttttagagaatgtggatgatgtacatttctgaaaattagttaaatttacatagccattgataggaggtatgttggtctggttttgattgttggtgaataataggtgcttctctgtagagttgtgcacaggtgtgcagtaaagcaagatactggtgtttaaatgtattgtttcttggtatcttccttttgtatgtcttatgtagttggtgaggttacatacgtggagctctttaaggatgcggaaggaaaatcaagggtaagtgctgtgggcaataatctgcttgaggtttaaaagttcctcagcagtttactttttgtataatacttgtaccagtttttggaaacttaagtttcattttgttttactttattatgcaagatttgaggctctataccagcaagtctgacacttatacaaacctagctgcctggaagggatgggttttgtaaacactccaaaggggcattcacttttccaatgctctaaggtaatacttcttcttagccaataagattttagcataggattttttttgttgtattttgatgtcttcaaggatactttaaaagtcactgaattgataatattcctgagttttttgagggctatagcttaaaggtgttagttcagaatgtatttttgaaattttactgaaaagttaaatttggtagcctgcaggactacatgagaggcagtgctctgaccaattggtatgaatgacatttacgattatattgacgtagaaggaattggttgatagtatattttgatttttagcaataagaatgcagtatactgaagaatacaatggaaaactcttagcaatgtttcattatgttagtaaaactagttgggtgcatgatgaataaaaattttgtcattacattcatatgggactttgaatggcaatcacagggaattattttttaaataactctccaaattaatttattattagtttatagatgatttttacatacttccaactgggtgctgttaaatgtgcagccagttttaatctaatagagaacttgttaaaaataaaattaatatttattcactattttgattttaatagagttgaaaaatatgtcgtagacaatacattttttgaaaatatttgtaactacagaaggataggtctattggagcctttagttatttccttgaattcctgttgatttaatttgtgcagtgacattaattttaacttaatgaaaagtcacctaaaagtgaaaaatgtgctccaagcttgttacatgttagagtctactatctttaatagatatatttaaaaatttagagaaaatttgtggttacttgcctgttatgttctggaggtataaaagatgaagtgattctaccatattattaattgccttaatgattgaaatgttagaactgattattaacttcatgtactgatctaaaactttttttcttttgcatattttgacaaatctacctggatatagggttgtgggtaagaaattttttctttaagtatcttaagtcaaattaaactttggaaaaaaattagcacataaacatttcctataaattttttccctattaagtgtggttgaattcaaagatgaagaatttgtaaagaaagccctagaaactatgaacaaatatgatcttagtggaagaccccttaatattaaagaggtaagatttctcatatttagaatttaaacatttgactataaagacatgttttccttggattttcaatttggtaatatatttgcctgactacaacttttttttaaaacataggtgttcattaaagcattatatattgacgaaagttttacttgtacatgattttatatttgctgttaagcagttatcctatatacttgattggttccaagttgttaaaaataaaagcacataatttaaaaaaatttgaggacctagaaattcaaaggggataaactttaggtgctaagtttatttggtacagacattttcaatatttagattttgttatttgagaaatataatatccttgtaattgataattaaaggtcacttaatgcaaatatgttatggatttgaataaaattgatattcactttttatcagagttacttggaaactgtactagattaaaatttaagaaaaattataactttgttagtgaaatttataactagaagttggaatcccctaaaatggaaatgtcttctttgtacaaaattgtagcagtgtaaacaggttgacaaaaaatgactagaagatacaaacaaaaaatttacagtttaaccttgagaatgattggcttgaatagcactcatcttcataggttcctttattttgtattgttaatcttaatagtttgattacagacctgttatgtacatatacttgctaaagtctgtgttaaaagagataaatagtgtaactttgggaccctgaagattttgtactaatactgatgctaatcattggttgtagagcagtactgtcacccatggcatttaatagtatactaatgatttgattcctggctttatcactttctagtgggtgtctagacatgctacttaatttctctaaactgaagtaatggtagtagtactactgataatagaggcataccttggagctattgtaggtttggttccagactactgcaataaagcaaatataacaataaactgtgtcatatgtatgttttggttttgcagtacacataaaagttacgtttatactatattctgtttaaagtgtgcaatagcattatgtctaaaagcacaatatacatgccttaatttaaaaatactttattgctgaaaatgctagtgatcatttgaactttcactgtaacctttttgctggtggagagtcttgcctcagtgctgatggctgctgactgatcagggtgatggttactaaagtttggggtggctgttgcaatttcttaaattaagaacaatgaagtttgctgtatcagttgagtcttcctttcataatagatttctctgaagcatgtgatgttgtttgatagcattttacctacggttgaacttccttcaaaattgaagtcagtcctctcaaacctgctgctgctttatcaattaaatttatataatattctaaatcctttgttgtcatttcaacagtgtacatagcatattcaccaggtgtagattccatctcaagaaatgactttctttgctcatacaagaagtaactcctaatttgtttaggttttatcatgagtttacagcaatttattcacatcttcaggatccacttctaattctagttttcttgctctttccatcacatcttcagttacatccaccattgaaatcttgaagccctcaaagtcatccattaggattagaatccacttattccaaactcctgttagtattgatattttgaccttatgaatcacagatgttcttaatgacatctagaatggtacattctttccagaaggtttttaatttactttgcccaggtctatcagaggaatcactgtctatgacagcaatagccttacaaattgtatttcttaaataatcaggcttgaaagttaaaattatttcttgattgatgggttacagagtggatattgtgttaatagacctgcaaacaacattagtcttcttgtatatcttctttagcactcttgggtgacaagtgcattgtcaatgagcagtaatatttcaaaaggattttttttttgagcaagaggtctcaacagtgggcttaaaatattcagcaaactatccttaaacaggtgtgctgtcatccaggctttgttatttcatttacagagcacagacagagtagatttagcctaattattaagggccctaggattttcagaatggtaaatgagcattggcttcaagtcaattaaggttaccagttgcattagcccctaataaaagagtcaatgtggcctttgaagctttgaagccaaacactgacttctcccttctaactctgaaagtcctagatggcatcttctttctatagaagactgtttcattacactgaaaatctattgtttagtgtagccatctcatcaatgatcttagctaggtgttctggataactttctgtagcttctacatcagcacttgctgcttcacttgcacttttatgttatagagatggcttctttctttaaatctcatgaaccagcttcaaacttttcttctgcagctttctcacctctctcagccttcatagaattgaagagagttaaggccttactctggattaggctttggcttaagggaatgatgagggtgctttgatcttctgttcaaaccactgaaactttcagaccactgaaatgttataagcacaaacaagtgaagtatcttaatagttcaagaagcatcttctgtgttgtgttatccttcttccccaaaggtaaccggtatcttaaattttgtgtttttacctgtttttgaaacagcattaaggctgtttcactttctcatcattcgtgcgttcactggagtagcactttaagtttccttcaggaacttcgatgcaagaggcccggcttttcacctgtctgaacttttgacatgccttcctcactaagcttaatcatgtctaacttttgatttaaagtgagagacttgcaactctttcttttacttgaacacttagaagccattttagggttattaactgacctaatttcaatattattgtgtcttggaatagggaggcctgaggcgacggagagagatggggagcggctggtcggtggagcagtcagaacatttattgattaagttcgctgttttatttgggcacggttgatggtgccccaaaacaattaaaacatcaaagatcactgatcacagatcaccataacagataataatgaagaaggttgagatattgcatgaattaccaaaatgtgatacggagacacaaagtgagcacatgttgggaaaatggtgctaatagacttgccggacacggggttgtcacagaccttcaatttgcaaaaagtgcaatatctgcaaagcacagtaaagtgaagcacaataaaatgaaatgtgcttttatttacctaataggatttttatgaggattaaatgagatacatggtaaagaacttatgttctggcatcagagaacctctctaactcagggcaaattacttaaactttctcctttgttttcataattactaagatgggagtaatgatagcacctacctcatagtgctatcaggactcgaagagttaatatatgtaaaccatttagtgttggctatttattatgcttgtgatattaccagtgtacaaagcactaagcacagtgctcaaaatattttagctacataataaacgttagctttagtaatgatgattgttactcctgtccaagagtcttttgttcctgagtgtgagataatagcttgaaatcaaaggccatgctaccaacatataacatgtatcccagatacctttatttgagcttgcttccaaattattctagtcctgtttgagtctggggtttattattaaaaaagttattaacaggaatgtatagaattagcagagaaaattttgactgttgtggtttgtgtcagccaattattggtggtttttatgcataagccagggccagtgcttcagaaatatattggtatcttaattttctttaaattataataatcagaatgattattttgaggattaaattaggttggtgcaaaagtaaatgcagtttttgccattaaaaaaagctttgaattaaaataatggcaaaaactgcatttacttttgcaccaacctgacaattttctgttttatgttttctgtttctcttcaaaggacatgtactacagattcttagtgtctttttcttttattggaaaaaaaagtttattggatgctaaatatcatccaataaacttccatataatattggatgctaaatatcatgttattgtgttcttttaagtttcagcacattgtagatcctcagtaatatttcagagaccctggagttatataatccaagttgaaagaggatgccgccatttttaacttttttaagagaaaaaaaaaaggctaaatttggcctagctaaatgatgagggatttattcagttgacttttttgaattaatgtcactttggcagtccctttcctgggatatctaatttatagaggggtggatggaatgaatgcttagaactgctactgaggaaagtctaaggaaggtgtatttccaatgttccttaacagactttagagttacatttttttcatttaattaaatgcagaatagtagcagttataaactgctattgtaggccctccaaaagcaatagcagtcagtaaccagcaggctgacagcaaggggaaaagaagagtaaaagtcatgttatatagtaggtggtttgttttatataaattttattttatatatgttttatgtatgtatgcatgtattgtatgtgtatatatttctgtcatatatatgtatataaaagacagatcaacacagcaatacatcttgttaatgttataagcacaaacaaccgaaatagcttactatactagttgaagaaatatcttctcttctgagttatctttcttccccataggtagccactgtcctaaatttcgtatttttacctctttttgaatcctcaggcctaaagaatttatttattaacttatatgttttgaagcattctttgatacattttttttttcttttgtaatcctttttattccttcatagtgaagaaatatgttgcaagccagaatggttttattattttaccttttcaccttttattctccagccatcctagagaatttattaaaatcacttgactttctttttattagtactgtattcccagactgaggccagcaaagtagatttgatggttacctttacacttcatcttagcctaaagatagagaagtgatgatggggtgattacctttaacataatcatttggcattgcagatgatagtctatccatgtgtttatgtggtttttgtttatttatttttgttttttagtattccacctagtgggatgagtgagaagtacatttatgtttgtgtgtgtgtgtgtgtgtgtgtgtgtgtgtgtatgtttggttttgtttaaaggtagggtgtttctcttaaaaaattaatgaacctaacaaaaaaacaatgtttaatatcatttctcacttggacatttagccctcctttatctctcctctcctccatctcagattataatcattgttgaagaaggtaagagtttagaaggtgggtaactgtattttgttcaggaataaaatttacagattacagtcggccatcctatcctctaccccagtatttgggttttataacagtctgttccagtattgaaaagctttgaattagtctgaatttggcattccattgggcatccaatagtgagaaatgaccattcctacattttggaaagaaaagttgcagtgagtacttcgctcttctttgagttacatgtatgtatgcatgtaccctagtgtgagagcaaaattaaactaatttcaagttcttaagtggctttagtgattggaaaaaaaaattaactgacatctctggaggctgaaatattttgtttatccacaggtttttatgggactcaattctctggatgagaaaaaagctcactcttcaagagggtcaataatttgagccagacaggatagctactgtagaatttaaattgttattttaattttgtagaattagtgatgtatttagtggaatttaacattcaatgtgtgttataggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatgtaagttcaagctttagtctaaaatttgtcattcagatagatagctaatttgattaaatgaatgagttataggtttatagaacattttgcttatttttaactaaagtaagtgaaatagtaattattgtaaactcaaaatcaattgacgtatatacatatatatacacacacacacacacgcacaaggttagagtttaaatacaactatttggattttttaaacatggaactgtgcagtttatacacattcaagcagttcttgaaattatatgtgttttggtttatattggtaaatggatttctttttttagtcttgatatttgtgaatatgcatgccatagttggtttgttatttgttctaagcatctgaaagtcagtgaaaacaatacttttcaaaatctggatttctcttggtaaaaatagatatgcaagtttcaaatgtacaaaacaggtttgagcagttgagagatgattttggaaattaaaaaaaataaggataaggaacaatgtagacgtagcttaaatgattttaagcaactgaagatgttttaaaatttgaacattatcaatatattgttgaactagaattatggttctttatggttttaagagtttagaaaagattttttgtatttacagatggggagatggatttattaggtatgtaactttatacaattttatattaagcttgacttcaaagttggttggaagaagctaaaggaagtgttcagcatagctggaactgtgaagcgggcagatattaaagaagacaaagatggcaagagcagaggaatgggcactgtcacttttgagcaagcaattgaagcagttcaagcaatttgtatcctgatttacatttcagcattgtttatgaggttgaagaagcataataccacctttgttttggcggggggtaattgaatttaaggttgcctggcttagagatgtgtgttagactttagtctccagcaaataaaacccttagtaggtccaagtattaaagtcactcttaaaacttgaattggccatattgtacagggctggtatgaagttttttcttttctttcttcctaccacaattaattgtatacatggatttaacaattgtgtaatctattgtatattaatgcagttactttaagcgaagccttacgagtttacttttttcaatggttgaattaaaaatacatcttattgatgaaataaaaccgtaaagcaaagaattgaatatttttttgagtatatgaaagtggctaatatcaataagtattaaagatgttaattaaaatatcagagagttggactctaagattattaaaaattagtttgtgttctgttataattttatagttatcttaactgactttccttgactgaaccaacagctatgttcaatgggcagtttttatttgatagacctatgcatgtgaaaatggtgagttcctgtatatcacttcaacctccaacctcttcagatcttttattggctctcttctacattacagttctttgtggtaatatgttaaccatattataaactttcttgcaattaggatgacaagtctgttcctcatgaagagtaccgttcacatgatggtaaaacaccacaattaccacgtaagtaaaagctattatgagaaacaacataggctttttttggtttgttttattatgtgctaagcaacactttgtttttgtgcctacatcctagtttctcacaatttgggattagtttggagttatgaagatagtttggcgctattgattaggaagactgagaagataagtgttacgtgccattttttttttctctttggtaacttttcctgactaatcagcaatacattctaaaatgtttggtaaatttatacacttgaaggaaaaaaagtcctctgtaatttcaccatctgtgggtaacctcattataacatttttgtgtattttcttctagcctgctatgtatattttttacatagttgggaacaaaaataattttgaattattttttgtttaacattagagtataagcattttttcatgttgaagattcttttcaaatatttttattggtagtataatagtctatcatatagatgttccataactatttcactgttctgtattttaggtgttttaacttttcttttgagtaaccacagagtaacacatgcctttttgttcacaaatctttgtaatgtttttgagtacttccttcagacagatattctgaagtagatttacagttctcatgggttagtattatcaaattgttttccaaaatgactataacagtgtaatatacttattgtattatgtgtctcagtgcctctgtg

SEQ ID NO: 79222 - DNA, 1232 bp, Homo sapiens
aagtacattgtgggagtggttgtctaaatgaacagtttgggaatttagtacttggaattctggatgtagtaccaatattttggaattatgtagcatcatttccttaagagttttcacatatatttttactttctcttccaaagtatttatgacttggaaatagttcagaaattatataattatggctcagtttcttaataattagatcatccctgtagcctctcaactgttatgccttttatagttttttttctttttttgttatacactgggaagaaacttaagataaattttaattctacatcatagatgagcagtttagcagtatttttaagatgcttcttatgggggaaaaatgaagaaatttactttctctgatcatctttgagtaaatattttaaagaaaatattatatataatgttactgtttttaatggaattttcagattgttgtaagcaaatatttaatctatgtaaccccacctaagtcaagaatagaacattgtaagtacttcagaactttgtgtaattttcacaattggtttaatccaggaagaaaataggcaggggaaggggtattaatctagagactatatagatatctgcttactgaatagagtcttagttactttacaaacattcactgaattcatctaagcctattatgtaaacaggccctttgggaattgaaaagaaaggtttgttcttctatctgcggtactcagaaaccagagaaaaggcctttgtgccttttggctgcttgctgccattttcaaaagtgtcactctgtttagacaggtaggtactttctagatttagacagttgagaagactcccccctaggccatgccatttctgatgaaggaatatgtttgatagtgaagatgtcctttttaaggtctaaaaaaaatggcaaagcaagtttggtccaaatgtctctttctttattctagcagtttttctggcaacatctgtgctcagatgagtatggattcttaattgactgttaattcattaaaaaattatagcacaatgttatatgcagtcaccgtgcgaggtgctgctgataccaaagcagatagtttttgttctcatagagtttacatactatatttatggctgtgttacctacaaagaagagtagtgttcaagaagctctgtatatattatgtaacaaatgactgcagttagaggtgtgtggagcattgcaatgtgtggatcaccagaattgc

SEQ ID NO: 79223 - DNA, 1925 bp, Homo sapiens
gatataggggaagtttggtatctaaacctccatcagattttctattcccttctaaagtctcttcatgatttagcaagacaggaaaagagaaaggagaaaggtggagaaagaatccttttctaatttaggaagagaaaaatataaggtgaagaaatgaagaaatattactagtaaatacagattatttccatattgcttataattcgcctctccctttctctttttcccagaagttgaatcgagtccaatttactctcagggatttctcttactgtctattccataagaagatttgtgatggtccagcatgagtcattcaaactgaataactagcgacctagtcctttttttttttttttttttttttacttcgtgaactagtaggagtggataacaaccccaatacataaaccttgagttgattaccatatacttttaataataaaaataattcattgttgattataaaaattaccataatattgccccaaattatgtattggttggaattgaacagagtactgcttgtcatcaggattgaaataatatttgctgaggttaatccatagttattgagggtgggagaccactatgtcttattcttctttgtattcttaaggcctagtaaatatttgtggaagaaatgcagaagtgaactttcatgcttatgaaactcatatacagggaatttagtttgcatattcacacctttagaaaagatccgttttccaactgtagtcttcttctttaacgccaaatggtatactagctctccttttcttaaaaatgaataggagggaaaagagcagtattattataactttattattcatgtgtaattaagtataactttggagtaggtagagattgagagttatattagggtactataaaatattaagcattggagcaaggtaatgtgttctttagctgagtgatttttattaggaataaagactagaactgtttcccccagctttattgaggtaaattgacaaaaattgtatattttgaagtgtacagtgtgatggtttggtatacaaataaattgtgaaatgattaccacaatcacgctaattaacgtatctgttacctcgcatagctaccatattttttggtgttgaaaatacttaagatctattctttaagcaaatttcaagtatacagtaaatatgttaagtatagtcactatactgtaccttagatctacagaacttactcatcttataactgaaagtttgtgcccttagaacatttccccatcccctgctgccctccacctctggtaaacacccttctactctctgcttctgagtttgacttttttaaaagtctgtgtgtaagtgagatcatgtagcatttgtctttctgagtctggcttttttcacatagcccaatgtcctctaggtttatctctgttgttgcaaatggcaagattttgttctttttgtaaggctgaataataatattccagtgtggatgtgttgtgtaaacataaaatataatatatatcatgtttcctttaatcatttatctgtcaatggacacttaagtcgttgtttccatatcttgggtattgtggatgatgcagcgaacatgggagtgcagatatctccttgagatagtgatttcattttcattggatatatacccagaagtggcattgatgaatcatgtggtagttctgtttttaattttttgtggacccttgatgctgttttccataatggctgtaccaatgtatattcccaccagcagtatctaaaggttctttctccacgtcctcagcaacagttgctatcttttgacttttcgataagtcatcctaacaggtatgaagtgatattgcagtctggttttgagttgtatttccctgatgaacagtgatattgagcaccttttcatataccttttggccgttggta

SEQ ID NO: 79224 - DNA, 1029 bp, Homo sapiens
ttccttttggtgaattgcaatcagtcatcaataactatttatggaatgtccgaagggtgcctaggcattgaaatggcaagagacttatatttgcttaattcaaaggatttctaaaggcagtctgaggacttgcaagaagtctttaaagatgcaaagtggtgtgttctttaactgcccctacctggaatgaattgaacagtctgggtgttagggctttgatgtctaatcccgctttgcaagcgaagactccactggtgccaagcgacaggcgggctggtgggcagacatggcaccaccaccgggggctttcaggactggtccagccctcccaggcaggtgtagggccgactgcagcaacagcggccctgaccccagctcccatggctcccctccccccgcactcccaccccccgcacccggcacacaccatctcccagtcacccagtctcgaccggttctcgcgagatccgggttactgagcgctcggggccttttcaaatcgggatccgttaccgcttccccggcagccgccattgtcgcgctcggagcccctcagctcaggcggccgaggcggaggcagcggcggcgggatggcggacgccaacaaggccgaggtgcccggggccactggtggcgacagcccgcacctgcagcccgcagagccgccgggcgagccgcggcgagagccgcaccccgcggaggcggagaagcagcagccgcagcacagcagcagctccaatggcgttaaaatgtattgtcttttcctccgggaaccggggcgaggtggggggcggggagtctaccgggcggctagaggccgggctgtgccccgatgggggacaaccacccccagaccccggcccgcccccgggccatcggcttcctgaggagcaggtgcagctgggccgctcccaggcccttccccgcccgccccaggcctggccgcctgtggtctgggagccggggctgggggcccggggaccagcgctcttccctgatttctagcccgagacagcgaacacccctctt

SEQ ID NO: 79225 - DNA, 1061 bp, Homo sapiens
ttagttataatttagtaattttagaatgaataataattagaattgatatgctgttaagtcaagaagtgaaaatatgaagtaatgagttcaattatctcaccaactggcctgatttaggatttgcagataaaagtgcagagattacaaaggagcaggattgtccctactagtgagcctttgttaagagactgaaaagatacttaatgcattaggcttctattgcattaacttatttagaaaggtaggcaaagacagggaaagaataagactgataggccctattattctttcaacttttatttcctatttcaacagtgtcgtgcctttagagacctctaggagtggtcattactatggaaaggtgctggctttggagagtagggtctgggttctcgctccagctcttgcattgtcctccttgacctggatattctaggctataaaaggggagtaacaatggctgctagaaactggcttgagagtcactgtgagtatttgggtgacagtgctctgaaaagcatgcagtgccttggaaaggcaagatattcactttactcagcagccacagggttgagattagcaatggagaggctttctgtttaagctcttcgtatacttattttgatcaggatgagagtttctttgcagctcagcccaaatccttgttagaaagcacagtacaaaaatagtttcctaagaaatagaaggtggagtagaggttgctggttgtctccccagtatccgtactgtgttttcctcattgtactttcagtgggaatggctccatgccattgtcagccaatcagcacaactctatgtcttcttccagagtaattggccaggtgggcacataacacaggtaaacttgaaccaataagcacccacaactatgctgaccacagtaatgtctcagtggcttaggttagtgaaacctgaaaggagccctggaccctgagctcagtaatttgggaagagacaaactttctctcctacggaacatacatgagcgagtagatagtcctggttgcaattgacagtcatcttgtttttataagtgaaat

SEQ ID NO: 79226 - DNA, 1263 bp, Homo sapiens
tcagctgtctccctcagccaggaaattcatagcctaagcttggtaaactaccaagccctgcctgacagatacaacacagttctttatctcttattttgtccacccgtttttctcctttccttctgcatattttccctaatcacacagatcattgtgagaataaaatgggttaatatatgtaaaccaattagaactgttcctggcacacagtaaaggcttaatcaatgatagctagtattattagtagtatttggccttttttctttgttctttcttcatttttttccttttcaaactatggttgtaaagcatccaccttttgaaagtttgcctttctgccctttcacgctgataagtacctcagtttccaataaacttttgttcaggggcaaacatttacaatgttgacatctcttcacaccaccaaaaatattcatggagaattattttatctaaagctgtctttttaataataaaatagccacctctaccttcttcataaacttttaagatgaattggtaattcatcatagcaaggttgattttagaaactaaagttgcattaattcattaaatacactgaaagtaattttgtatgcttggtcacaaagaaaatataaaaacaattttataaatagatttgcagttattttctttcaatattttcttagtgcctatgattacacaataccacctatggagaaagctgttgtgaaaacggacattcagatagcgctcccttctgggtgttatggaagagtgggtaagtcatttaagaaacaggtaactatttgtcaagttctcctttgtgatagattcttcatgtttcatttggggtaataagcaggcaatattgcttgggctgtgtcctaaaagaagcaccatttgtgatagcaaatgcactctttgaaaggctttatttacatctctgctttgcctctttttgacccttttatttttctccttcctcactggagcttttaggctcacactggcctagaaggctgttctcagaacatggcattttatattatgagagtaaaacttctgacctgttggtcccagaatgtgtaagcctacttaaccttttcttgtttggccatggggttagggtaagggatactcttcagtgttgtagaggcactgggaggagctaggacaaaatggagtacacgtcaacaggtttgatttttctggagcggatcagttgttaccagacagttctttgcaagagcgtaagttctttttgactaacttcagagt

SEQ ID NO: 79227 - DNA, 1256 bp, Homo sapiens
attaattataggcctgatgcttgagtctgcaataataaggtgtaaccttagctttttatttttttcattttttaggattaaaaagtatactagcattgaatcattgagacttagtttttggcatttttacttaactgatattagcccatttatcttactctggttcatgtgtttcctacaggcatgtcttttggcatctgaatcatgaatagtggggtcccaagttgtaggctatggtctgctactatttggttaggtttgtttccctctcccttcctcttcctttcccttcccatctgcattgtacatgttgtggtgtcccatcttaaaaccaaagtcttcttcctcagtagtgtgttcctgctggccatacttctctttcttcccctttgaggcttaacttcttgaaagagcagcctacagttgttcccgcttgctcacctttcagctcattctagcagtccttctcccctgtctgcagcaccacaaattctgactgaagtcacatgggagtggtttaagttagttttgaattaaaaccttgtggaatttttctaaactagtctttccaactttggtaatgcagtatgatgaatatatattctttaattcaaaaccatgtgctaaagttaagatgaagatatagatattataggtgaagagaatgacatgcttaaattgcatcagttatctctgatatagcccttcccccttaaaataaccaatgtctccttttttgttttttagctccacggtcaggcttggctgcaaaacactttattgatgtaggaggtaatatatttccttttttattctgtaaatgtttgcaagtatttactttgtctttaaaaggtaatattcaaatgacagattttatttttaagaaaagaaaatgattagaggaaagcttgttataataggaggaaaagctttgtggttattttaagtaattatattttgtttaactactaacttaatttttaaaataatgattacctaattaataatgacagatttaatgatataataattaagtaattatttaagcaacaaaagttctagaaaacacaggtctatcttgtaagaattttcttcataagagagctatctgtctttagcaaaatttaagaagaaaatctttccctgaagtcaggagagaaaacacttttctctaaatttgttaagacagtcctctgtgttacctgtttcccttataataaagcctttctcatgtttgtctcaaagttaaccctacc

SEQ ID NO: 79228 - DNA, 1147 bp, Homo sapiens
catggatatgtggtaaaaactggagtctctgtgtgattccagcctccttgttctttccactgcaattaattgtggagattaccctgctgcatccccctcaccaactaaacacgtccagaattagctcacttttatgtgccactgcaagggctaactaagcacttaatgaaacctggctatcctagacctgccccttagtctaacatttggtgggtgtggtgtctctccatagtgtcaccaggtggtgctgtgggacaagacaggaccccaaaagtacaccctttagggactaaaggggagctgagttttacatagcagggtggacattgacagcccactcttgggttgaggattccttgggctctgtaagttatgcccgatgttcaaaaatgcttttacaaggtcaactgtggtcattttgggacagtaacttaaggatataaataattgtatatattttcaatgaagtttcaaatgattgttcaaggaacgggagctttggaataacaactggatgtaggtcccagctctgtcattaactagttattacttaacctttctgagcctgtttcctcattttacaatggaaattagtgtgcctgcctctagaggtaggaggattaaatgataatgtgtatgaaatacctaatatagtacttggcacatattagattctgtgagatataatttctgtccttagggacttcacagattgtttttatgtggaaactttttcttttattcgactttgttactaatttttgctctgtttaaaacaactttctggaaaaaaattcatgtaaaagaatggaaagttagtttgcctagtggttggtatggtgttattcataaaatcacattgtggtgtgttcttggatgcagagaatcttaacaatctcccttaggcacaagtttatcatagttggcaacagtttttatttctgaagagagatgttgttagaaatcccaggctctaaataagggtcaaagggaaaagttgagcattcaggattctgttcagaattcacatctggtaggtgtggatagtttttcactaaaaaaggtttccaacaaatgacatgccaaactcttgacacagtaaaacttttgcctgaagtcagttaatcactctgccagttccaatgca

SEQ ID NO: 79229 - DNA, 1243 bp, Homo sapiens
tctctgaggagaaatatccctgatacttatatcctgtaggcagagaaggcttttcttggaggtcgaatggcaattgggtggtaaatgaatttggaactactgaaatttttataccgtcaacattcatgcaaaaaaaaaaactattgagggcctttttttctgccatacatttgaattgacttcaaacttcttaatttcttttagtcacttaaaggtttttcacattttcgtggcccaagcataaagatcacctatctgcaggattcaagacacccaatcatttgagtagttctgataggactgctttacagatacgttagcagaggcctttcaaaaagggagtgtttttgtatgttagaagatactataaagccaacaagcaaatatttgcaacttatatgaaaaagaacaaatgagaaaaaaacatacacaaaatatagacaaggacatgcaaatgtccaacaaatgggaggaaaaaaatccagcctcactagtcatcagggaatgaaaagtaaggcaatgagatagccattttgtactcatcatattggccagaatgtaagagattgttgccatcaaatattggcaaggattttggaaatgggcattctcaaatattgctgatggaagtttgagtggctacaccttttttgcaacctatttgatgaaaataaaaagcattcatatacaaggatatacttaaagggctgcttcatttattatagcaaaatgtaaaagcagcctgtgtctgatattatgcaagagaatagttacatagaaacaatggtacaggttgggcgttgtggctcatgcctgtaatcccagcactttgggaggctgagacaggcagattgcttgagcccaggagtttgaggcttatttgagcaacatagggatactttctctctacaagaaatacaaaaattagccaggtgtggtggtgcctttgtacctggaggctgaggtgggagaatcacttgaggttgaggctatagtgagttgtgatcataccactatactcctgcctgggctataagagtgagaccctgccaaaaaaagaaagagaaggagagagagaacccatatttccatatcttgtatctaaaaagaatggctaacatttacatatattaatctcaaaggataaaaagaaaaaaataaagtagtatgtaagatatatttctgtaacattagctatctcagggagggtaagagaatattataagcttttactttatatgta

SEQ ID NO: 79230 - DNA, 2397 bp, Homo sapiens
gtaagtataactctctgggctatgtcagggacctggctcaagtctcccctgcaaagatcttctccccctgtgttcataatcttaaacaagtattaattacacaaaaaaagttgtactcatgaagcctatgtgctacagtcttctgagaaaccatgctctaagaaaggatggtggttcagattaaaaggagaggaagattatgaactgaaaaatacagcttcatttttagtgtaaaaatggaatattctaatatttgcaagactgctgcttaacaatgtcagcgttgatttactccactgcagagctttaggctttttgacatttttatttatgactcaatcgtatttcaatctgggtattagcgggaagctgataccaggaaaaacctttaaaacccaaatcgtaattttctcctagtctttttggcaagtgtgccgtgggtagacagtaggttggagatggccattgctactgccagcttaaaataggaaatggtcgccatttgataaagagtgacaggttggaaaattaggacctgttttctaaatttttatttgtattttagtaatgtcatttcttggttttgaggctttacatagtaccagggcaagattcacttattcaattgtaagaatacaaatctcagagctacatgataatgattttgagataatcttacacctctagtattccaatagcaaaaattgagataatattacttttcttttctctagctggtgtcatagatgaagattatagaggaaatgttggtgttgtactgtttaattttggcaaagaaaagtttgaaggtatgttaaatatatacattcacataattttagtgaattttcagagtcatgtatgtgtaaattaatattgactcctttaattctcattgaataagacaggatatggcgaatgtgtcagtaacgtcagtaataaactattctttctttgaagtcaaaaaaggtgatcgaattgcacagctcatttgcgaacggattttttatccagaaatagaagaagttcaagtaagtattacaaaggaagatacagaataagtaatataacatcttaagtgaagaaatatatataatcttgagaatttaatatgctgtttgtaactaaatagtatatatgactaaacttattttaagcaaatttaaaatactagttttagaatttctttaaatgtttttcatgtagctattatgtagtattactttggataataagttatttaaacatactgtgaacttctaatattttattagaattttttaaagttatccagtattctaatttatggagctttttagaatttaattttctttctgtaatctcccttttgaaaagatgatatagcaagagtagaattctggctgtatttttcttaggagctggagaggaaaactgaaagaggctcttaaaaaaaactgtgaagcttactacctttctatctttcaggccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggtattccttgttcttcccttctcttcactagtctaaaaacttctttttaatcttaagattctttgtgatgagggtgagaaaaagaatcctcagtttatttttccactattaatctttcttttgataaatcctctattgactgggtagaggtatgtttgtgaaagacatgtaacttggggatttgttactttaggtttgttcccttgaatttcatctcatcaggcaaattgtactagttgtagttacgagttttccctcagtgaagtagcaataggctgtaatcaagaaaatatgccatttatagagataagataaatgaaataatacttcagccaccaggtttttctgtctcacatacataagcagcatttcattgcagatatgggac

SEQ ID NO: 79231 - DNA, 1266 bp, Homo sapiens
agtgctgggattacaggcgtgagccaccgcgcccagccagagtatcatcttttaaactgctttgttctaatataattatctgtgtccaaattttagaattgattttcataacttaaattagaatacaaataataaaaggaagagagctaacattttttaagtgctatatacaccaggtgctattctagttgtgttccttttacctgaatgaggtattgtaaacctaggggcagaatttactcttagggtgaaaactggtctctttatttttagggagtcagcaagccattctgatgggctactcaaatgttagagtaggatctcagagctcaagggcttgtttgggcaggctgagaaggagaggcagagagatgtgagggactcaggagttggtggcaggggtggttagcagggggcaggaacgccaaaatatggtaggaggctaatcagagaaaggaccagtgagaaatttcctgcatcaaggagtgccaagacacttcttctaaatttatattatggaaatttctagcatatacaaaagcagaatgagaagtataatgaaccccgtgtaatcatcactcagctttaacaatgatcctctcatagctgattttgtttcttccgtatccctacctacttgcccactcccaacccccagtgaattattttgaaacaaatcccagacattgtatcacttcacagattacattttaatctgttttccgagctatctgtacggtagctcccctcttattacccaaacttcagtcaaatccactcctttagtgtcagtgggactttagagggggactaaaagcaaaagagtttgcatctgggccaaaatgggtgaagaaaaagtagtgagaagcctgatgcgcagccgagattaagaataagcagagctcctgagaatccttgaaaagattggaggtgaagggatgctagttcttccatagaagtcagatgggagttttatatagtagtgtgtgtgtctgtgtgtgtgtgtgtgtgtgtgtgtgtgtgtgtgctgttattaaaatgaagagtgactctggaagactggaagacttggggacagccagacagctggcctttgggttacagttgcattttccaagtttcctttccttgcaaggaaagaaaatactaaatttaaacaccatctttcaatttctcagtcaataatttccttttctgtctctttcacaaatgcagtttcaagacatcaatgcaaggcatttattttctacggcgcctttcagaaac

SEQ ID NO: 79232 - DNA, 1039 bp, Homo sapiens
gttctcaaactttagcatgcatctgaatcacctactaggtcttgttaaaattgattgttgggagacatcccagggtttctgattcagtagttctggggtgatgccgagaatttgcatttctaacagattcccaggtgatgctgatgcagcttgttcagggactacattttgagacctccagatacaaatgatttcaacctgcctttcttcctgacatcagttaatattttcaaatattacaaatatgtgccaatttaatacacttgtggtctaaacaaaatgctttcaatattgtgtatgcagcataaggcagaaaattgtattagtgtgaaatttgagtcattttttctttaatatgagagctaagtggcatatgtacattgtatttaacatattgccatgtgtctttccaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttg

SEQ ID NO: 79233 - DNA, 1051 bp, Homo sapiens
gtcattgccactgccactgagcaagtcgaatttcacggctataaacctgagataataagacatgcacactccctttttgcaagaacagaatgagaattaaacattacagatcaggctgggcttggtggctcacacctttaatctcagcactttgggatgccgaggtgggcagattgcttgaggtcaagagttcaagaccagcctggccaacatggcgaaaccctgtctctactaaaaatacaaaaattacctgagcgtggtgatgtgcacccataattccagctactcaggaggctgaggcatgagattcacttgaacctgagaggcagagtttgcatgagctgaaatcgcgccacagcactgcagtctggatgtcaaagtgagactctgtctcaaaacaacaacaacaacaaaattacagtttaaaatcctctgatagaataaaaggtattatctcaattcatcatgttttggacacattcctggtttcttgcagatactgatgaatgttctgttggcaatccttgtggaaatggaacctgcaagaatgtgattggaggttttgaatgcacctgcgaggagggatttgagcccggtccaatgatgacatgtgaaggtacatctcttaaacagagaacagttgattacgtgtactgatcctgggaacaattggttgattacaagtcttaatattaaatacaactcagggtgtatataataaagatcatctaggcctgatgggccatttgatcattcttcttttgtggcctcttctctgtagggaaagagagatatccaagaatgatacagttgtgtgttcatggcacatctacactgtatatcacagagagttctcattggtgtttccctaccacttatatttagatgcttccgtgttgtttaataccttctttcttactctcactttctccttctttctgtctctcatactccctttctttttcttttctctttttctcttcttttctatttctaggagcactgcacactaagatacccaccatcatcctgtagccatttggaggcaatc

SEQ ID NO: 79234 - DNA, 1050 bp, Homo sapiens
ttactttgtactttataatcatacctggagacaatttgaattattataaggaagaaacacccattctggaactaacacatttcaaagttggaccatactttctaaatatttatttagttccttaaatcaataaggttaatccttttaattcgacaaaatgaattaaattatataaatttaattatataatgtaactctataaagattaatgatttccagcaaatctgtattttcttcctgctaaagaaataagtgaattaaatagcctagtgactttaggctttgtagatatttagtttagatacttagtttaaaaccaggtcaagcctctgttttcctaaaatgagatagtttaggtaaaagctaatgctacaggagttttgcctttttgcttgaattgatcacgtcgttatgactttaaagatctaatgtaaaagagcaaagtagatacaggcaaagtttgggccctttttaagtgtttattttcattgactttgcagatattaatgaatgtgtactgaacagtctcctttgtgacaatggacaatgtagaaatactcctggaagttttgtctgtacctgccccaagggatttatctacaaacctgatctaaaaacatgtgaaggtaaaccatatttttgttcttatactgtgtactttgctatcttttggaatgccattagaaaaccataagactgaattagagtctcctgtattttagacagttatgccagtttagttgaaattctgtggttctacatggcactagtatgtactttgtaagccacttatggtatttacttgtaattggcattttaattgccatcatttaatagataaagaaaatgttatgtgtctgctatttgagctattcattcagaaatcacatacacatttactccagattttctaaataaaaagattcagccaagtcccgtattctatactatagagatgtactagtctatactatagagttattattttggcattccatctagtgtaggaaaaactatttagcccagctttactgtgtgggattaaggata

SEQ ID NO: 79235 - DNA, 1050 bp, Homo sapiens
aaggctttagttgtatatcctttaattttaggcgaattttcccagagagccaagacatgggtgatactagaagtgatgccagtctgggtgatgaataccaaaaggaaagtcttcctgtagtttactattaccctagatttctgagagccctggaagagctaccctggttatacatttcacaaaaccctttgtcttttagcagccattgttctccttcctctgattctgtttttgcctttgtgattattttggatacaaaaatctcttgggagaatatattaaagttactttttatggaaaataagttccaacagttgatttctcttgattttgttactgttctttcaaaggaaaatgagaatgccatttgagcttttgttgctgatgctgcatattatttcctatcttccccattttcaagggttaaaacataattgtcaacatgttataattttagataaatgtcacttcatttttaataagtgcctttctctgccacagacattaacgagtgtgaaacccctgggatctgcatgaatgggcgttgcgtcaacactgatggctcctacagatgtgaatgcttccctggactggctgtgggtctggatggccgtgtgtgtgttggtaagaaaacatcatggctaaccttatgagagaggttcagcctctgtcactcaataaagcccaatggtaacaaacgctctctactgtagcagataagatataaagaatatttgcagagcaacaaaccaacagggtcagttctctttttgtgtaaattgaacattaatttgaggattagaaagatgagctaagtgaaaagcaagggaatccccacctatccttcccccttttcttccctaatcccgtagctgtcttcagttttctccaggcctcctttgttgatattggtcattgaaattgatgtgcatatgctattatctcatgatgaacattttaatagagaattgatgtccatgggcagtatagaatgcaaaggagaatatggataatccagaaacctgtatgatagtagttttatgaggcttt

SEQ ID NO: 79236 - DNA, 1051 bp, Homo sapiens
atgtagcctaaatacatttcaaattccactaatcttagttttgacttatgttcatattcagagcattagaagtaatatgaatctgtgaaataaatatacccactaggctattagcacatttttcagtttgtaaactattattcctaaaaaggatcctgataacttctatggagtcaaattttataaatagatatacctatacatctagccctagagtttgcatgcacatgccaaaactcaagaacttgagatatgtatttcatatgtcccatcttctccttccttagatgatcttatttggatgaaagttagccttaggctgtaataacaaaaagaaagaaatacgaagaaacagaattattttcatccagattggtttccttcgtaagcttactcttctggtcataagaaaatgtatgttttgtattttcagatatggatgaatgcagcataaggaacatgtgccttaatggaatgtgtatcaatgaagatggcagttttaaatgtatttgcaaacctggattccagctggcatcagatggacgttattgcaaaggttcgtgctataaaaccctagatcatgttcttcacgtgccttttctcctccttatgttgtttagaggtactacctttctttactgattctccccacttaaagtaccttgaattttggtttgggaaacctgactgaaactccttcttaaatccagccatccaaagagctacagtttatgcccagaagactattgttatttcagaaagggtatttgaggtcttctcaaaggagtcaaaagctatgtagcaaataaataatccaaactgcctattggtcttccaacagatgtgggcattgttctcaagaagctgagttctacctcttctttccagttagggaataatggtggttaggcttcttggtggctgttatttgccacctcttacatctttacctggacagaatagtgtagactgttatttgcaatgatctcttcctcataatttcctctaggcatcttaagacacagaaattttttttaaggataatttattt

SEQ ID NO: 79237 - DNA, 1049 bp, Homo sapiens
cagcagtaaccctgcacgtaaaccagaattggtataaggaagatggacattttagagatgtgattgacggttttcaggcagaattaaggtgattgtttaaaaaaatagcatatgttgtattgttctgagatagctataaaatatgtcttttaaaattatatgtttaaagatgccagccaaatttcagtataaatagtgatttatactggttaaatagatgtgcttggaaaatggtgaagaagaatctattttgtttacagacttcggatttaaggagtcttattagaaattagagttacatctaatgccattatacaggttttttatcatgtcttttcaactctgataaccctaaatatcacattatttgataaccaatttatgttggagaatattattaagtaattaaaaccaaaagccaagatcatgagtttgcaaatggagggagggggaaataaaataattttaactcccctaaataaagctatttcttctttttaaactttgattttagacattgatgagtgtttacagaatggccggatctgcaataatggacgctgcatcaacacagatggcagttttcattgcgtgtgtaatgcgggctttcatgttacacgagatgggaagaactgtgaaggtaataatagtatactaatgttagtcctctccttccattgcagtttcaatatcaggggtctttaacaagaccaaataatgagtgaaatgtcaaagtatcaaatatgttttatatattttatctcaaaaggaagcctaattttccatgatattcatttcttaatttacatttgtgtgaatcaaataacattttaatatgctaggagagcttgccatttaaagatccctggtgtgatgaaacttctgtggcacaatttcatactttctaattttttacaatcagaatttgtacattttttaaaaataggacacacctaagtctgtgtattatctagccgtttataatctttttgtttaaagtgtctgcctagtaataaaatgctactaatcagtatctgaaatatatatct

SEQ ID NO: 79238 - DNA, 1087 bp, Homo sapiens
gtccaacaatagtgtaacagcattctcagggctacatctctcatcaagatcagaagagaaaactttttccttcatcctcaactcaccccaccttgaggtttcacttagatggatgcatttttattgaaaacagatgctgttatatttatgcccctagactctaacagtgagtacattctaagttatttgtctgggctggataattaaccttgtcagttgccactgtatatcagatgagcaaaagacagctttaaatttaaggtgcaattcataagttacatgtaagacatttaatatctacttgccctgaaactgaataatctaactctgatagaactatctttatgagttggaattgtttttaggttataaatcatcattgaatttataattgatactgcattcttgaacatgttatacatagttattcggggtagttgtgaaaaaatagttctttctaaagacttcttaaaaaaacattttaagtttcaaagaacaataaagttgactcttgataggccaatgtattttagaagttgtactgtagatctaaatttgaagcagagaatgttggcactgaaaggggcaaagaactcagctatttccacactctacattatatattaaggaatggtgtcttgggtgtattaagtaccctgtctgaggccattcagacaagactgctcaaatttacctctttaactcacactctggtgcttgctgagccatattacattgtcctctttcctagatgaaagttattattctggaatagattttcgggccatatacacacacacacacacatacacatatatatatacacacacacacacatatacacacacacatatctttatatagacacacatatatctatatacacacacacatatatatatgacattaacttaacaagccattaaagtttatcacatgcaaaacctacatcaacgataggttgtgttttatcttttaggctttctcagtttaatatattcagcttcagaatatataatcagcttcaagattgaggggagtatagtccttatgacttgtccagtctgtgttttgttttctgaaatta

SEQ ID NO: 79239 - DNA, 1049 bp, Homo sapiens
tacgaagacaaccgaggaatacttacaaagccaacacataccaagttatgcaaattacaaatataccagatctcatatcacatagcacaaactctgcacctaactaccaaggggatggggaatcccaaacctcagagaataacatttgactctctcatcctctcctaaatgatactagcaactgctctttgagcacccagtaaggcaagcatttgttacgtattatcacatttaatccttaccacatcctctgaggcaggtattattatcccaattttataggataaggaaacaagacttagagattaagtgatttgaataaggcttgtaggtggtaaagcccatcaccaaccagggtccttattattattgttatttttattgctatctcctacaggaaagttaggatcctttattgatttaaggtgtgtgcgctttgtctcatgcctggctcgtcttcttgtctaagagtacacgtagcgtggtttcagataagggtatgttgaagagaaaacttaacgtacctctgccaatacccagggtgagcctgatttcatgcagtagcaatttgagtcgcctttagtgggcccatgagtaaaggaggcccatgaattctgccttcttgcctcaaaactctttattatgtgagcctggcttctcctgtgtagcatctgttacttcgttttgccttccacatgtactaagtagaaatagacaaacttaactcttgcagataatagatgactgaaaacagatgatgggcacacaaaacaggctttgtctccataggattttgttggtaaaatacttcgtctttcacttcaatatattttgttcattgttttgctgctgcttagatatgaaaactttcctctatcgtcctaatcttctgatatgccatcatctctttcaacctcttttccgatgccagagtgaatccagtctgcccttgaatactgtagaaacctcttggcagttgttaacaagccttagcatttactcagtcattctgggaagagaggggaatttacactgtttccttagttcac

SEQ ID NO: 79240 - DNA, 1046 bp, Homo sapiens
ttggctcttgtctgccccactatacaagtgcatgcagttttagtctctgttttggtgggtagtttcctacccctctggctcgctatacttgattatgaaattataattggctttcgtttatctctttaggatagaatagtaactgtagctaatctgtggctgaaaatagggagataagaatgaaaataattaaaatggatcactctgggtagcctgaagtgacatggattaatgtactatcagttttttccccctgagaaacatttggtcacaaggaagtttggctttcagaagaaattcagatttgggtgtgtggcttttggcatagtctagcatcactggaatggcctaaagtagatgtttctttttttcccatgccttcctgtgggtgctcagaacaacccggtcttttgactgtagggttatctgccattcgtagactgagcattatcttgccaagtcatatggagaagccagttaccgagtgcacttggagcagaagataatacttggctgaagcatcctagaaagcctaaaaagcttatgtcagagggatataacgtagagtttctaaggagaggtggagaaagagactgattgatcgattgcttgatctccaaagggcaggggctctaccacgtgtttcatagtgctaggaaatggcaaactttaaaaaggtgttcttcagttgccccaagaaatacaaatgtcacgcttgtctgactgtcagggatgaatggtcctagtgcatgcatgatgactgtatattcttctttgatagcgccatggtgtgggtaggtatgaggatctgttggcttagaagcaattggaaaaactggacaaggaaggaaaagaaaatgaaactaagaggctggattgagaaataccaagaagggtggaaatttcaagctttttttaacttcagtaactgtaagagagaaagaaagagaatgaaacagaaatgtctgactgtgtcccttcaatttcaaaacatattttgtagctctccactgactctggtttattcattatttatttaatagact

SEQ ID NO: 79241 - DNA, 1605 bp, Homo sapiens
cagcctgggtgacagagcgagactccatctcaaaaaacaaagcaaaacaaaataaatttacaataaaattggctcccaagagtaataatgtaatttttatatcattaaatcttagagttaatataataatatatttcttgtgatcatataaatatgtttagatgcaggatttaatttgtttgtttggttttctcttcatagcctgtcctgggcttctgatggattgagtgctgtggactaagcaaagagaggttgagaaccaccgtgactggataaaggagttgtggattttaaagccagagtttatttagttcaatagacttgttttgaaaatgagtacacctgaggcttaaggtcatataagtcatgatagcaaagtttgtgagggacctgagaacccaggtttcctcatttgaggattggtcccctataacaaatcgtgttccaaatccatgtgctaacagacctctggtttattcacagccatttgccggcattcctgtggggatggattttgttcgaggccaaatatgtgcacttgcccatctggtcagatagctccttcctgtggctccagatccagtaagtctaacatgtcattatatataatattattttatgtggttataccccattttctcctaaatttgattttggctttcctctttcctgcaatacattttttcactagaacatctgccttctctgttctgcccaaaatacttggaaaggctttccttcatctggcctctcatttcccttctttactctttataggaaaattacctatggggcatagttactatgaatagtataaagcttatggccttttatgtaggtatcgccttattcatctttgtatctccagtgtaaacaccataaaaggtgctcaatgaaatggttgtttaatggacatttttggctcaagaaatctaggcatgcttccttgtggtactgaaatatgaatctgattaaaaacttatttaagactcaagacccctgctttacaagaagaaaatgtaagaagtcattatggaagtttctgggggtgatttataatgaagcataaacatatttttcctttcagaatgttgccactttctgtgatgccagatgaatatccacagttcattcttcagaaccttttcttgcttgttctgttgtttttcttttgggggtttgggcaagtgagtcataattggttgtttaaaaagctgaagttcttgtttgtataaacagcccctcaaaactttgaccgtccccatggcaaaaaacgtaggtcccttttccgtttctttttgtcctgtaagaaaatgcaccccccttattgtgtgtcctattttgacaaagttttaaagaaaaacattgtggaataagtgcattctcttttgtttactgcaagtagagacttcactgtgtcaaggctcattacctgttaagagtctgaacatttgagtgtgtctctcacaagccaattaacaggttagggcaaattgtcctgtgtagcactcctggtgccctcttgcctcccttggcttcatggatgaacacgggggactcttcctgagagctttgtatacttttctggccagagagcatgccagg

SEQ ID NO: 79242 - DNA, 1151 bp, Homo sapiens
taggacagattttagaaatgtataaatactgaaactgaggcccagagaaggtccaggaacaagtgctcaaggtgcttattttcctctccggttcgtaggtgtggaagctgagtcacgtggtagcgagagctgacctaagaggcgcgttgttgggtaatagattgggcctctttgtgttcacaccctcaagaggtggactggtatctgcaagttctctgctatacttgaaataaccaaaccttatcaatcctgtgggcatgggtgttttctttctctcatttatttgatcttaggcagtgtgattactctctcagcggtcagccctgaaggggtgatactgtagcagagttttagatcctcagtactaccctgctctcagtgggaacctccacattagaaaggattgggtgggatgggactttttgagggaggtagttgtcaatgagggtatcagtcaggtggttggaaaaagagaaatagtcttctccgggaatcggaagcatgactcctccccgcaaccctccaccacacacatactcacacttctaattggcagtcaaagagtcaaatgacctgggatcaactaaggcagttctgggtctgtgattaagcttggtttcttgttgtgtaacttgctggctcagttatccaaactatacattaagagtttatgtaataaacatgctaaagaaagaaaaaaattcttaaattcttgtgttttcctccatatcatctcacctagtaatactgtaaaacatctgcctactccaagtgacaactatgttatgagcattagctgcgtttgaataggacccaatgcttcattttcagaatgaacaccctgtcttgggcttgttgatattattatctttttttccaatgattctaggcagaactgccatttggaatatctttctctccctttctgatggggttaatgtctgaggagatgtaggcaaatgcttttcagtgaaggacttgatgtgcagcctttaagtagacaaatagttttttaatctttcatggactgctggtgcttcacaccccagagttgaggccactgacctcaagtttgcaaattttatatcccattaccaccctgtgagctctgtgctccccagggtcacatagtcggtgttttagctggaatc

SEQ ID NO: 79243 - DNA, 1016 bp, Homo sapiens
gatacagaggaaagtaatatgatttgtcaaacaatgaaatgtcagcgttatcaaactccatacctgtcagaagaaaccacgtatttggagccaggaaagatcagtgtgaattgtggacacccatctcgtcataaggctgatagattaaagtcagatttcaaaaaactgagcagtacattaccatcttcagtgtgtcagcagccttcaagaaaattaattgttccgctatctagccaacaagatagtggctttgatagcccatttgttaatctagactaattatggtacagtatttaagaagaatcattaatatattaacaaaaatggaagggaagacctcatactgaaaaaaattgtgagccctgcctcttttgagatgttttaataacatctgttatataagtaaagcattcttctaaaattgcttgagatatttatgttgccttaatattccaaaggcctgatggtgtatgtataatctgcttttgtgtggtgcttatttttggtttctaaaccatctatttttatacttataaattgactcactctgcagtgttaacttatttaaataaacttgcatatggtctgtagaattgttatgaattattttgtggttcagaatacagaaatgtcatattggcatcatgtttgaaattcacccagaaaaaaacataaattttgattatttgtatgtgttagtcagatttagtttttgaaattagtcatgtttaatgaggctatgaacttaatctacatagacttttcctagcaatatctactcaaaattttgatctttttttcagttagaggttttccagggtttactacaaaatacatagctatgtcctggttttattatttaaatattagtctgaatttttttagttcttacttgcattatttcagatcatctgtgacatccaaaaactttgtctcttttatggcttcacatttgttttttcatctgaaatacgaccttttgaaaaattgagataagttttgtcatgtagcaaaaa

SEQ ID NO: 79244 - DNA, 1715 bp, Homo sapiens
taagttattaaaagaccacaactttcaaatagggtttttaaaaatgtggaaatttgctatttttacaagaagaacatctaaaattaaaaatcaggggatggagaatgatataccaagcaaatgcagtgttgatattagataaattatagaggtaaataaaagattagataaattagagttagcattaaaagggacaaagctgatagttcataatgataatggaatagtctcccaagaaactgtaattgttttctttctgtagatcatacagctttatataaagcaagagctgatagaaatacatgaaaaagactggtaaattcccaatcacactgagagatttttaacatatcagtggggaaatggggttcttgaacctctggaaaacttgaagctgagattgttcaggggtccatgagtctgatgttggtaaacattcctcatgtacaagccaaagattatttgtataaattttggaatggtgatgtgaaccttaggtatgaaaaggcagtaacatataacaagaaaataattttctagatctggggcaacagtgtgcaaataatgtccccagtagagaagcaaatccttttcatggactctagggcttgctactctgagatacaatgcctctaatttcatgctatgtggctgctttgtctttgatcagatttagtgtcttaggtaattaaatcagaaagtctatttagctattctagaagtgtatgtgtaggtattgggtgggtggggttctttgagcgaacttgtcagaaactccattcttaacatcagaatcagggcaggattgaaaacattgtggctggatcttgaaattgctataacatctattgcagaaaatgataggtcagatggatagcaataataattatatatcagatcttagtaacaaaattaccaagctttatctagtggatatatgtaaaagaatatttttaaatgtccagcattgatgtattttctttaagaattattacagtatataagcattctttgggaatacagtataaaaacataaattttttcttatttttaattttttttatttttttgttcaaggatgaatcttccctttaaatattaattttctcttaatttcgtgtttccttgcacataatagcactgcccctaacttcagagatgctgattgcagttaaaaaatcaaaaagaaatgatgtgaatcagaaaataccatgttgtattgaaagcaaatcaaatagtgtaaacaccatcaccagaactctgtgcgaacaagctcccaagaggagggcagcttgtaacttacaaaggctgttagagaactcagagcatcagagcataaagcatgtgggatccaaagagacacatttggaattccagtttggggatggtagttgcaagcacctaaacagtttgccaaggaatgtttctcctgagtttgttccttgtgaaggtgaaggaggctttggtttgcacaagaagaaagacctactcagtgataatggttctgaatcacttccgcattcagctgcatacccctttcttggaaccttaggaaataaaccctcacctagatgtacccctggtccttctgaatcaggatgcatgcatataacctttcgcgattctaatgaaagacttggtttaaaagtatataaatgcaatccactaatggaaagtgaaaatgctgcatctgagaaaagtcaaggtttggatgt

SEQ ID NO: 79245 - DNA, 1044 bp, Homo sapiens
caataaataatggaacgtaaattttcagagcactagagaagaatgagtctctccagctcatactgcctccttttcttctgtctttgtgtttgctttttcctttctttctgcttaaccttttctctatattttatttttctcttttcctaactggacataatgtacaattgaaatactaagtttctgtacctcatatttacagtattttcttcgctaagtgttttagaatatgacaaaatttagctggggaatatgccatgtttccttactatatgtagctgtcatcattccgaaagaacttatagagtacttctcatttgagtctaccaaaatgatgatctaaaatattccattttaatgactgtggaaagtataatgtttaaactatacttaaaatcacttcatctaccagaaaattgatctgaagtctgcccctcctgtttctgaaaaagtgctaataaacatacattctgtgggcattttctcacttccctataggtgacatgcttcgttatattcaggagagtaaggaacgagctgcagaaatggtaaaagcagaggtactgcgagaacgtcaagaaaccgcccgaaagatgcgcaaatattatttgatttgcctccaacagattttgcaggatgatggaaaagaagggtgagttcagtctgaacaatgtgtcctgagattaccaggacaacatgttatcatttttaaagcattttccttaaccactaaattaactatttctacatgatcagccatagggggttaagagaggtttatggctgtgctaccctaaatgttggcagagccaataggaaaacagaaaccatggggctaaggcaactcattttttcctttaaactatatttttaatattctggaattccccacagggctgagaaaaagattatgaatgctgctagcaaacttgctacaatggcaaaattactggaaacacctatttctagtaagtcccaaagcaaaactacacagtcaggtatgtcaaagtgagtcgccaaatggtttttctatcttttcttctt

SEQ ID NO: 79246 - DNA, 1044 bp, Homo sapiens
tctgtaagttaacatgtgaagaaaagttcagaaaggttaatttttcctaggcttatcaaccttgtaagcagcaaagttagaatgtaaactgatgtctctgactctgaaattcatgtgttttccttcataccacatggactcttatcagtttcctcatcctctttttaaaagttcaaagaattgtaatctccccacccttaagaaggttctttgtaactctccccacccttgagaatgtactttgtgagatccaccccctgcccccaaaacattgctcttaactccaccgcctatcccaaaacctgtaagaactaatgataatcccatcaccctttgctgactctcttttcggactcagcccgcctgcacacaggtgaaataaacagccttgttgctcacacacacacacacacacacaaagttcaaagaattgaaaatcttacattatttctgaaaaagacacctacttaaggttaactttctttttgttttatatcgaggtgcatgttcaatgatcgtttatatgagcataaactgtctaccaggatccatagggaacatggaattagaaaacctagtaggtttctacagagcttcagcacagttggaaaacaaaacacaggcatctgaaacagttgaaacccaattccaggacagtgtgtaacccaaagcaagaagaagatgggatacagattttaagtgctgagaaaacagagcaagggaatggtctgagtagggtttctaaggggatgaacgttacagaaaagcgactggaaattgcacagtctcttctataaacatttgtattgggaacttaagggaaaagaaggcttaaaaaatttttaactgtctaatatactataaactttctgttatagaagagaataataaagttgttgaagaattaatagaagaaaacaacgacatgaagaataaattggaagaattgcaaacactttgtaaaacaccaccaaggtatacttttactattttaaagtgctattttaaagaaatctaagtacaagtatctttaaatttttttaa

SEQ ID NO: 79247 - DNA, 2470 bp, Homo sapiens
tttttttctcttccagtacagacgtttgtctagggtcagctgttacatttagttgtaatgtatctttagcctcctttaatctagaacatttccacagcctctctttgtctttcatgacattgacatttttgagaaatattctctgcttccaccttcatttttttttaacagaacttttctcatttggggtttgtctggtgtttcttcatggttgattcaggttgtgttttctcagctggagcactgcaaggggtgatatgttgttacatctaaaaattgtggtgtccatatgtcttattggtgaggttacttttcattacctagtgaatatgttgtctaatttcttcactatataattactgtttttttttcacccttgcttatcagttgataagcaatctgtgggagacactttttaagaccatgcaaatatcttcctctcatgaaaaccttctcttatatttggcaaccgttgatgattcttgcttgatccagtctttactatggtggttgtgaaattataattcttccaacttcctccctctatttatcccagttggcactaagcatgttgaatcaagaatcctttcctctcatttgtgtatttattttatctctctgtccatcgatccatctacctacctacttaccaacccacttacctacctaccattcataaaattattggtatgactcataaattcctatttttaatactttataattcattactatatttcattagtgctcaaattgtcccagattcagctagtggagctccttcaaactggctcctatgtccttgtgacatgcctgtatttttgagtactttcttactttctggcataggaagatatttcagtcttattttgtatataccctccccagtactggagtcagccatttcttgaagatccttgactccctttagtagggaatggtattcaataccaagatccagagcaataggtttcatgactatttttaaagtagatggtagtatccagtagtgccttagacaagttaattaatatgctccaagtcacacagccagtaagcagcagaaacaatatgtaaacccatgtctctctatcttaagcatcacactctttcagtcgtgctgtagcctttagtcatgagtcatctgcttttctttctgtcttttttttttttttttaatgatagttcttggtctaaactgatataaaagttttctgtcatttaatttttgcagataagaaaaaggtccttgaaattaaggatttatgctgtggacactgcttccaagaacttgaaaaggcaaagcaggaatgtcaagatctgaaaggaaaactggagaaatgctgtaggcatcttcagcatttagaaaggaagcacaaagctgtagtggaaaaaattggaggttagcatttaaagtagcactgctaccaatatgaatttctttgatccttgttgaaatgttcaaatgtgacattttagttaatgtgtgcactgatcctcttttgggattaatataaactaatttggatcttatttttactaatcaaattattattacaaaactcaaaagaggaagatttcagctctgattaaaaggtcacattcctttcttcctttcttgattaaacagatattgagggcccagtatacgtcaagcaggcttctaagcactggggatgcagcagtgaataaatcatacaaaattccagttctggtggagatgtgttcccttccttcaagaagcttttggttaagtgaggagatctaacaacagattaacaaataattaaacgttgaatgctgttggcagtgttttcctcagaaagaggattgttaattctacctcttattaaagttaagaaaggtttgactaagccttgaaaaatagaggtgtttgccaaggagaacaacgtttgagatagagggaaaaggcataaacaagggcgtgagggtctggactggcctccttctagtccattcatcacaatgctgtgagacatttggaaagggatattttctaccatttcccagtgcccctctgaagaagggaagttttggggcttagatcgctgctccctcttcttacctttcactatcgcttatagcctatacgctatactctacatttgaaatgcttccgattcctgagctggtcctatttcttttactgctggaccttcattgcatatgatgtttgtattctgtcctgtacttttccccaacattctttttagtcttactctcatcctttaggattcaactcagaagatgctttatctgcaaagcccttcttgattttccctagtcagggtgaagtgggctgctcttgtgcggccctgtagcattggctcttcctctattatcaccattaccattctgtattgtaattgtttggtcacttgtcagataccttctccaaattctccaagaattttctgaggagaaggaatatgccatatcttgttcatcc

SEQ ID NO: 79248 - DNA, 1030 bp, Homo sapiens
ggattaaataatacaaaacatgtattaagtgataaagtcctttaaaatcctaccaccagagagtaccactgttggatgtttggttatgttgtcctaatatctcattattatttgaagtacttaaaacattaattatgaaatacttagttcattcaaagaatatatgtatgcatctgtaagttatgaagcctagcaaccaggaacccattattcagcttaaggtacagaacatcaccagtgctgttgaccacagttctatgcctgcaacctctccccagtctgagctaacaaatattctgattttcaaaaattactgtcttttttaatgttttaattatgtgtatgtaccctcaaaaagttgttgcctttttgtgttttaacattataaaaatagtttaatactctatattctttgtaacttgcttttttcctgtttaacagcatgctactaagatttgtctgtgttgatgcaatagctctagttcattcattttcattgctacatagtatttcagtgtatgaatatactatgagttatctgttctcttgttagtggtatttgcacgagttccaattttacaacagtatcctagatgaaaaatataaatgcaatttatggtaccattgtgatgtttcattaatcctttaatgttcattaacataaatggcaccacttaaatcaaactaaaatgtcaggagagagctaagaataattttgctggatcaatgactttacagtaacattttggcccctgagcctgtgctaacttgtattcctgctttattatatcacttatgttaatagtctactttttaatcatttttgtatattttaattttataaattttatgtattactaatgacaatgtctgttatttattgtgtacttgctctgtgccagctactgtgccaaacagttcttatatatttacgtcttctaaaagttttaaatcattttttaaacttggaaataatttcaaacatatagaaaaatagcaaaaagaaaaatagttgcgaagaacattcaca

SEQ ID NO: 79249 - DNA, 1050 bp, Homo sapiens
tcagctggccttccttacaaaattactgtgtatgttaaagtatttagaagcatatgaagtactatataaatttaaaatgatttttaactgttattttcaattcataggaggcagagggttagcattatacttgctaattaacttgttccttgctgtagtaaaaatgttctagattttcaagaacaattctgattttatattgtctttcatgtggtttaatcacgtaaaccattgaaaaatctcaaattcacatatataatgtgcaaaccatatcttctgtctgtctcatagctgcccaccagtcgcctgtcagacagtgttcttatttggaaagtttcataggaagctagttcctagtacagtgacagtacttatataacaccctaagaaaaatattggcgatagatagttcaggcaagatttttttcaggtagtgttttctctttgtatttttaatattagcattttaaatataaaattgtataaagatttttactaagcattaactttgaagatactttatttcagagaaatatggccgagctctctaaggattctgccagccagggcactggccaaggagaccctggacctgctgctggacaccatgctcagcccttggccttacaagcaacagaagcagaagctggtaattggattttgttcccaccagtctttgtagcatccataatcacccatctgaagggttgctttgaggataaaaggagatcatagatgtgaacaaatgggtaataatcgtctgacttaatgtcccctcttcctagatttcattttgtatttagataagagggttaatttaggccctcttcttctatttatggttttcccttcattcacaactgattcttgttacaaggagaatcatgagagttttaatggagaagtcatgtttttattccctgaaatcaagggtttcacatcagagaattgccaagtaatacagactttttcattcaaattactgaaactaatttcaatcactttttaatggaaatctttctgaaatgtattagatgttttctaattgat

SEQ ID NO: 79250 - DNA, 1040 bp, Homo sapiens
gataaatttctacaggagctttatcttttccccatttcttaactccttggagtttgtacgtagacagagtttacacattgacatatttagcactttaacgagaaatacagcctcttatatcaaccctgcttttgtgttgtatgtacgtatatatacatatatctgcatatctgtgtgtattttaaaataaaggaataaggtaaaattatttaacataatcttctggtaactagtggcagatttacaaccagatgaccctcataattaatcaagtcttaattttttcccttcagaggtatcaccctcattctttagtataaactcattctcgacagtaggaaagttcgcaggtgtagggctctaaactagatcagtgtatgtgttcatgcacatgtgtagagcatgaggagtcaggaaggtggtgggtgtagtgattagacagcagttggcaccaagcagtcctccaggaggccttctctttcccaggataaataggagttgttagaaatggtaattggtacctcgtatgacactttctaagatagtactggtcatcaaacattcacagattcccacttcctctgttgcatttgtatgggatgctatgggaagtttacaacaaaaggattagaatccactgtttgggataggtagggtacttgcagtcagtttgactttattatgtagtgatatacagtataaaatactgaaatcataattgctgtttaaaaatgggatcttttttaagttttatacttccctttacctctttcttttgcaatgtcctacaggtagaaatagctgtgcaaaatgctcatcagcgatggctgggagaactaccagagctggcagagtatcaagcacttgtgaaggcagaacagaaaaagtgggaagaacagcatgaggtctctgtgaacaaaagggtaagagctcttctgcaaagacacttcaggaggctgtcttacctgaccccttctcttatctcagtccttggaatttgtacctactcatagaattgttgaaggataaacatgttgata

SEQ ID NO: 79251 - DNA, 1025 bp, Homo sapiens
atatgagtcaggtaacaataagagttaaagggtgtttttttatgtttcatgcattgttttctgaaacacttgctgagtcaggttgcaggttaaataggagctcaattccaagttttaaagcttttagtagcacacagaactttcctcacatgttaacctggctcattgagagaaagggggaaaaaatcatatacacggaatccttcaggttgggtagtaatcagtgaagcctatgaatttgcagacaaggcaaagatggtcaacattcccattcctgatgccatttctatgcacattaaggcttatttatacaattgtaatatgagttaggtaggtgcattttagaagttagagggattttttttgctatccaagacacgcacaacaagttcatgttttaacttggagactgttagtgttgtagagagatgtttatttgaattttgtttaaagagacagctattggaggaaagagaagaatatgtaagcaaactgcaggtggaacttgaaaaaaagtaccaagatacacttatgatggaaaagagcaagtggctgaaagatcaagaaactgatattaaacagcaagttgaaagtgaagtgatcttagccaaagcacattgggataaggaagagcaagaggtgtggattaaaatttctttctggtcaccacatttttaaaatgtggtactaactttagaagacaattcttcttgaaccagatacgtaatttttatttgccaggcacttacataatcatccattttaccttttggaattgagctattagcagttaccacaccagttttatttttaggaatttagccacctcttgacttttcgacccaactcaggatataacaagttttttgggcacttctttgattcctcaaaatgaaaccatgatctgatttcatattgtggaatgattataactctagactaatatttataactaacaaataagccatatcatggattagaaacaaagaagtaatgggcagtctcagaagcccataatttgttac

SEQ ID NO: 79252 - DNA, 1313 bp, Homo sapiens
caccttcaattgattattaccagtggtgagacatagtgatatcatgtgtctcctgcaaagagcacatatcagttcttgacatgcatgccaaagatgcataacctgattttaataaacctaaaaactccaaattgaggaacatcccacaaaataacgggttagtattcttagaaaacatcatgggtttgaaagactgaagagctgtcctagattggaggagactaatgaaacatgacaactaaatgccactcagaatcatggatttgatcttggaccagaaaacagacatttggggcaaattggagacatttgtataaggtctgtagattacttgatagtattgcatctgtgttaatttactagttttgatgattgtgctgtagttatattgggggaagatgagtaaaagctatatggagattatttgtactgtttgcaatttttttaaagtatggaagtatttcaaagtgaaacttagaattttttaaaacttgtaaaacttttgaccttttaatattcagactaaaacagatacctcagaaaaaccaaagaatcaattatggcctgagtcttctacttctgatgttgtcagagatgatattctgctgcttaaaaatgaaattcaagttttacaacaacaaaatcaggtgattaaaaatattttttatattttatgagaatttttatttcctcattaaatacaaaggatataatagagtttttgcaaataaagaggcaatgtgagttagtagacaagtatattagcaggtgattatgagttccagttacttccctttgctagtgaactgttggttagtagtttcattggaaggtaagttagtgtagttccagttctctttctctatggtagcatggctgacagaggtattctttcctccttagccagctcttgacccagaagtaaaactttgcttatttagatggttgctgaagattattgaattctgagacttattttaaggcatcagctagccaatacttctctggttaaatattttcattttatatatttcaaagtaaatacaaaatttaaacgtttagtcctgtcagaaaactacttgtcaaataaatgaatctatgttcttatcaaagcgtgaagagactttttcttttgcagaattgtaaaaataatatgtcaaatattgttataggggagagagaaagcatagaaaatattaaaaaataagacaaaatcaatcagtgaaaatgatgtttattttctgtaagtactaagtttattcttttgtgtctaggaacttaaagaaactgaaggaaaactgagaaatacaaat

SEQ ID NO: 79253 - DNA, 1025 bp, Homo sapiens
ttcaagtacctgtaaaacagttctgttttttactttcagtacagtgttcaataaatttcatgagatattcaacagtttattataaatgaagctttgcattagatgactttgcataactgttggctattataagtgttctgagcacatttaaggtaggccaggctaagctatggttttaataggttagatgcattaaatgcatttttgacttaatgatattttcaacttataatgattttattaggtgataaacccattgtaagttgaaaagcatctgtatgttttttctggttactcttggcacctagtaaatgagataccaattaggtaaaattcctttaccataaatacaaggaagtattctctgtaacaaggaatctgcatttctttaagattggcttttaccaatagtgctctaaaatctagttaaaataaatcctccatagaaatcctgtagtattttctatgagattttcctggcccatgttcttacaacaaaagtcattctatatgaggacattaattatatagtgatgatggtacagatattatatagtggtcgtggtactatgggaaagtacacaaaatctggttttgtcagtcattgaaatccacctctgtattcttcagttcggaaaatgaagctggagcactttgtgacacttttgaatttacagagccaatttcagacaaattgaaactaaacacatgactaataagtaagtcaaagatatttctgtaagatcatgctatcacagagatctttagggctgctctcctttatagatccttttttttacccttccatatttcacaaatcatcagccatctatactcccaatagaaaataatatataaaacacctaataactaagaaaagcaaaagaagagggaaaaggaatgtgggtagtatactccttttcctcctgggtggagataattgtttacttccttctttagtactgttttatctcctatttaaactaggagttgtgttcattagaacagttctgctaaagtatgta

SEQ ID NO: 79254 - DNA, 1052 bp, Homo sapiens
cccacctcggcctcccaaagtgctgggattacaggcttcagccaccgcgcccggcctcctgtactcatcttaaagcacattcctatagataataaacctgagacaccgcatcattattatagtaaaaggaatgatggacgcattcagtgggaaagtgaagaataaagcacagtgtgattagtcactgaggctcggcaaaaagacatccagtgaagcacaagataagcgaagaaacgttttgcttgtagtcatcccacccaccagcagtttattagatgatattttggcttcgtggaaaactaaaagctattatactcagatcaaattcaaaggagataaaggagagaagatatttgtctctttcccctggtctactgtgattcctagaataaggggaagcaataattttcatgtgttgggaattttagttctttgttgacttgggctgctttcaaatcactgactcaaatattggtggctacaagcttttattaccaactacctcctccctcaagctactgcctagtaaattttaagggtttagcctcaatgttctattttacattcatggaatttgagtagctaaatctgcatgcagcttgcagacagcttcctctctcccttattatagttggctgctaagctcaaataataaacatttaacaagtggaatgccttttccctttggtcttctcagcaggcttcataagggactacagtttatttggatttaggagaactgacttccatgggactcagtagtgagcctttttcaggattggtcactaccactgatttttttcccctttgaggaaagaagagaaaattattttagcaagcactttctctctctgacttggctccctctaggagtacaggatgtgctatttcagtggtcagcattcagtaagaaaagaaattggggatgcataatttgttaaccgagcaaaataatcattctgcttaaggttagttcaccatgtcttatggcacaggaagttatattgtaaaatattttatatttcttgtaatttatattttctacttcaatg

SEQ ID NO: 79255 - DNA, 1015 bp, Homo sapiens
catttaaaatattaggtttctaaagtttcagaattataaccctaatacacttcatttacatgtggaggtggggatgctggatagaaaagcatctacaaagaagttaaaggcagcacggtatagttttcttattgcagggtagaaatgggttccaaagaattttttctttgacttaccatgagttggagtgttacgctcctattaaaggacttccggaatgttaaggtctgtaaatgtgactgatttgattcataaaaaggtcatagtagcccatgcctttaactgcccaaggtcatatgggatgccatactaaatctgggaaatgtctggcccagacctatgccttctgggtcccatgggctctatgtattctaaagagacagtagtagtaaagcagaactttactttctgtagcctcagtggattcaagtcttctgtagatcataagcactttgtccccttaattttttcagtatatcctatggttctttcctctgcagggtcagtacaagaggtggctcagctacagttccagctgcagcaagcacagaaggcacatgctatgagtgcaaacatgaacaaggctttgcaagtgagtgttgccacttggaagaggctctatgggtatctgaattaggcagtagttacatcacctttttgaatcttgggtttctctgtataatagaggtggttggaccaccttcaaaccagcccatgggagttgttcaccatctccttcacacagttggcaagtcaaactcaggtctgtctaattgcagagccaaggccctgcacttcctgccagcttgcctgccacctccttcaagtggcatgtcctttcatctttgggtgtatcccagagatcagttcatctatgggggtggggaatgttgaattttgctgcaattctgtcatatcctcctccagtgctatttacattttccactggagggggaggaaaatatgggagaagagttccattattacctccaccttttcaccaccggcaggctaa

SEQ ID NO: 79256 - DNA, 1035 bp, Homo sapiens
caaagtagtctgcctaaatatatatacatacacttatactgacaatataaaatacgcataggaatgtaatacattttctttggcttgaataaaatctaatttttgaataactcattgtcttgtgaatatagagttgaaggagactttagaaggcacctaattcaacctttattagcataattacaaaagaagaaacagactgaagagttgaagcttcacccaagctcttgactcccagttctgtgcactttaccttgtaaaagaggtgatgctcccatgtgatgatcttgtgtttgacatcaaatctaattatgtatcataatttttagtttactctttattaaaactctttatgaaaatgacttcctgaactttttttctatttaggaagacatttgctctcgtctgaaagatcacgtgaaacaactggaaaggaatcaagaagcaatcaagttagaaaagactgagatcattaataagttgacaagaagtctagaggagagtcaaaagcagtgtgcccacttgttgcagtccggtaggtgtctggtaggtccactgtctccccagaaggttggttcaatatgcagaaagaatgtagtaggatccatgacttgtaaaaatccagaagggacagaaaacacaatcagcaataaatttctttaaaaaaaagaaatatatatttttatatatatacagaaggcatatatatatatatacatatatatatatatacatacacacatatataaaaaaatatataaaggtttagtttgtttttattaaataatttggaagctggagaccagtataaagtaccaaataaaaataaccgtaattctactactgagataattattgttagcatttgaatgtatttccttcaaatgaaatgaatgtacacacatagacaatgtcctgcttctttatgtaatgcatttctgaaaacatactaaagctgaacatgcaaaaattgaacaataaaatacattatagggtaatttctatccctgaaaactaaaagtgattataaaatcc

SEQ ID NO: 79257 - DNA, 2025 bp, Homo sapiens
ggctgggtgacagagtgagactctgtctcaaaaaaaaaaaaaagacactctattttggagtccctatattttcccttttctcacttaggcttttagaatcattgaacattatttaactgtactgatggcattctgtcctaaaaagttgttgattccttatgtctgattccttatgtcattactctggatgaagtattccagctttcagagtgatttgtgtttagtttgcactgcagcgtttcctgaggctacaaattagcataaacgttttaatccaaataagagttagtgattgtgaagtgccatgtctgggataaacacacagagtaaatacagattcaaattataattgcttactccttgtgctttctctagttttggtccacgttgaactttcatttgcagaatacttttgtgattgaactctagctcatttcaaatttaattgatggtaaaaatgtctctttctgtaatgctcataacatttattttgagagaagaacttgtgagctgttatagcaaagtatgtgggaagaatttaacattaggtgaatttaagagttcattccaagtgggtcgggcacggtggctcactcctgtaatcccggcactttgggaggtcaaggagggcgggtcacgcggtcaggagatcgagatcatcctggctaacatggtgaaaccccatctctactaaaaatacaaaaaattagctgggtgtgtggtggcgccagtagtcccagctactcaggaggctgaggcaggagaatggcgtgaacctgggaggcggagcttgcagtgagccgagattgcacctctgccctccagcttggcgacagagcgaaactccgtttcaaaaaaaagagttcattgcaagtatgtgtaggataattagtcctcagataacttctttgattagcagggatttgtccccaaaagggatgcaataatagttttaaaggaagtagttctgcttctctaaaaaaatttttttggtatcaggtttgtttttttttttaatttttaatttttaataatttatttatttggggctgggtgaggtggctcacgcctgtaatcccagcactttgggaggccaaggtgggtggatcacttgaggttaggagttcgagactagcctggccaatatagtgaaaccccatctctactaaaaatataaaaattatctgggagtggtggcaggtgcctgtaatcccagctactggggaggctgaggttgtagtgagccaagattataccactgtactccagcctgggcgacggagtgagacgctgtctcaaaataaataaataagtaagtaagtaaattctttatttagttttctctaaatcaactaaagttcatttttctgaattaaatttaattcaacaacatttatatatgatacagacgtgacatctgattgggattgtgacattggggtccctctacaggaacattatttatataaacatttttaataccgtagatgaaaaggatggtttgactctcagccttcgagaatcacagaaactctttcagaatggaaaagaaagagagatacagcttgaagctcaaataaaagcactggagactcagatacaagcattaaaagtcaatgaagaacaggtacctattttaacttatgtatggtaaaaaaattaaaagtttagttatttaacaaaactttttgtagggtaggactaaatttagaagaactttgaagttattgacaaagcattagaacttaaatttcctgactgcaatagtttgcttcagaattggtatcccgagaagcttttatttttatttttcctgctgcttctccatttggagaactgttttttaaacttgagtttaaagtggtgacacattcacattctttgattaatgagatagccatttgatttttggaaatagtcataagtcattggtagctaagcctggtggtggttgattcattttttggcagggggcagggttaaaaatgaaagtgatggccggatgcagtggctcacgcctgtaat

SEQ ID NO: 79258 - DNA, 1220 bp, Homo sapiens
gttgaatctgggagatgggttcgtggagattcatcatattattctctttactttcttatatatttgaaatttttcgtaatgaaaagttaaaagacatttttccaactttatatttcagtcattctagtttgttaagccttttctccttatttgtatagtgttaagtatcctcgcctatcatacaggatacctggacttatttgaaatttaaaaaaattttaaaagactttttatgaactttatatatttttttgactgaagcctaatttggaaaatgaaacatagttttcaatctcagatttttgactatatagaagtgtaatttaatacatcagcactatcatcaacttttttcttttgattttacagtttttagtcaactctgatataaattagtttatattcagaattacttagatatcaggttcagtcatgtggcatttgccagttttttttgtatagtatgtatataaatatgagaatgaaaaaagtgcttataggtactagagaattctgagatgaaatgctagtatcaaaaaacaaaaatcccaaaatataaacccgtatagtgactgtactgaattactcttgtcatactgtctggcacactaaatagcttctaattattgtgcatattgaagagccagtgtaattctagagtgtggcagcaagtgtttttgttttactttttgtttccctttaattagtaggggaaaggtcatactggatattctggcttacctgggctataccaaagagaaaactggacttttgggttgtgacttcatattgttgcttccatcgtacactgggacggcagggtagttacagggggaggcccagaattcattttcccctgaaggagtcaacagcaaatatgaggatggcctctctttgttcttaagttttttgtggaatgaggaagtggacagtgtatatgacataactggttttaggttgagtaaatgaacctcacagcagtggcctgacatctccttagtgtttactctttcagttcccttgaaaagttgtatttgtatctcctggtctttctgcatataaaaacctttccttacctttcttaacactctgcacttcttcaagttgagtcagttacacatttgtctaaatttgacatttggaagttaattaaataacttaatggtagtgccaaattagtgattatagtttcttagcaacagtaatttaaaaaatttgga

SEQ ID NO: 79259 - DNA, 1778 bp, Homo sapiens
cacctgctgctgctgctgttctcatcacctggccagagtgcatctggctactcacattccctgtgggatgcctaattgtcaattccccaaggtctgattactgataaaacaggattctgagacttagtctgcctgccctgtgataacataatgcattgattgtaccattattgtgacttgctgtgtttccataaaaaagtttttgaattctgctctatgtgtatttaaatctgagatcttcgttaaaaaaaaaaaaagccttctgatataaatcctaaaattatgcattcccttttccccaagtgaaatgatgaatataatttgtgtggaacttaagaagttaattaaaggagggaattatgaacttctttgacctctacagtaaaaaaccactcgttccaaggcagctttggcttggtgtcttgtgtttaagttggtatgatattgatgcagaccttttgactcagttgcagcagttactcacagaccttccccatgacatgctggatgacgacctctcctctccagagctccagtattcggactgcagcgaggatggcacagacggacagtaagcacctgaagtcactttcacttgtatattgcaattctataagtctttttcttttgatgaagattaataattacatgattataaaattgtaaattgattcttaaaattttgggtgaagattggaaggaaaaaggttaaaatcttggggttctttgtgttatctatgtacaaataaatgatacgctttaaatcgaaagtattcctttttctcgagaccacatcatcctgagcaattggagatgagctggaatgagcaaatgctgcccaaatctcaaagtgtaaatgtaagtatctggtgtgatgatgactttggtgagggtgggactggatcttcgtgcttttgttttactcttgttatctaatagggctataatgaaattcagagtttatatgctggagaaaaatgtggtaatgtctgggaagaaaatagaagtaaaactgaagaccgacatcctgtgtaccatcctgaagaaggtggagatgaaggtggaagtggttatagtcctccaagtaaatgtgaacagactgatttatatcaccttcctgaaaactttaggccatataccaatggtcagaagcaggaatttaataaccaagcaaccaatgtaattaaattttcagatcctcaatggaaccattttcaggtattgtaaaaacttgactttcaagaacttgtgtgtgtgcacacgcatttgcgtgatgtttgtgtgtgttcaggaaatgtatgtgagtacaatggtaagatgatttaaccacacgaagttctgagagggcacttattcaggttcatggtgaattagtcatggtattttctgtttacagtctaatacaatcatgatcttaagtcagaagtttaaaatagaggctctttggacatagttgattaaacattaaaagttaagtctgccaaagaataactatcctcatttactgctgcttctaccactgcactgtgcttcaatgagaagctgtgttcaggtctcttattgtagtttttaaagcagtaattctgtgtaggtggcaacatttaatttcctcagttttcttgctcaccacccataacaaattttaggttaaacatgtcaaagctgatatctctattgtatggtgatataacagtagacaggatgaatgtgaaggaaaaaccaaaaaaccttgtttttcctgggggggagtttaatgaagtaagacctcaggatatagt

SEQ ID NO: 79260 - DNA, 1028 bp, Homo sapiens
gactgaatggagggcagtgttaggccaggtaattgatgacacctgcctacttttttgttgtgattgttcagagctttgaagttctgaggagtttatgtatagtgtcaggatccctaagtacaagttaaatcagcagcagcttttttgaatgtaagtagttgaaaacccatttcctgctgctgcttctgccgcagcagtcactgctccccagggaactcttgctgttgcttttggaattggaagtccacagtggtggagcttcacagccttcacttctgtttttcccgagtatattgccagaacctgattttatcaagcttaagaggaggacatttaagacttatattttgttgtgcactctatggcattgactgaattgtaaatggtttctgggtagtagtcattcactcatgatttaggggccttcttcttgtaaagcatgatatttggatttctgatattaaaaaaaaatgaagcaatagggtactgcctgtgccatgtttaatatatcacatttgaagttttgtttgagcttaagatttttacatttggcacatttctagtttattattattgtcatcttatttttcatgtcggcaaaaatcttactgttttatactcttcagaccactagaaaggtctattcatagctttattacctatttgcatgttttcttttccatgaattgctgtcatatagctattttcggtgaatcaccattatttttattggccataactgagttatacatattttctcccagtctgtttctgtcttttcactttgtgtatgtatggcatctcttatgtagtttgtcctggggagattttatgtggtgtccagaaaccaaacatctttcccttcccacaggaggaccatgtcattagactttggcagtgtggcactaccagtgcaaaatgaagatgaagagtatgacgaagaggactatgaaagagagaaagaggtaagttgttaaaaaaaaaaaaaaaaagagacactaaacccaatctttaacaagttttatttc

SEQ ID NO: 79261 - DNA, 1021 bp, Homo sapiens
ctgtgtataaaatatatagctaaattagccaattcttaaaaacacttcaataattacttgtcttcacattggctaccaatgacctaaagtatttaagcatgtcaaaccaagacatgctttttttttttttgagacggcgtctcactcttgtcactcaggctggagtgcagtggcacgatcttggctcacgaagcatatggaagaaaagcagcctttacaggatttcaaacccttgttttctaattaatggatatccagtttcccctttaagctttactacttcctcatcttttagcctggggtatagttattttcaaataactattatatattagttccatgatgctgccatttttaaaagtaaaccaaatgttaagagttccaccttttccccaagaaattccacagatgcctaattgtgaattcccattagcaaacaagggacatacaaggtgtctggtgcttagcagctgctatttgagcccaagagcctatctggactcttttccatccagccttgtaatctggcctcaatagcaacaccaaggatggtggctggcagggagggtcaactgaatccaggctgaaaaataccagcactttctcttctccctagctcagtcatccatgaaggaactcaaatacttttcttaagagatttaaagtagtgtttatacatgtagtgtgaaaaataattattggcatttgccctaaatttcttaagggttgtcatcatgttagaattggtgcgcaaacatttactcaaggcatgccctgaatgatttctgttattgttctccagaatcttaatttttttcatactctcttcatgtgcctttagttctttaaattgaccaaaccactgttcctataaaaaacaaacattaaataatttgtggccactatgggaaagtttgtacctgctgcattgagagcacctctgtgctctctaaagctggtgagaaagcctgttgattctaatttaaagtagaaatctggcggcggtgccatggcttggttg

SEQ ID NO: 79262 - DNA, 1083 bp, Homo sapiens
gtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctg

SEQ ID NO: 79263 - DNA, 1041 bp, Homo sapiens
gctgtaacccaggctggagtgcagtggcatgatcaaagctccttgcagtctcaaactcctgggctcaagtgatcctcctgcctcagcctcccaaggagctaggaccacagtcatacagcaccacatttggctaattacatttttttgtgtgtgtgtgtggagatgaggtcttgctatattgcccaggctggtctcaaactctaggcctcaagcagtcctcccaccttagcctcccaaagtgctgggattacaggtgtgagccactgtgcccagccaggtatatttttgaacaaaggaataaaaataaatttcatgaagatactcatttggttcagacagccttggggtccacaagttgattcagatgaagggaaggatttctcaatcatgtggaactggatgagctttaacctctttctagttgaagagatcaaacatggtttcatctattagcaggctgttgaaatagcagtttattattaatttatagcgacttatcaactttgtcatcacaaaatttaacatttataaaatagatattactattaaccctgttttgtccataagaatattgagacttagagaaattaaaaaatttaccaaggtcatctagcaagtcaataggtggtagaactggaaatcagatctgccctgcctcttgtgcattatgggtcaaccaaagtggaataattttaaggaacaaatcttggggaagtgctgaaagccagaagggtcagaataaggaaatgtttaatcctgggtttaagatgccagattccttttttgtgaattctctctggaaggtcttcataaagatactcataaatctgtaggaaaagatactttaatgtccttttgtgatttctaaggagaaaaaaaatgtgtgagatagtagttctcaaactttagtatgcaaaggcttcttaaaacagagaatgttagctgggggtggtggcatgcacctgtagtccccactacttgggaggcttagatgggaggatcacttgagctcaggagtttgaggctgtagcgtgtgataat

SEQ ID NO: 79264 - DNA, 1039 bp, Homo sapiens
tctctgcccttctctaggagtttgtatacctgcttaggagacaataaatgagctaaatgttttatttgctagtcagtcaccacctggacttcagtgactttacaagtttatgtaatggtggaagaatgacaaactatgtaatttttttgtcttccatccaactccccaccacccccaactgtcccccccacccccctcacacacatgcacacatccgtacgtgtgtgtgttttccacttacaagcttccataagcaggcacaaaactgagaaggaaggggtattatccctgccctgattatctggggcagggctttgcctcacagaggcaggagagaagaattgggcagattctttactgaactcattgggactactgtgctagttttgatgttttataatgctggcatttaattactggagagattggattcttggttgatgatttagtatttgtgaattgtgaaagttcaggagctgtgtagaaaatgttagtcaatcaactttattattgtgctaaaaggggacattcttatactgtcctgtctaaactgttctccagtatagacttcctaggcactaaatatccaatatttaaaggaacacagcaggtaaggaatgaagcctctgaaatagtactcatggatttatacatggcagatcttactgtctctacacatttggaagtgttcgttggtttaaagaaatgatagaggttttgaactactgacagtcttaaaagtgaatttaaaaactgttcatactttttatggtgtaaatttcctttgctcgatgtcagtgattcagataactcttgaccttgagatgatggcttttcacaggtttcttatattttatatctcttctgaacatgaattgtcattttagatttttgacatttgtatcaaaagagaagttgaggaaatcttcagaacactggtaacttttagttttgctatagacttcagaagtgtttatttatatgttcggtaaatgctctcgcatatgcagtacctcttctgccagcaaatccaagggac

SEQ ID NO: 79265 - DNA, 1052 bp, Homo sapiens
ttagtattgtcattgttactcagtgagtcaagcagacaaaagaccagagatctttaactcctttcggattttgtttaacagctgggtttattatttaaagcattgccttctgtcagctgttagtattcacgtgagagtgatctgacagtaagtatattctctttatatcagatagtatttctattctagaaatctagactcttaatatcttatatattaaatgttgtactatcagttttcctcctacaaatgcttttgcttttttgtttatattattggcccttcaaaagatcactctaaccaattaataggtttctaagaccctattatatgaagtgaacctattacataaagctatttgtgcaagtatttctaagttcttaaattgagataactggggggatcacagaatatgataccccatctgtgaatagctttaacagttattgctgtgaaggattttaagattttaacatttatgttgatgaattaattttacctttaaaaatgacatatgaaagaatcccagggtgaaagtataatctatgtgagtccaaattacattggtttattctgttccttttccctataccattgtttttgagcaaatacttcctgcctagctttggaaagttaattaaatgtcaaatcacagatgtggagcaaatgaaacacttgggggataaaatgttacatatgtatgaaatgaacagcttgaaggaaaaagggaaaaaaagaatgaagaaaattgcattttgggatgttctagtctttgattgcattcttcaatttggcacactttgacagttaaatgttcctcaatctctgcatttatatatattcttctgaagtagtgtcattcttgtacttatttaactatttttgacagaaatacaaaaaattcccctgcaaacttttttgcactaaagaagaacaggcacagattttcccactacataatataaaagtagaaatttgcttgccttggttattcatagataagaaacaccaattctccctattaagtacctgcttatggtagacatgagggg

SEQ ID NO: 79266 - DNA, 1055 bp, Homo sapiens
aggttgtggtgtcttagccaacagattgttgtgagaagtattcatacacatgaatcttgacgataatgtgttaatttgaagctcaggatatcatcagtatcatgactatctttctgtgtagaacggggccctggaaaatgaattatttctataaggttaaaaaaaagataaatatgtagtatcccaaaacattaagactccaggaatcagaagccctggatttcagtattaacttcagtgcttgctacacatatcattttaggcaaccattttactctcatctttctcatctataaattggggagcatatttgatttaactcactattgttaaaagggtcaaaatgagataattcgtgtccaaataattgaaaactgtagaatgtcaatcaaatgtaactgtatgacctgggttccaaactttttaatttaccctttttttttttggaaactctagtttgccacctaggatttaaagcatcagatatggtttgatagctgtatattctataacataattgcttttctttattttgtatgcagtacttccttcaacttacagtgtctgaaattacatttgcctttttgccagttagccaaacttctcatgttcatgtttaagtgaactaccatacctgtgttataatgtatattgtcatcatttgtacacagttgaagagtaatctgtaattaaagactagtgtaatgacttttaggttattttaaaagaaagagaggaaaagaaggggcgcttaactgtggaccacaatcttttgggatccgaggaaccaacagaaatgcacttagattttattgatgacttgccacaggagattgtttcccaggaaggtaaggagctccccctttctcctcttctcatggaatggtctgaaatattttaatagatacgtaagctatcactagttaatgctcctgattggaagacgtgctccatattttacataaatctctttattcttcagagtggtttcttttaaagatgcttttgtagggagatggttaaagagaaggggacaggtattatatagtaggcct

SEQ ID NO: 79267 - DNA, 1033 bp, Homo sapiens
attgaattctttgaagagtctagtccggttgtactgcagaacatcccacattctggatcctttttccttatgattgacttttatgggatcactaacaaatgtgttttttctggttatcatagttggatgatttacctgaaaactcaccaatcaatatagttcagactccaattcctattaccacctcagttcccaaacgtgcaaaaagtcagaagaagaaagctttagcagcagcccttgccacagctcaagagtattcagaaataagtatggagcaaaaaaaattacaggtacatattcatttttatgaacaaatgtgatagtttacttgctaggtttgatggaatagatagaaggagtgataaatgtagtcatcttaaaatgccacagtttcgtactataacaaaaaaattaattttttatatttattttgtaggaagctttatcaaaagcagctggaaaaaagaataaaacacctgtgcagctagatttaggggacatgttagctgctctggaaaaacaacagcaagcaatgaaagcacggcaaattactaacaccagacctctgtcatatacaggtgatatcattagtctgagcaatttgctgtttgtctctgctaatatatgttagatgttgttaatcgaaatttttaaaattttatatatgtatgtgtatatatatgtgtgtgtgtgtgtatatatatgtatgtgtgtttgtgtgtgtgtattttaagtcagcttaaaccgcaagccttgaaattgtccatgctcctttccacacctagtcctttaacacatcctatctgtcctgcctgcaaaacatatccatactctaactactcaccagatttcctgccaccacagtagcccccattattgtatcatactagactgagtagcctccttactactacctgcttttccctccccacaaccccttgtctgcgttaaaaggagtgacctttttaaaatgtaagctggattatatcacttcactgctcagaatcctctaacagtgcttcatttcacttgg

SEQ ID NO: 79268 - DNA, 1018 bp, Homo sapiens
ttgcagtgagccgagattgtgccattgcactctatcctgggcaacaatagtgaaactccatctcaaaaaaaaaaaaaaaaatcaataatatgttagataagtttagtaattgagccaaaggacttgagagtatatctcaattattttctcaagaatagtttcaatatatccaggtctggcaattgtagtacatgtactcaactgtactattggttctatacttatatttaaagacattagatataattttcaggaaaaaggaagatattaataaattaatttcaatggaaaagatgtttttaaccttattgacaattgtgtggagtaatgcagaacaaggagtatattaataaagtttacatgaagctgtctgttaaacactttctcaaattatctgaatgtgataaaacccagtttgaatttcttttcaattacccacccatctgaaggtagaattattaataaaaatgaaatagtaggtgcagaaatccaaaaactggacatgtgtggatacgcccccatccttgaataattaaattgtttatattttagcatgtgagaaatgacatttcctctttaagaccgactttgaataattcagtaatagaatacaagaaataacttcctcatttttcaatacttctaagcattataaaaagtttaggagtttgccttgaactctttttacttaaaatgtgaaacatttcaggatgaagatgggtttcaagaactaaatgagaatggaaatgctaaggatgagaatattcaacaaaaactttcttctaaagtagtaagtaactctttaaaaagaaaagcaaaatataacatcttttgaacaatggctatgttgaagggaaatattaaagataagtgtaaaggcacatggagcagcagagtgtgcaggagatggtgtttagtacctatctttaatatttcttttccagcatagcctgaacaaagataataccctatgaaatccacagttctattactaaaataccattaactaaatgatatc

SEQ ID NO: 79269 - DNA, 1013 bp, Homo sapiens
ctggttttttaaaaaagtaaccatcagatttaaaaaacattagatttggtctgttttttaaaaaggaaaagtatgggtagcaaagcattctgcccagtatgggcagaatctaagttaaatactttgatttgtcttcctcattattgtctggagtctgtgaaacttacacgtgtaagtactgtgttttgtttcggcattttaatcaaaaaaacagcacagctagtagttatctcttaagcattaatcatttttcccttcagaggacatttattttatcttttgccatgagatgtaaaatatcttaaagtttgagatattctatttttaccttaacatagaaagaatatggagggtttccatggtcatattttttctgtgggtgtgtggtacatactctggagtttcactgtgggagagtgtctcgttatgttccaacttcagttttgattttaagtgggtgtcagttttttattgcttaatctgggaaaattatttgcattcatctggaggttccatgtctgaggaatttagtgtacattctctgccgacgtgtgctttgtggtaatgtttgcccattttccctaacccagtccagcacagtgctctttccggaatgtatgctaaatgcacgtttgttgaattatataggctctcaatgatctgaatacatttgtctaataaactcttttaaataacatttttgtttcatactctgacagagtcttgagctttctagattatttacatcaaaggcattttgtttatagacatttgccttaatgtacacaaaataaaaagtgaacatgaaactgcttaaatatttttacaaagatgattctgggactatgatttttttcattaatttggaaaattctgaaataatttctgaaagatgaagatagttttgctatgtagatggttgtgcttttttgtgaagcaaataatacaagaatgattagactttgttaagtgtagtttacatttattccatatttatttcctttatgaagaca

SEQ ID NO: 79270 - DNA, 1024 bp, Homo sapiens
aggctagtaatttctgcctattaattttacagttggataattagcacctgaattaatgagataagatttcccaaattcctgtatgtgtctatatgtagttgaagccggtttgtattttgaaatcggactcttagcaggcaaagcacagcttcctagttgtgtatacttgtttttacagaagacttttttttttaaaaaaaagctttatgtgaatgtaactctgaagacacaaatgagttttataaaacaatacatggaattaccaaagagaaattgatacagagtctcttggcaaatacacttaggcatttatgtgacccagaagtattctgtatacagcctgtatctagtttaatttaaaaacatttttgaaggtatctatcataaatacctgagatttcaaagcctgacaaatgaatacgaattttccttgaatcatttccttgtatgtgtgttactaatgaaagggttcaacattttgttccttcactaggatgccaggactaaaaccagtaatgctaccttatgtatacttagagttcctttcatcctagaggaaatataattaactatttagatggtaatttttagcatagctgtttgtgattatcctagcagcaagtgctgtgagcaaattatttaaactagagagccttttcccctttccacatctttccaaagtccacgacctattaaaaccttgtagaaatttaagaactaggaaaaaaacatggaagaaggttttctgttgacttttttttcttccagtacttcttgcctcttccccagcctaaccctaaatgaaagaataatttgaaaatcctccacttccctatacactcagaaaatatatatagaaaagtgatgtcttcacctcatttatgcgataggcagttaattcaggggtccatgaatgacctagaaggagtatgcttctttatatgcctttttctagggcaagaatccattattttcatcgtattctcaaaggacggctaagaaccattaacttaatagtagattg

SEQ ID NO: 79271 - DNA, 3568 bp, Homo sapiens
cacagtgtggcacactgtagtcttgaactcctgacctcaggcagtcctcctacctcagcctcctgagtagctgggactgggctttacttttaatgtgaatttttctgttttcttggcataaattgagttaacagaaaagagccttaacattgtaacaaagaaattaggaatcactaaatttctttttaaggattctttcaccctcagagaaaattgtaggggaaagtagtggctaaaatatgtaattgatgaagggttaacttcaaccacaataaaattgttgcaggaatgtgcttcagaagttaaaaatttaagtctttatcatacctgtgttctcggatatattttgaagtgataatgaaatatgtttaaaaatcttctcttcactaattttcctttaagtgatagaaatgaattaaaattagaatgattgtgtaaaattatgaagtctttaaaatgttaattggtatataacaagtcttttgtcttaggagttaaacatagatgtagctgatgtggagagcttgctggtgcagtgcatattggataagtaagtactttactattttttatcacaaaatatttggtaccgtaagttttgaataatagtgacaaaggtaacaattggattcttgattattcataaaaagcacccttgggtatggttttctattagaagagatatatatgtatgtgtgatggtttttgatgaatgagcgtattaaacacatctcagaaaaagttctaaatgatttttcagaaggatttcttattatatacagccaaagaattatttaatgaatagtatttatgtatgtttttaagtatagggtatgtggtacataacatttttgaaattgtatcttacttgaaaacagtacattgtttaaagcttcacaggtgatacttgcctttgattaatcggataaatctatgccttatgggtctttcagtgaaactgatgaaaagtatctgaaatctggtttctatctagagtttgaataacacagtgaagttaaaactaacactgaactcatttaatgtaggcagctgctttttttttggcatttgttgatactgtattttatgaaacattaatccagaaactgtgcttgatgaaagtcttttgtagacacatcttatttatttctttctagcactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacacttccttttctcatgtataaattaaaatgtttgctgcattttgcaaaatgtcaattctctaaaaatgtgtccgtatatttctgtacctgcagtgtagtaaaggtttagacgaaaccccataattatagtggcatactgtcacttaggtttcaagcagcaaaataaacagtgcagctcagaaattgtagtttggttcttgatgtgtttttattacatttggagttgttttgttttttagtaccttcgaaatttcaaattattttatcttcagttaatgattttaaaaagcctgggggcaaataagttggttatttgctttcaagtttttaaaagtagtctttattgatagagtaaggagaactactttctaacaaaacacgtgcatagttatgacagtgatgctttaaaggaataaaattctttttttttaaagagtgatattccttttcaaaagaatactaactctcagaatgttcactttaaacgaatatgccagaacatagacagctaaatgaatgttactctgcatagtgatcatgctggaaggttatttcctaatgccagcaatctaccattgcccaaaacctgctgagtttactcttttagaattgcattcaaagttaatttgtcacacacactaaactttatgattatacattgttttaaaaaatatagtattaggaagcttgattatttttagttaccattacttggcaccaaatgaaagtttccaaaacttccacctaactttgaggtaatgcagaaagtatataactggctttgaaggcaatcccaaaagagttttaaaggttttttgagcagtggcagtatacttaggagaatgaactgtggccttccaaggtaactaccttaaaggaactcagctcatttgaatgtattgagttttggatgtatttgtttcattttttaaaaagttcacattattttatagtgtcgaaaggaagaactaggattaacataatttctttggtttttctattgcttgttattattatgtaaaaactgggtggcagttcagaaggaagattgtggttacagaagagtgacaaccaagaattttttgatcattaaatcagattttataaacagtggaaggagcatggacttaaaacaaggcatgcttattcggttttgtcaaaattttacgaaaatatgtgatatatatttatactaaaaatatataatccttagatttagaaaagcaatcagttaatgtctttagcagactaaagcagtattaaacacaggtacaagttggaaattgtagaaaacggaaagaaaacaaaagacaaaatgtctatggtagggaataaaagtttaagatattataaaattatgtgtattttctcttttacataaatcatttgtgaaaagtgtgctaaactttttttacaagagtgatattaattaggatttatttttcaatataatttggagaccctttgttatccaaataaaaatgatgagtttttgtgcctgtattcaaatatgtatgcatgtgataacccttgaaagctaaagcccttcttaacttttgagttgatggaattagaattcaaagatttgaatgaaatgatttaacctttatcctccaattcttacagtgcccagttctcctgtgctatctttgctttgtacaatagtgcatcttccactttctagagagaaagcatgcacttgttatttggaaaactgggctaaatatataacagtatccaaagttataccataataatttattgtaattgtgtattacatagctttgtttacccagatataggtgcgttcttttttttctgttagtcatctgtgacttttgttctggaa

SEQ ID NO: 79272 - DNA, 1551 bp, Homo sapiens
ctttggccttctgcaacaggggattgagaaatgttccttttgaaaattttcacagttgctggtagctttctagaatataaaaattaagaagctgcattttctgaataacctacacagaggatatgctttctcatttgaaagacgaggctacaccccttcatgtagtgtacatgaagcctggttcctttcattatgaacaattaggaattaaatgcacaatttcatttgaaaacatcaaacattaaatagttgttaaatgttttattgccaacttttaagagaagtaagatattgaggtgattttaattaactttgtataaatatagtatataaccccaaaagaagatttatttaatctttcttttaaaaaaccaaaagcatgaaaaggaaatttatgttttttttggcagaaggttatgtgtgcttgtttaactgtgatttccatgacagaaagtataatattatttagatttttgcatatgaaagttgagaagcagggtctttggattatctgatttaatacataacttcttcatgtttgacataatttacactttgtttttctattagtgcctatcagaataatgacatcactgaatttgaaaagattctaaaaacaaatcacagcaacatcatggatgatcctttcataagagaacacattgaaggtatgttctttctgccaactggattctattactttctttgccactgtcaaagaaatgccacttaatgaagctgcatggcattaagctgttttctttctgtctattgcaaagtatagatatgtttctaaatgctgtcattggatgggatattccttaaaattatgaagctcttttaaagaaattgaccaatttcatattactatagtcaagtttatatataatgtccattttgtttaaggtaactgtccctttttaaaaaaatctaatatagatgctgttgcatgtttattattgatgcttaggttcaaagttaatttttaaggtttatttttgacaaataacaaaagttatgaaaatatcctgctatagataatgctaagatatatgtactatgaaagataaggcaacactgtgaaggtttcataccagtaagtgaatgaggtttttagcaagttatattgaattaccaaagactacaatcatctctttgctcttggacttcttttatagctccgattttcccacctattatggagctatttgaaggtttttaaatgaccatttggaactaaatttcagatgcatcagaagtaatgttctgttccccatctttctttctcttttaatcaacagacattttaaaagttcttacatgaacctggaatgatactgcagtttatagatatagaaaaacgtagaatctttgtacatgaatttcaacctggttttaaaaaattttaagaactattgtacagacaaaactggaggaaattgtaaaagcattatataaaatatagtactctaggttttgagagagtctaaaacaaggaacttggctggctggtataaatcagagcttctttaaagatattaactgttgagg

SEQ ID NO: 79273 - DNA, 1106 bp, Homo sapiens
atagtaagttttcacttaacgttgttaataggttcttagaaactgtgatttaatgttgttttgttcaacactacattgatgaggggaaaaaatgatttcattgtacattgttttgcttaaggtcatggtttccaagaacctatcgacagtgttaaacgaggacttactatataggaaaaaacatactactatacatagtttcaggcatccactggacgtcttggaatatattccctgtggataaggaaggactactataaaaaaaacctttggctactttttccttatctcataactaaaaagtagaaaggatgtattagtttctttttggccattacaagtggtattcttagtactgtagctcccaattaaaatttgtgttgtgttttcacatggaaatagtattataaatgtaagatttccaggctaatgcaaataagaattactgtctgaattctatcttgtctaaagttaaatatttgctttcctagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagaggcaagtttggtttggagagggtgggcagtggcatggggagatatcaaagtgtttaattaaactcttgctttttagaacttcagtgtataccttggggccagtagtattcaagttacagaatttaaaaactgaaaggcactgaaatagttttcatttggcatttatgaggtggtcagttttgttattacagaactgaaaatgtcctattttctcatgtcttattcttcacagaatgtggtggtaaaatgcacttgagggaaggtgaatttgaaaaggcacacactgatttttttgaagccttcaagaattatgatgaatctggaagtccaagacgaaccacttgcttaaaatatttggtcttagcaaatatgcttatgaaatcgggaataaatccatttgactcacaggaggtacgtgtgttttaattgttaatttctctt

SEQ ID NO: 79274 - DNA, 2031 bp, Homo sapiens
actagatgtcatttttttcaggcagtttgtactctttacatttaaattttatgtaatgccaatagaggaaggtaaacttacatgttttgttagaatattaacacttaatgacactaattctagagttaagctatatatcatggagctttcctaaagtgggaaaatgttttccaactcttaaaaacaagtgtcatcaaaacatattttgtatactgtttataaatattatgccagtaattggagcagggagagggaatcgagtgattttgaaacttcaggactgcatgctctgtgtgtggttatatgtaaggtttttgtcttttgaaagtaacaacagatattgggtgggtggtactctgttctattcaatatgccatcagcagtcatgcataaatagagagtgttttctgaaaatgtgaaattttcctgctcttacagtcctcttcttgatcctgttaagcagagaattagatattcaaacaaaggcaaagccagaagcggggggaagagggtgggcaggggaacttaacaagatgtaaaacaaataatgatttccgtgaaaaaatgccacacagattggtgatttggtggtgattagacatagctaaaattatactagacttttctctccacccacctccatggtttaccagtgacttaaaagctatgcagttgagttacttagtcatatttatagaagaattttgagggaaggagcttattctttgtttcttcaccagcatgcttagtgtttgccacattgtaggctccaaataagagttgagtgaataagatatacactgttagtaataatacaactagttctatgtacatttcatttactgctgttaatatgaaatgagtggctgatgtgagtggagtggtatttacagctaattgagcacaaccagttacagattactttgttccttctccactcccactgcttcacttgaatagctttttaaaaagtaaaataaaatacagaatgtattattagattgggaaggacaaacgtgtactattacagcatgagaacttacagcactatgtttatatggggaaatattttctgggttctataaaacaacgcatcatggtacttgtaaatttggtctgtattttgcttcagtttgttaattttttggactgtagaagacagtaagatacagatagtgtatcttatgtgtattaaagttcaaagatgcacttttagtttgttcaaattaactttattaacaggtacaaatttgctgtttacaattatagaattctgattttttatgtcagatggatttactgcaggaattctatgaaacaacactggaagctttgaaagatgctaagaatgatagactgtggtttaagacaaacacaaaggtaaccgttataatacttacacttttcttttgaaaagtgggtgggtgtttttaataaagtctcctaaagatgcacatcttctgttgaaatcttgattttaataaatttgctttcttgcagcttggaaaattatatttagaacgagaggaatatggaaagcttcaaaaaattttacgccagttacatcagtcgtgccaggtagctttcccttatttttttctgaatatttcttcataataaaaaaaaagtataagcaataattatattcaaaatattgtttagggatgttttagtttaagcattatctgaaaaataaaatttagaaaataagttataaaattatctttttttttttgagagagagggtatggctctgtcacccaggctggagagtgcagtggtgcgatcttggctcactgcaacctttacctcctgggctgaagcagtcttcccacctcagcctcctaagtagctgggactacaagtgcacaccaccatgcccagctaattttttgtatttttttgtagaggtggggttttgccatgttgcccaggctagtcttgaactcctgagctcaggcgatcaccgcctcggccacccaaagtgctgggattacaggtgtgagccaccatgcctggcccctcaatctt

SEQ ID NO: 79275 - DNA, 1903 bp, Homo sapiens
ttcaattcttggttaggtttcagggattgttctcaagttttcttgttctttgtgctgtgcctcagggcagaatgtattgtcataagcaagataattgcagcattattagtttattcctcaccctaataaatacatatgttcagttagtcaaggaaagaagcatttgtatctgccaatgcttcatgtctttgataaaaaaaaaaagaaaatagaactcagtaaaaagagaggttaacagcaattgcagattatgaggattgtggatgcaggttataaggttagacttataaattgacttacaggatatacttaggaatggtaaacctctcccagaataagtctcagtactcctttattttttagacctttcttgtttcctggaacaacctcaatagtacaaatacaaggaataacaacatttactatatctacttttgaatagaaccttagatggggggtcttttcttgacttgaaacgagtattgaggcttgaaaaaattgtttaatttcacatttttatatataaccagccagttgtagggagaaaagaaacaggtaactcttattgcagagcttcctgaggaagggataaaattacagggaagaatatagctaatatcctgcatagcaggtacccaaggcatttgaaagcttggattttggccgagtgcagtggctcacacctgtaattccagcactttgggaggccaaggcgggcagatcacctgagatcgggagttcaagaccagcctgaccaacatggagaaaccctgtccctactaaaaaaaaaaaaaatacaaaattagcccggtgtggtggcacatgcctgtaatcccagctacttggagggctgaggcaggagaatcgcttgaacctgggaggcggaggttgcggtgagtcaagatcgcgccatgcactccagcctgggcaacaagagtgaaactctgtctcaaaaaaaaagaaaatacttggattttatttgtatgttttggcttatgaatattgtagtaggttttatgatttaaatatgttgtgcaatgacaatttctgaaatttggaaaatttagcagttgtacttgtttcataagctaactttatacatttggtttgagtaatctagtcatttcaaatttaaggtaattacaatgttcctgtcatacatagttcctcttttacaaaactatatcaggaactatatgaactacatttcattatgtagtagtgtattctataaccttaatcatgtgtacatattttagtacctaaatttgcatctgataattcatttttcttttctcacagacaaactttccagaaatgatgaatagatataagcagctattgacctatattcggagtgcagtcacaagaaattattctgaaaaatccattaattctattcttgattatatctctacttctaaacaggttagactcaattttcccctcttgggacgatcagtgtgtttattatttatagtaagggctttgttctttatagatggaaaggcctagagcttctatttaagtagttgtgctagttattagtatgctttaaaaatgataagtactattttcctggttatattactgattatataatagtaaaaggtaataactccagcttgatctctttaaataatgccttcagatgctaaaatctgtaaacaacttttcaggcttatgttagactcctatacagttgctaccacaggtccttctaataaactacattaacactttagctagccattctgaggtgttaaatacactgaatcacaggttatttgtgtggatttggttatattaaaatctttgagaagtgcctgtgctcttatcagttagtgtttggcattactcaacaggtgctcagtaaatgcttctgcaaaggatgggtggataa

SEQ ID NO: 79276 - DNA, 1012 bp, Homo sapiens
aaaggatcaggagatgataggactaggtacaaacatgaatcttagatcactaaaggagaagaacttttgagagaaagatgaagttgaagctcagatgagcagggagtgaagcagttggaaggttcaggaactatggcaaattgaagaatagctgatatgttaccactttctttttcccctgtttttgtatttcccatatgatatgtttcctccacctctccattagcttctctatcccgtctgactagtacttgtatccaggttaacttctactaatcttgtacctcttctttttgaggtactgtcactctggtatggtttatctcacctttaataggaggggcactccatggcatctcctacagaagctgttgacaaaatgtctttgttcatttcttccccaaaatacatcagaacaattcaaaacatgttaaatgttattaagtatattgtatattgcacttaaatctagttaaagaatgaaaattatctacattatatttaccctttctactcctactgctttgatactctcaaaacatttctatgttgcccagagccccatgctttctttccattttctgtttgcaagaatattaaacacaaacatttactgtattcagattaataacttagaaggctgtggaagaagcaccaagtgtttcaagggacagaaatttgtgattaaacaattatagtgccattaggggctgaatgtttaactcgtaggttctgtgatttgagataataccaagagtccctatagaaatctgctattttaacgtactagcagtggtttcgagtccatttgaacactgtgctacccttaagacttggttttgccattttaccttgagcagagtgggaaggaagggagagggttttttgcattttatgttattttgtttaccttatctaccttttgtttgctgtagcagcatctgtgaataagttatggttcacaagagtgatttcagcttctgtacctgcccctctcgttttctgattggac

SEQ ID NO: 79277 - DNA, 2668 bp, Homo sapiens
aagcctagattacaagggttaagaagtaaatgaataattatgaaacttatttactacctagtttcatcttgtccctaaaagaagtgttccaagtgattttcatatgttaaacagaatggaattccaggtcttaaatctgtaagactgacagactcaggtcttcacacgaggaaggaattatcctccagagggcgcacattacaaagccactcttgattattgaaaaattcatcttgtgttaatgtatttttgagctttcaagtaacttattatacacagcatacctttcttcactcctatgcttttatgagactgtaacagaatttttcataaatatctcataaagaaatttgttacctgtatttggatttagaaataactataaaactattcttgtctttttgtgtttgtttccaggtactattcttaatttgatataaacttgccctttgtaatgacttaaagctgagaaggaaataatctatatcttatgactcataagataataatttccattataccaatccatgtgtattttgtaatcctcattattaggttgaatgtcctggaactgtgtaacactcttgtttatactgctccacaaaatagttgttttattccagttttcccttctgccttgttttttttccactaagaattgaactcatgtaatagaaagtctcataaaattatataaatccattttgttttatttattttgatttgttataaagctgattaagttaacattagtataaacagctgttgtatagtgcacataaggaaagtattcttattaacataattatatttagtgctagatgactttgccatgtgtagattaccatcctagctggttttaaaccgtgttacaataatgaaatttagacttggggaatagaaaaattagattacagaaccaaagattaataattagaacacatctacgttaggtttccctcagatttcatgactaacgaaagcttagcaactacagaattggggtcattaaccaatattaggttgcattcttcttttatgttgattctatagaaattttagctttcatctgaaagaaagtaatgattatattctgctatacacttgattttgactcctccttcctcctctcttcaacccctggttttatataacagttgaatatcagtggcattttacgtatgtattcaaggttgttttgttttgtaaaaatatgtggtttttctgtcttaacagcattcactttttacgttgctacgtgtgggtttcttttctttttttcttttaatatttctttctttccaacacaggaatactctgaagatagtaactccgagccaaatgtggatttggaaaatcagtactataattccaaagcattaaaagaagatgacccaaaagcggcattaagcagtttccaaaaggtttatattcttttccatttgattctatgtgttaatttttttaatgatatgctagaacaaataagtcccaggtgattttatctcagaaatgtgttttgaatacttaattatcctatcagttagcattaggcagcacaagcaagtgtttcaaaacggttatcctgatgttttttccaatcaagctgtctatggagcagggccattgtcctgaaaaactaggatggttctggcagaagaaccaccaacatgatggtcagtaggtattatcactgcaatcttgtttcttttaggggtaaatcatacagttgtggtttcattattatgaatagcttgatttcttgacttactgatacacttacggattatttttaccataggttggttattcaggggaaaaaatatttcagaaactatataataatcaagaagtggctctttattttgctgatgaaggaactttaagcttgcttatccttatgtaggcatcttacaacttgttttttttaaagactgaaaaatgacattgagaaatggtggtatccttggggaaatgttttttatgcatatagtataaaattaattcaatacttacacattgggcatcattagaaaataatgtgttaatattaagataaactaaaaatttcttcctctttttaggttttggaacttgaaggtgaaaaaggagaatggggatttaaagcactgaaacaaatgattaagattaacttcaagttggtaagatttgttttgaggggaattaaactaataaattttgtaggtaaaaacctcatcacgacaaagtactattatatcttcttttctaaagtacttctttggatgtgtttttatatttagtctgctctgcagttgggactatagtaatactaagtaaaaaaaacaaattcttcataggatacagaagttttctatttaagaaaacttactcttttagatgcatttacagtatttgccttttttttttttcccccgctctgtcacccaggctggagtgcaatggtgcaatcttggttcactgcaacctctgcctcctgggttcaagtgattctcctgcctcagcctcctgagtagctggaactacaggcacatgccaccatgcccagctaattttttgtgtttttagaagagacgggctttcaccatgttagccaggatggtctcgatctcctgacctcgtgatctgcctgccttggcctcccaaagtgctaggattacaggcgtga

SEQ ID NO: 79278 - DNA, 1061 bp, Homo sapiens
gatcataacaaggaactgtctatttgtagtcaatcagtagaacatcagttgtgccgattctcatgtatttatatattttagcaataacatttgtttaagagttgaattgcagttatgcaaaaacattatacatgccatttcttaatccgtatgatatgaaaaaccaaaagaatgtagtcacaaaacgaagagggctgaatcaaatcttttctcagtcattgtgatttttttttttttttttttttttggagttgtaacatctaaagtttagaaatctctatctgaaatctatcaggtcccagaagttacaggtaactactcttattataagtattccgtgactgaatgacaagacactgtgtgacatatgacaggaaatgtcaaggatcctgtttttaacaatgttataattggttcagtaatttccagataattgaagttaatctcttccctttctaaaatactgtttctcatttgctgggaagctccaaaatactagtcctactgttgtcatgtatacctttcagcttctactttcctcttctcgaaacctgacctaattgttttttctaatttgttttgagccaagaaaccaaaaataaatggactctgaatttttactttgtgatcaatgtaaatcagaaatacttttcattttacttccaggttcaaggctgcattctgaaggtttgggttgcaaaaaaaagtaattttctggttcagcaagctattcctctatcttattcaacactgttaagtgaagtttttattttagttattgtatgataaatcatatatggtaaatctgtttatatttgttccaacttaataaaacaattagaaaagagctgatttccgaaggcatagagtaggttttatagctgtgattctttactccaagtcttccctaaagaatacccttaggctgagatctgaaatgataagcagtagttaactagatgaagagaggtagaggtagaggtggaaagagagagaaatagcacataaaagtgggagaatttggcacttgttgagttaaggccaggatggctgcagcaaag

SEQ ID NO: 79279 - DNA, 1050 bp, Homo sapiens
aacacccaccgcaatgtgtgggctaaatgcacacgtacaatgatagcagaaataatacctgtcatataggacgggcatgtcagccttttctccgcgaaaggcttctggtcctaagctgtcccttactttcaccggaatgagatgcgtccagagtcccaagcaagggaggagactgctcctttacccaggaggctggaaactgctcgatgcgagcgcagtttccgacgcccttcggctgagacctgcagcaccggacgatgtcccagttgccagctttagttgctaaggcaccaaccacttcggaggaaacggggggtggtgcagtctcttttggagtcgtagcgaatcagctacaagtcgagataattagttccggcaggaaacagctcctctaagagggactggaaggcggaaagaagctgagagtgacgcctctgagccgcggaggattgtgggaggaggttgtctccaatttctcctccccctcccggccaagatgtctgacatggaggatgatttcatgtgcgatgatgaggaggactacgacctggtgaggcgcagggaatggaactctgagggtggtgatgtgtcttgttttcggggtccgggccggggcgcccgcggcctctccccgtagagcatgtgccgtttacagcctctctcagtgcggtgacaggactggtttacctcctccccgttcccgcaccgggcccgggccctgcttctccagcatgggggaagggagggcaaaggaggcagcgaagggggccccgggccttgccctccgagtctgagcgcctcttcggtttacacggatgcccctggtcccaggcgttcggttctctgtcttctgcctccccaccgcgctagccgcctcggtgaccatgctgcggtgtaggccctggctttgccctttcgggcccagcgttccgggcccccacttcttcacactggaactgagcgggtgcgaaatgctaggagaagtcagaaaacgggggtgtccttactgctcccaggcctgactgcgaaacgcaacttgtgagtctcctg

SEQ ID NO: 79280 - DNA, 1055 bp, Homo sapiens
ctatggtcttcttttctcccttcttcttttttccccctattatagataacttaaagtttggcatttcgtcttctagttatactgaagacaaagtttttgtatacttttatttgttcttgttttgttttttgaggatgtatagagaaagatttaggcagccgcatctaccaggtagtccagtagatgtattttgagtgatatgctagcgatatcagttattgtctccctgctgcaatcttttgttctcatccacagcctctgctgaaggagtaaacacaagtgaccatatttgtaactaaaacaagtgaccttatttttactaaatgacctcaccctttggccacagatgaatttatctttcctgtatggatacaggacctaaactctgccaagctgattatatcttttgagaatttgaacgaaaggacacagaaacgtaatcagttagtataggatgctggagctgttaagtcttgtagagtcaaggccacagtgtcatgaaaactgaaggtatggaggagcagaaactaagaggttcacagaagtaggtggaatgcagagtactcagcagagagaagtttataatggtgtctttggagcaacaagagaatgaggcaggaagagagccaaagaaactggtataaacagtttctgatgactattcaattcccaagagacgagcttgaataacttccaacaatattcaacatatttttctattattttattacattttcttgaggttttttgggtgtgggtctctgtttcttaattaattaatttcctgaatatattaggctttaataaatgtttatcatcctggtgttattacccagatacaatatgatgtgggactacaaataatgagggctattcacagaattgacttgagataatttgagagtatcaagttattaaatatattacaagaattttggatctggaagggacctatgaggaatatctagttcaaattctcaaattttagggaagagaggccaagagaaaatgatttgccgaactttgacattgaattagaggtctcattagaatta

SEQ ID NO: 79281 - DNA, 1020 bp, Homo sapiens
gtttgaatctgggctcttctcagctgtggtaatttaacctcttaagtctcagatttatccataaaatgatgtcattgctatcctgacaaagagttgttaaaagaattacataaagcttgatggtagccatttaataaatggtagctagtattgttattgctacttcagatgggattaaaaaaagatataatgaaatgtattagtataagtattttccaagaaacattgaataattactttgaaaatctctaatgttacatacaagaacaagaaaataaaatgttttcactctcataattgaaaaagtatcaaggaccaaaagaaaattgatatttgctgtttttagagccacttttatattgcaataattattttagatgtagtgacttgcatagaatcatagtaggacaataagaagtaaattttgcctttgtgagctaaaagtaaacaaacaaactgacccatgttttagagagcttgtgttccttactgcctggcagtcctatctgaaactttgtaatgagcagctaggacttagtggcacatccattacagaaatacatcaaatttatttctaatgtgtagtcctatactgtaacagtggtggtttttgttcttaaagttaatgaattcatttctttctttcttttgtgttttcctttctctcagacacatggtaataacttacaggaaaagttattggcaggttttaaatcttcaaatcatctggcttatcatatgcattagtgggaattacagtatttggaagcatttgcctggcaaatgcaattttaatcttccttgtaacaacatgcctttttgcagcatatgggtaaagtggcctaaataatgcatgttgctttgtgttatttttgagcatttcaggttttaaagccttcctgtttggtttgacaatttatgtgcaaaagcaaacttatacaatgaacttttggcagaaaggtaatttaaatgctagcctgttcagaaactttcaaattcaaatactagaaagtttcagag

SEQ ID NO: 79282 - DNA, 1046 bp, Homo sapiens
aaaatgttaaaggaaggaaaggctgggaaacaaagcactgggaggggcccaagggcatttcaggcagagtgaacccataagtgtattttaacagttctctgagccagacttaaaatatgtgtcagccaaggcctagaaattctcttgcagcctcatgaaattccttttaaaactttttgactacagggatgctttctagttgcttaagtccctgaacagatttacttaacttcatttcaggggcaaattagttatatagacaggggttgatactcttttcaggggagtgtttttgaagtttgaaacctgttctgtactggagacctctaaggttcataaacagagtaagtggaatgttcaaagttctgtgccaaatatgtccacattttcacttttctgagtttacaagtgctgtttccttgagaaagtacaaggctgtatttttcttcacatatagctgcatttcagtgaaatatttcttggccttcagaataagaccttgtgcctaaagaataaagacatgtctatgttataaaatgaaaaggatctcaaaattatataaactatgatttgaatgttttaatagtttgttacatggtataagaaaaatcagaaaccaatttgcactgtcactaattattatgcttagaagtccacataaggacattgtttcagtttgcttagaataacaaaacctcatccatataatggttaaggaaaatagtagtttaaaccattccagccagatgttgagtgctaatgaactgcagcagtatggcctctgaaaagatggtaaatccagaatacaagctttgaaaagaatctcttaattaggtgttgaacatggactgaagccatgtgctcactggtacaaaaaccaggaagctatagtgttagctctgggtggcctgtgtttaaatgtgttctaagttttaggttaataatgtaaatacaaaaccattcacgtagttttgtcaattaaaagagatcctctggttgtatccttttttaggagtaggattggagactgaatcatttctttaatg

SEQ ID NO: 79283 - DNA, 1040 bp, Homo sapiens
ggtgaaaccccgtctctactaaaaatacaaaaattagcctggcgtggtggcgggcgcctgtagtcccagctactggggaggctgaggcaggagaatggcgtgaacccgggaggcggagcttgcagtgagccgagatcgcaccactgtactccagcccgggcgacagagctagacactgactcaaaaaaacaaaaacaaaaataaaacacaattggacatatattttcctgtttgcctcaggcttcattactccttaatgttgaattggctgttttagaggaatccagattctttaaattctctttccctgaacacttaaaaaatggtcttgtattctatagtaattataacttgtctttacatttggcttgggacttggctgcttttttatgtaaatcagatgattccttattcatcatgtaaagataacaccaactgtgtagtactttagagcactataaggtgcttttatttgaagttttaaactttagtttcttggatcattacaataatcctgtggctagggaggtgggtatttttctccttattatggataggaggtaatatatggtggtggttaagattatgggtgctggagtcagatcatttgagtttggattatatctttaataattactagcctagtctcagctaataaacccactcagtttcctaatctgtaagccacagagacctattttataggtgtattagtccgttatcacactgctgtgaagaaatacttgatactgggtaatttttaaaggaaagagatgtaattgactcacagttccacattgctggggcagcctcaggaaacttacaatcatggcagaaggcaaaggagaagcaggtactttcttcacagggcggcagggcggagtgagtgcaggcaggggaaatgccagacacttataaaatcatcagatctcccgagactcactcactatcatgagaacagcatgagggaaaccaaccctgtgatccaattacctccacctggtcctgcccttgacacgtagggattatggggattacaa

SEQ ID NO: 79284 - DNA, 1076 bp, Homo sapiens
ggaggaagatgagcctgatgagatgacaccagttctgattcttacatttaatggaaatgccagagagacttcattacttttggacaggaaaataaagtttaatgaccccactttggttatgggtagactgtggaatagtagttcactgttgggagacaaaggaagctgaggcaaaaatgaatgattgcccatatgagattttcagtgataccagtctagggaaggatagagtaaatagaaagatggtagaaactgcttgctctgtggagactattagggatggcgaaaacatagtgtgcacggtcaatatcttattccatacccatagcagacattgttaattgattttggtatattttcctatagtctggagccctttttaatgcagtgctccaggcaggctactattagttgatcagagttggtgctggaattcaaacctgtttgtcatgcctgtagtaagaaatgaatgagaaatgggttatgactactcacagtacaaatcagtttttacctttccaggtggaacttgcagaaatctgtgccaagagtgagcgttacattggcactgaaggaggaggcatggaccagtctatatcatttcttgcagaagaaggaactgtaggtagcattccaagtaggaaccattcagaaattcctagtgggaaaatttacatggagaagaaggccctgagagccccaggatgcttggttatggacagcctactatattaggctctattgtaggatattatttcccaactgcttgtaactcaaggctgccaccagttaatctactctatttcatgttgattgcctttctcttacgcttccagaatgatactcaggtctgtttttctcatgtgtctagctttttcccctcttctatttttcttcattgttaagatgagctttctcaattccctagttattggaacctcatttcctgctcctatcctaaatcacttcatctcatgcatttttataatctcttgttggttttaaacccaaatcatagttctcttaccacatatattcacagtccctctttttataatttactctttggtatcatt

SEQ ID NO: 79285 - DNA, 1033 bp, Homo sapiens
ctcaccacttctcacccctcaaactgtaagctctaaccaaatttccatgcccgtagctccattaacattccatgttgttttttgcccctggacttgcctaagttcttccctcttcttgacatgctttttgaggaaagaaaccctctgtctgccctacttttttcatcttttagaactcagtttagatttctctttttcaactgagtggaacctacagtaggctgtactgatgagatgcttcagctatgtatccatatagcatctgtgctttgctaccattgtaacacaacttggaaaggtatttgtctgtctactagactgtctttcccacttgattgcgggctctatgagaggaatgacagtgtctttcctgttcactgttgtatttccagtgcctagtacagcgcctggaggtcaataagtaatatttgaatgaatgaatgcatttttgacaaaacactttaagataaatacataaacacttgaacattttctgcattctaataaattatatttctcctttcatttttcttctaacaggccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaaggtatgaacttggcaggctagtgaaacttgaagtagggtttttcttgtctttattttcattgttctctattactttatctctttccccaaattttagggcaacattctgactgcacagcattccaactgaaggtctttgggtacagagaaatctgatttctaactcagaagacagatgaaccagttgagtcttctggggtggcactgggaagaaaagggcagcttatatatgtgaagcagaattataggttaggtctatgggtggagaaagatagttggggacaattgatgggaatgaccacagctggtcttgtttcctcaacaaaagtgatggcagcctc

SEQ ID NO: 79286 - DNA, 1045 bp, Homo sapiens
acaaatattgttcagttctggaaataagaggaagtggaattatttctgcagagatcaggaagaaatgtctttgcctggaaggaagtgggatggttggaatcccacctgaaaagctgcggaagggcatttgccagcttcctggaattctctaataaactttctcttcctagagtggtcaacctgtacttgttttcatggagcttacattctcgtggggaaagagagaaatgacaattaaaaataatttgaatggtagtgataagtgctatggaaaaaaatgagaaggaatagagactacaggtttgggtgggtactctttctgtggagtggttgaagaaggtcactctgacgaagagatctttgagcagaggcctgaaggaggtgaataaatgagaacagcaaatgcataggccctgaggtggatacttggctgtcaggtgtgaggctcagcaggatcagcatggcagagggccaggaaggaaggagaggtagtagatgaagtaaggaaggaagtggggagccacaccatataggccgtgtaggccatcggaaggcttctggctttgagaagagaaagggggcaatggaaatgctaggcaattctatgccaaatatgcctgcaaggaagacttagataattgctgtgtgggtataagagagaaatcaagacgactcctgggtttttgtcctgagaaactttccttgtgcctctaaaagccacatttttgaaaagcacacttcaccactgtaggtaagagttatcttagagtaccataaaatattagatcaggaaggggtcttagagatccaggaaggcactaagagatgaaataatttgagtaagtttcacatatgagttcattggaaagcctggctcccaatccaatgattttgccacacgtgcctctccccttgggttatactaagatgtgattacacttaaatgtgggtcatacatacgtgtgtgtacgtgtgtgtttgtaacctattttcatctcctagctttgaagctttatgatggaggcctttgttgtcatagtttcca

SEQ ID NO: 79287 - DNA, 1077 bp, Homo sapiens
tgactttggctatattgggtgcctggatagttaattctgtgaatacacaaggatcaaagagtaacattcctcataatctccatccctcatctgccctagcctttgccatcgtgctttataaagtagaggctgcctttgttgctttaacaaacccttctacattattcccaatctagtcatcacaatcatcaaagtgggatccgagggattttagggttttggtttttgtaattcttgtattgcctctctgatgtgcaatagctcaggagatatatttttaatgttttattgttcttccagaaaaaggcgcaaacatgaaaagttcactaaacacccttggttcacttacttttctttcttaatttaaagggtatatcggtctcctaactttcggtcttctcagaatttctatggcatatgccaaagggcctattaagtaccagcagggaacactgcagacagacctttctgcctttataagtgtatacagctgcgcaggctgctgaccagctgctggggcagccctgacttgtgatcagatgtgccactgacttgggggcagaaggctatttctaatagcacttatcattctttatttgggaaatttgagccctgatttcagaccatgtgattgatgcaattcagtccattttcatctgtagcaggcagggtggtgacagagcagctctggagactcagtagcaaatatctttacctacaaagacttccagcttctgctccctggaaactagtaaaagtctcaggaaaatagacctctggcccagttcctataggttttacagccagattaaaaataatactctgtttgctttaggttcaattttgaaaaaccacagctttcaaaaactgttcaaatgagaaagtataataaaatatgccttttagaagttggattgaggacccttaaagacttgataacttgagtccagcaaaacggcatattttagatcttagaaaatcaagtaagaaggcacagtattcttctctagaccatgtcatggctggctttaatgcccatattttagggtcttccagagacacttcagtgacacctca

SEQ ID NO: 79288 - DNA, 1047 bp, Homo sapiens
tgaaagtgactatgaaaagacttaatgaattctgggatttgtaatggtattgatgggtatctctgtatgtatatcaagagtgggcagaaatgtttggctggtgatggcaaatgactggctttctcttgtggatggactataggaagcactttctgaattatgtaatgatttggaccaaaaagtattttgctgaaatactcaggtaattgagatagcaatggttttatggcatgaattatccaaaaaaatatcagaattacttattattctgtgatttcattagctcattaatgtttaactcacagattgggcatcaccatctagaatttcagtttaagggaggcctgcgcaaagctagttttatttcttaaaggataacagtcatacatagaatactaggaaagccaatattctatttaaaaataaacttctgatgcattttcattcttagcagaaaggtaaatgcttgagaaagcttgagtcaaatttgttaaaagaattttgagttctataaatccaaaaatctgaaacctgaatttatttaaatttataatcctttattttttaataccgtgccattttccacaaaggatttgtggttggtatataattctttaaagatacctggatcagtgtaaaaaaaaaaaaaaaaaggcacctgtcattgttttgctgttccatttacaattttcaccaggtgatttcttcttcacaaaaggtgagtaaaaatttccaatgtgcactcttctttgggggacacacatggtcattctaagcgagggatctattctatatttgttttgatttctctcgataaaaagaactatgtttcagtcttactatcactgtgtggtatctagatattatgagagatgctaaacttacctggaagggatagggccggggccattagaaaaaagatcatgcagtaaatggactttgagcatggccctaaaagatgagtagagtttaaaagctgtggagtgcacactgcagatgagcaaagcctatgggtataggcaaacatggtgtgtgtaggaggctcag

SEQ ID NO: 79289 - DNA, 1088 bp, Homo sapiens
tcgatacttccacttttgttgtcagaactctccccatggggacaagatcagagggtgaatttagattactgctgcaccaggcagtccaacagcagacagaggctatcattctgcacctgacagaaataacactgctctttaagctgagtattgaggtgccgagtgagagaaagcagcagtgcactgggcactcagtgaccgccttgagagacagatgtggaagacagaatccaatccctcaggataattttcatgcttttggtatccaattactaaaaagttgtgctcttcccaataatagtcaatatcatctactccttttaagaatttcttgtcataaattgcctcacttgattataatgaagcactgttagttccatagcaagaaaagggttagccattctgaaaactggccaatgatttggcaatattctcttttggactgttagactgtgatgggatatggcctaacaattggcaaaaggcaaataaacacagcgttgctgaatttgactttggctacaaaaccttcagcgactcatttgtcaacaattctttggataggctcctacttaacaataatgtgttagaagctagcaaatacacatattgcctctgaatatggagatggtaaatttgcttatattctaaacagttcttagcaagttatctaaaagaacaataattcacattatcagaatcaaaaatagcaatgtaaggacaacccctgcctttaaaaaaatagataataagtaacatatctacgcagtcgaaccaaaatcctagcaattatagacaaggtagaatcttgtagaactggtgacccgcattcccttaagtaacttgttagggctttaaattatgaagaatggataaactgctggggagcagatttgaaaatattagccattctttgattagtttttaattttataatcttttctttttggctatcacatgtgcctggcacttatgaagtgctaataagttcattcattgccacgagtgcatctcttatcatctcttttctcttttgtaaatcctcatctagactgacccttatgactcagctgtacaataactcttta

SEQ ID NO: 79290 - DNA, 1025 bp, Homo sapiens
gggcatagtgaagaccaattctagaggagctgtggccctccatgacacccatttttgttcccacctgactgccagctaatccatgcatgccaaaaactataaacagaaaaaaacagtaattcatagttgatattggtttaaggaatatctgcattagagacaaaaagagaaaaagtctttaataattaaatgagctatactagaaaacaagcagtggactgataattttggggcaggggtctgcctactaatattgatcctggagttggtgatcagcactgaagggaggagagggcatatgcataggaagagagaactggggagaagtcaagaaagttggtgaatccactctcaattcgttttagtgccagtagcctgatcttcaggagtcttttggtatcttacggggtctctaactgtacttctgaccataggcctagtttatctggttcatattgaggcagctctcataggaaggtcacttgtaggtgttacatagtttccgcctttgtttgcatgaataatgaagatatgcaaaattttaaaggttaatgacttttttttttaattaattcaaccaagttatttatacctccttttgctagactaagaatgcaatagtaagcaaatatacagtccatgcttttacagaattaacagttgggagtcaagggagaactccaagtcagagtgagtaagtttagggcacatcgcaggttgtcaaacccaacacaaggagaagggcatggaaatcttttctgagaggaaatagcctgaaggatgaaaggacaaaagatagaggacagatgtattatcctcagaggaaatgctttttgtagatgtttggtagtaacagtactgcaagattgggaaatgaaaagtgatttaacatctttccaagtatcaatgctaaactcaccaaggtaaaggttttttttctattaaaaatataagaacatttactctttattaatttgcatgcttcgaatgattgctatgtttattaaaaacataactaccagcaa

SEQ ID NO: 79291 - DNA, 1097 bp, Homo sapiens
aaaaaacagcccactttcttcctatggcaataacttaattgcatatggtatataaagaaccagttccagcagggagatttctttaagtggactgttttctttcttctcaaaattttctttccttttattttttagtaatcaagaaaggctggaaaactactgaaaaactgatcaagctggacttgtgcatttatgtttgttttaagacactgcattaaagaaagatttgaaaagtatacacaaaaatcagatttagtaactaaaggttgtaaaaaattgtaaaactggttgtacaatcatgatgttagtaacagtaatttttttcttaaattaatttacccttaagagtatgttagatttgattatctgataatgattatttaaatattcctatctgcttataaaatggctgctataataataataatacagatgttgttatataaggtatatcagacctacaggcttctggcaggatttgtcagataatcaagccacactaactatggaaaatgagcagcattttaaatgctttctagtgaaaaattataatctacttaaactctaatcagaaaaaaaattctcaaaaaaactattatgaaagtcaataaaatagataatttaacaaaagtacaggattagaacatgcttatacctataaataagaacaaaatttctaatgctgctcaagtggaaagggtattgctaaaaggatgtttccaaaaatcttgtatataagatagcaacagtgattgatgataatactgtacttcatcttacttgccacaaaataacattttataaatcctcaaagtaaaattgagaaatctttaagtttttttcaagtaacataatctatctttgtataattcatatttgggaatatggcttttaataatgttcttcccacaaataatcatgcttttttcctatggttacagcattaaactctattttaagttgtttttgaactttattgttttgttatttaagtttatgttatttataaaaaaaaaaccttaataagctgtatctgtttcatatgcttttaattttaaaggaataacaaaactgtctggctcaacggcaagtttccc

SEQ ID NO: 79292 - DNA, 1092 bp, Homo sapiens
ggcggaacttcccgtctaaccccccccccgctgtcgtcccagcctgttgcttaagccgcgcggtgtgcggtgtgcgcggcccctgccttagcaacgacgctagtaactgcctggctcctccctctggtgtctcccggaaagcgctccgtctggtccgtgcgcgatcacggcccggcgcgtggctcgggctcgggcggagctggagacgtgtggagctgttcgaggactcgcgggtgtgcaggtctgagtaccactccgatccctggtggaggtccccgcgcctctctggagaccagtggtctggccccagaggtgcggccgcgggaagtggacattctttgtcaggaccctagcggaggtcgcgctgggtgtcgcctgtgagggggatcctcggtttctgcgcggtctcttgctttttttaggatcttgcgggccctttgggaaaaaggtttccaaatttttcctcaaaaaaaaaattatttttcctaccaatgattttcggtgcattccgccccaacgaaaagtatgtcctggcaaagtcagttccctaggaaccccatactttattttattttatttttagtatttggagtggtttgtgggggtttggttatcacggaaggggaagcgtagtacagacgtagaattagtgatgccatgcagtgtatttaaaatattgaggttgtggttacataataagcaaaagagcctgtttcttacgtctaaattatttattgggaatgtaggacaaataaggaagtatattaacattttcagtcgccaggcccacaaagttggatggtaaaatcaatactgtagatcgcagcatgtaaggactaacccagtgcaccatgaaaacgaaggcaagacagtttgttaccatatggcgggtggtgtgggagaggccattgatcctatatgaaaaagggtactactaccttggattatgaaaaatgaatgttggacctgtaggtcctatgtgaccaagttcttaaaaacactctaaagaaaattggaagtggtttttttctaatactgaattggtccacaatataggacaggggagtctgtatagtgttccattgggaggtg

SEQ ID NO: 79293 - DNA, 1019 bp, Homo sapiens
ttttatatgtatatgcacacatgtacacagacacactcacacatatgtagtgtgtgtttaagttggagagggttatatcttttagaacataaccaactaaattttgccaattccactagaatcttctatttttcattaatgtcaattcaaagtcagagccaacagggttgaatatatccctgtctgatgctaacgtgaaaccattgcattcctaatatctggaaaacaaaactgccatctctggaacaaaaaagggttcttgaaaaatggattctcagtacctgaactttatatttgaaataactttcagtttattgcttttaatcttatgttttaaagtgtgccaatttggtggtttaaaacatgtttaataagtactaaaacagcacacaattgtgacttaaattgagtaattttctttgtagactgagtaaaatgttttctgtttttatttttccttctcttgatactttttttttacagtgcacctatgatatgtgttttagaaatagccgttaaactttggtttgaatgaagaatgtctctcaatccacctatatttctcaaacgaagtgaagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaaggttagtaagaaatttaattgtttgaaagtatgaaaatagattttttaaaaacatctcatgtatacctactctaattgataaacttaataaataatgttattattgttagaaacaagtgcttgttgctgcaaagaaaaactagcacttagacagaaaatttctcagcagggcacatttacttctgcagaagggtgctgcgcctgatcgcaagagcaca

SEQ ID NO: 79294 - DNA, 1053 bp, Homo sapiens
atcatccccaaaaatgctgattcagtaagactatgttggggcccaggaatgtgtatttttataagaaaccccaccgccaaccctaggtgattttgaaacaaatggtctgaggactaggctttgagaaacagtctagtttcccattgtttttcattgttgtttgtttgtttgtttgtttgtttgtttttgagacagtctcgctctgttgcccaggctggaggtgccgtggcgcgatctcgactcacggcaacctccgcctcccaggttcaagccattctcctacctcagcccctcaagtagctgggactacagatgcccaccaccatgcccagctaatttttgttattatcagtagagatggggtttcaccatgttggccaggatgatctccatctcttgacctcgtgatccacctgcctcgtcctcccaaagtgctgggattagaggcgtgagccactgctactggccttctcattgtcttatagctgtataaacaaaggcctagagggatgatatgaattgcccatgatcaagtggatagttaggaacagaaaggtagagatagaacccaaatatttttttctcacttacgaggcactgtttattctatcacaccatcttgaacatgatacataaatgtcagtttgattccatattttgagtttcagcccagggcttgtggactagtaagagctcttgagctccatctgtcagtcaaattctgcagtatatgtaaaggaccagcacagaggcatttatcatgaggattgatccagttgttatgaatttgggggtttctttataacacttaacaggactcaaccctatcaggaatttcagtactcaattactcttttcaattttactatagttacagaaagtcaagactcataaacacttccctgaatcaagcagcagcactgtttcccagagaatatgactttctctctgttgtacatttcaggatcgttctccagggcagggtatgatctaggtaatcacatgggaaaattgtctccaaggataagaacctgtatcaatgttgtaactaat

SEQ ID NO: 79295 - DNA, 1150 bp, Homo sapiens
cactgttcgccctatgggaaaggaaaacttgagtcatactctttcagccactggtgagcaaaagcttaggtgagaaccagacatcttagaagcctccaggatctcccatttgtgcccacaaacatttccagccttaatcccttttgctgatgtaataagattcttcagctggatgatgaaaactgagcccatggtgttgtgattatgagctcagctacctgctactggcaggtgatagctgcacctgtgaggctggtcagcttcccacacacccagggtgcctgcggcctcctgcaccctaagccctgccctgacctggccactaattattgaacagggagtgaggtttcctggtagagattatctattttactgccaggattatgctctatgcaaagcacaggtccaggcactggggatgacatagagatacatgtacatttggcctcaaaggagtttaccatttaatgagggagatagataatcaccatccaatagacaaggaaataaacgaagtgggtaggagaagggctgctggcgggctgcatgtgggataagtaagaccttgggtctacatgtgggaatgctgctttggagcttccattgcaagcctgggagcaggtgagcacccagctcaggtgatcttctttaagcaaaagcaagtcttcaaatatgtgtgatgttttatccttggggcggcagtgggagggggtggtctctgaatactgacagtccttatggaagaggatagtgccttgtgggcagggtgaccctacaattcagtatccaaacagggacacttgagagtgaaggtaatgaaagataaccagcattccaggacacgtatagccagggcttgccctggcaaaccagacatatgatctctggacttaacgggagcttggtaattataaagcggggtagagtcagtgacctagggaccagaagagaatagattctggctgggcacagtggctcatgcctgtaattccagcattttagggggccgaggcaggaggatagcttgaggccaggagttcaaaatgagcctgggcaacatagtgagaacttcatctctacaaaattaataaataaattagccaggtatggtagcacgcacctgtagtcccagccactcatgaggctgagg

SEQ ID NO: 79296 - DNA, 1050 bp, Homo sapiens
acgatggcacacacctgtaaccccagctacttgggaggctgaggcaggagaatcccttgaccatgggaggcagaggttgcagtgagccgagactgcaccactgtactccagcctgggcaacagggcaagattccatctcagaaaaataaaaataaaagtaaaataattaggccatatacaataatgtacagtatatgtgtgtgtggtgtatgtatgtgtgtctgtaatatatatgtacatataattcacaggtatacatgcatggaaaatgatacttcctacagccagcttgttgccagcaggttgtatggcattagttttaagagaaggttgatgtataaatttgacctctagcacataaaataagtttactttcttctgtcttaggtgaagttggacttctggtttgcaaaatcacacaacttacaccatttaatggctatgctggagcaaaggctcagacagagaagaaaaaactgagagatgtctttaagaaaggagacctctatttcaacagtggagatctcttaatggttgaccatgaaaatttcatctatttccacgacagagttggagatacattccggttggtttttctgaatcattgagccaaaaacaaacacacgcacagtttggcttactcctagtggaatcgcattccactttggttatggtgcatttccttctctatctttggcacatcaggtcaaactcctgtgttcccagagaatgaggaatgaagtgcatgaagtgtcactctgcagtgcacggttaacttggctgagcaacaccagatgagaataaggcaggaaacctgtatctgatttctggagacaaaagtacatttaactcctcttgtttctcctgcattattactggtcactcttaggacagccaaggattttcacctttccaatcatggaggtgtttagataaaatcagatgcaaattaatgtggagctgatctagttgaagaggaggtgaggggttcggagccccttcccccaacccctttcatccccaaccagatggtttcccacagaaccccca

SEQ ID NO: 79297 - DNA, 1259 bp, Homo sapiens
ctccctgtaactaaagtgtgattttttttttcctttcttgttgccgtgagaccctgaaataaaatatgaagttctattaaaaagaacttcagaaactgaattaagtagcaactgagttagtaaatgagaaattgagagacctaaacagcagaaaatcgttgagatttctttctaatttccactgcctttcttagctagggctgtattttaacattagaacattattctgtgtattgtgtttcatgtggcaacattgaaattccatattttgttatctaggtctatacttttcccttttatgcctcaaacaagataccccggccaggactaagttggggagtttgaggggccaagatgaggaacacgagatcaggatcatgcagaaatctaaaggaaacaccagctctccgacattgcaacctgggccagaaaccaccagtgacctctgctaactttgtcctttcttccaggtggaaaggggaaaatgtggccaccactgaagttgctgatacagttggactggttgattttgtccaagaagtaaatgtttatggagtgcatgtgccaggtatatacaagatatgatctgtacctaacccatagagtaactgaacataattttggcctcaaggcgaagtttgtcattgctttctcccgccatccagagttaaacagttctttcagctgccagggagtaaggagcttatgtctggcttatgttccactataaaagccaactcagtgcatctgaacatggccttctcttcatttcagctcccagccattcttgggctctcaggcaaacaaagtctcaaatatgggagctccatgccacatttggcacacctcgagaaaagtcgtgtcatgcttaagagctgggaaatgatgtcctagcctctgaactaggaggcaaaaagaagagccagtgcagttgctagaagaaaaagctggggaaaagtggattttgtacagcctcttctttttaagatttctaagcccagttcaccacactaagtttcagaatcatcacacaagaacgttgtcaccgcagcttcatctgcagatccacttctgccagcagagtcaggagggccagtgtctgaccttgaatcctggcttcaacatctgctggctgtttgactgcaggcaaatcactaaaattaaggataatgccagccctgcagttaagcttgtcaagagaacaaattcattttaattacatcaacgctaagcatatatttatcaaatatatatataag

SEQ ID NO: 79298 - DNA, 1598 bp, Homo sapiens
atctcataatgtggagcacaaaattagggacttaaatgttagtgaattgattgaaaaggcaagatgtctaggaaatttcaataggtggctgcttttagctactacggtttttttttttaatttgaaggatgcatgcttatatgtattaataatgtatttttgcaaaaattaaaaaaaaaaccctcttcttttaattaggagagagaagctcttcagaaacagctggatgaagcaaatcgagaagcacaaaaatatcgacagcagctcctaaagaaagaacaggaagcagaggcctacagacagaagttggaagctatgactcgtcttcagactaataaagaagctgtttaattgaaatgaacatgtagtttgattttacttttggtcaagaaagaatacaatcttgaactgtacacaacaaaggtacagccatgggaatacagaatgatagaagagactacagatggataattggacttaagccatgagctctgagttcttgtaacataaaactttactttagaagttgtgaaatgtatttaaaactgaattctgtaaatagtttttttttttttacagttccaaatgagttgataaagattgttgaagagatccaaaaccagaataagccactgtttttgtgaattctttttgattttagtacaaaccttaatttctcagaaacggaacagttttaagggtgatcgttgttggttaggccaaatgttgtgtaataattatggtggactgatgctggaattactcctgtaggtataaacctctgtatgaagagaagatttctcccaggaaatctttgtacagctttaagttgtgtcagattctctgaaaacattttttagaaagcaaaatttttatatttgttcaatttcagctatacccaagtagatttacatgtatatgaagcaaatatttttaaaaatttctgtttgtacatattctgcatgttttataatttcaaaatgcatcacttacataggtatttctcccacagaaatgatgaaagtgaccagaaaaaaacaaaaacaaaacccctttactctgtaggtcattgaaacgaagtaagctggcagctggttttattggaatgacagtgttctcggaaggagcagcctacaagataacttgaatttgccaattctgcaaaatctgtgcttttttgaaaatttaagagtggggacgtgaaactgtattctgtgccttccatcatgatttccacatgaaagcactttaaggcactgattttaagataatgtttttggaaaacccaatgcatatgggtttctgaaatattttatggacttatttctccccaggaaatgattcttacggaaaaaaattgcttttgtatgtagaacaggaactttttgtattacagtgatgcaatagacatgtctaatgtaacttctacttttccttttgaaagctcagtgtctgtgctatgacttgctctcatcacaatattgttgaattccacaatgtatggacattaaacactggcagactgttcactttttcttttttttttttggtaaaatattacttcaaacccctttttcttgctttatttttcagtgttt

SEQ ID NO: 79299 - DNA, 1034 bp, Homo sapiens
attacattgtactaaataaatattagttttactatttttaaatttttatttacatttataactgtcactaagagagtttttcatgttttggcaaaaaattttaaaggccgtggaacaattataattttccccattgtgattattaaaatggcttcgcatggtttcagcttgcacagtcatttttatgttcctgtagtgctgtgcaaagcaaggacagcctctctatataattgcatttatataaagagctactaaaaattgagaaaaagcccaacagtacaatacaaaaacaagcaatgtttatgaactatcagtgctcataatggaatatgcacttagtggatattatgcagctaaataaacagaagctctctatgtagtgatgtaagatattataagtatttggagtgaaaaaagcagatgcagaacaatatatctattgtatagatgctaccttttatgtaagaaaggaaaatgagaatgtatactaatttttaaacaaattaatataaggataatacataataaattaataaaatgatcatctgttagcaggggtgggcatgaggcctctcaaaatatgctcgttaaatattttgatgttttgagtcatgaatgaatatattatctatataattaaaaaaatatttgtaggtactttaataagtagatttcagtaaaaaagcaagaaggtaataaaaaagacaaatatggatagtctcataaaaagcaaatcaatgatttggaattattgttttggaatgtagttattttagatgagtagcatcaacaatgtcaagactagttttatttctaataaatctctctgaaaatgaagtaatacataatttttttttcattttagtattaacagtaccagcaacagacattgctgaagaaactgttataagtgaagaaccaccagctaagagacaatgtatcgaaataattgaaaaccgggtggaatctgcagaaatagaagtaaggagtcttttacccggtgtgctttgccgcagtcatccaaaataaattca

SEQ ID NO: 79300 - DNA, 1169 bp, Homo sapiens
catcagagtgagaccctatctctatttaaaaaagaaaaaagaaaagaaagaagcatagaaagcaaaagtagcagacaaagcaaaaataggtttctattcataccgttacatatgtttgctgagttttcttttttttttttccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaaggttagtagtagacatttatataaagtttgtatgttttttttttttaatttttattttctttaagtcttccctgcagtccaaaaagattgtgtttatttttaattctcaggaaattgtggtatgtgttccaaagaatgtatttttgccttgagttatatttgtataaccctttgcaatagacttaattacctaattttatttgcttaggctaattaaaattcaaattagcttgctttctctgagtatatactggtggaaagagaaattggccccaaagtattctggttgaaaaatgagcttaaatgtcaacacaaataatatccaaaataaataattcaaatcagcattggacagtagtttcctagatcatttaatgcaattcaattaccatgtgagcttttaaaaataccatataagaaaaagctacttaaaaagaagttggagcctgggcaacatagtgagaccccatgtctaaaaaaaatattcaaaattagctaggcatggtgacatttgctgatagtcgcagctacttgggagcctggagtgggagaattgctagagcccaggaggttgaagctgcagtgagccattatcatgccactgcattccagcctgggcaacagagagaaactctttctcagaaaaagaaaaaaaaaaaggtggacttaggacttgtagtaggaatatggtagcacattttagcagctttattgtgaattctaacatttttctccttttggaaaccacaaaggctaacaagatgaaacaaaagtctcagctacattttcagtgaaactaaaaggctgagaaaaacctcagaattccacatttttaagtgc

SEQ ID NO: 79301 - DNA, 1053 bp, Homo sapiens
ggccactctagtgtcatggaatcttcctagaggaagaaacatttaaactgaaaattaaagtaggcgttagtagggaaaagtttggggaagaacattttagcaagagggacatgtgaagcttttgaggcaggaaagagcttgactttttaggggacccagaggccagtgcatctaaacccagtaagtggaagagtcactcaaggtggttgaaggtgagattatataggactttaaaaatgatcactttggcaggtttagaagaatgctttggaagggagttttgtttggaatctaatgcagtcaaccagggaagagttatcataatgatagcatgaatgaagatttgacagagacaataattgaatagattcgagggttatttgggatatagaattagaagctgtgattggttaagatgtaggccttacatctgtagtgtagttatctggccctttaaaaatattttttcatacgtctcttattttgtagctctagcctgtagtcctatagcaactttcctttgcttagctttattcttccttgtggtacaactgtataataccttgattaaatacacatcagtgaccacccttcttttttgtctttagagcaacttctggtaattactaataaagtggtttttccaaaggtgtaatgcatctggtggctttaaaagttccctcttttcttatgtgtcaaaacaggggttaaaaaaagaaaaacaataaaaataaaaaagttccttctttttctccctaaaagtgaaatttgaaccaggtctgttttgcacattgttttttggtctatatcaaaaatagggtgatacaactcaattggctttaaggggtatgtatggggcctcatgaggttgttttgttttgtttttgcttttttgtttttaatttcaggttaaactgccaccataataccttcgaaaagtttattttttcttcaatgaatatagtttccattttattttatttatttatttttgaggcggagtcttgctctgttgcccaggctggagtgcagtggcatgatctcggctcactg

SEQ ID NO: 79302 - DNA, 1182 bp, Homo sapiens
aaacgtagaagaaataattaaattcctatagctacagggcagaaatattttttgtttgttttgtttttgtttttgttttttgagatgggggtctcactatgttgcccatgctggtcttgaactcctgggcttaaccactccttctgcctcagccccctgaatagctgggattacaggcacctgccacctcagccagcttaatgtccagttgttctgtgttctgttaaaaaccttttagatactcgtttctcctctcccaggattttgctgctttacctaagagggggacttgggatataaatatatacccatgatgtgcccctacactgtcagtggaccttagacaaatatttccacttgtactatgtgattcttcttagagaatactcctttatatgtgtttgtattatatggagaatttgtgctatatgttctggttataattctgaaaacactgtggtcattttttccctagattgctatgcagaaccaaatcaacacaaacccagagagtcctgacactgtgacaatacatgctgcaacaccacagtttatcattggacctggaggggtggtgaacctaacaggtctggtatcttcagaaaattcatccaaggcaacaggtattgagatgcatataggataggctttgggattttatgctttagtaggtattcatccttgtaagaaaggacggttggagaatgagggtaagattctatcagccacctttgttttctttggtataactggcaaaaagatttttatgagacaaaacaatctgaagaaaggtgatattacaaaatttactgcagtattacctttcaaaagctaatgctatccaagctttgtttaagagtcagtaagataaatagaatatcagaaatatgcattggattaagctccttagaaattcaaatctattttcttttttcttacagatgaaacgggtgtatctgctgttcagtttggaaactcttctacatcagtattagctacattagctgccttagctgaagcatctgctccattgtccaattcttcagaaactccaggttagaaaaacgagtctaatgtgtacattaaaattgcagattcaggctgggtgccgtggctcacacctgtaatcctagcactttgggagggcgaggcgggtggattgcctgagctcaggagtttgag

SEQ ID NO: 79303 - DNA, 1675 bp, Homo sapiens
ctatgtaaacagataatgtaaagaaaatctgtttactatataaacagaagtgtagtaacaataatgtaaatgtggatttttttttttttctgtggtacagctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaaggtatgtgttctctttttgcactttgcttttaaaatactttacggttttataagaaggagagggaactagtttttgttaaatgcctacttagtattttatctatagtatttcattttttgtgtgtataagcccattaaatgaaaattgtcttatagctttcatttcatgagggacaaaacttcatttaggtatattcttagttaaatcagctaattgatttcttggaccttggtctatcttatgatgagggactacagcattttttctttttgttttttttttttttttgagacagaatctctgtcacccaggctgcagtgcagtggcacgatctcagctcactgcaacctccacctcctgggttcaagtgattctcctgcctcagcctcccgagtagctgggactacaggcgcccaccaccatgcccagctaatttttgtatttttagtagagatggggtttcaccatattggcttgactggtctcgaactcctgaccttgtgatccgcctgccttgggctcccaaagtgctgggattacaggtgtgagccaccatgtccggcccttaattttttgtattgtagagatggggttttgccatattgcccaggctagtttcaaacccctgagctcagctgatccaaccgcctcggcctcccaaagtgctgggattacaggcgtgagccactgcacctggcctggaacatctatttaacatatacatataaataattgactacattatttgttcttgctttaaagcacagaactaataatttcatatcaggaattttttatgtgatatttcatattttagtaaactctttgaaatatttttgtagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacaggtaacttttggcttttaatttaagaaaataaagaaaaagaagccttatcagtagagggatctcttatattgtgcatgatttaaactattgtttgtagcctttcattttggacttagttattttggataggcctttttctctttcacttcctctttgtttattactattcattttcttgattataaggccagtctcttcattaacattagataaggtgattactttctgttttttaagtttctgaatttccctttagaccttttttttttttttttttttttttttgagccagagtcttgatctgtcccccaggctggagtgtagtggcacgatcttggctcactgcaacttctgcctcctgggttcaagc

SEQ ID NO: 79304 - DNA, 1022 bp, Homo sapiens
ctgggtgtggtggtgcatgcctgtagtccaagctacttgggaggctgaggcaggagaatcacatgaacccaggaggcggaggttgcagtgagccaacatcgtgccactgcactccagcctgggtgacaggccgagactctgtgtcaagaaaaaaataaataaataaaaatttaggccagcttttctctgctacttacctcttctatcttttaccagatgtatttggagaatttaaactacttttattctaagtaaaaacttaatgagaaaggaaaatggattctaaaatccaaatataaattgcttttgtatgatctgtaattttaaattaaccatagcacactcttttgaagggataattgagaactgacttattaataaagacaggaagggaaaatgtcatgtcatagtgtataaatggagattttgatgttcagttcatctatgttttgtttagatgtccctggtagatttgggaaagaagcttttagaagcggcacgagcaggtcaagatgatgaagttcgtattttgatggcaaatggagctccctttactacagactgggtaaagaatgattttaatattgtgtgttctttttccttctcatttttgagtttttgcagagaaaaatgtagtcagtattgtgtttataagtggtaaaaagttattatttttgcaaatgtgtttattattttagaattataactgtcctaaaagaagtggtttatattattttctttgatattggacaaccttatccaaatatttcatccacaaagagtttttctttcaaactgtggagtgcattaatgtggcatgaatataaaaatgtatctgcttgggatttaatttaaaggccttataaatagcacaggtagaatttataattcagaaagatactgataaagattggagttagtgttaatagtcactcctaaaagaaaaacaagtttatgtttcaattattacttgtaaaactgttgcagacatgacgaaagaggaagaaaggaatgggaatgag

SEQ ID NO: 79305 - DNA, 1058 bp, Homo sapiens
tcttccttattgagtgcaagttgagtatcccttatctgaaatacttaggtccataatgtttccgattttgggttttttcagattttggaatatttgcattaatacttactggttcagcatccctaatgcaaaaatgcaaaatctgaaatgctctaatgagtatttcctttgatgcttaaaaagtttcagatttcagatttttggattagggatactcaacctgtaatagttgttcataccaggtagagatacactaatcaacctgccattactctctttataatttattttctcttgactacttacctaaccctcagagtatatactttttttgagataaatttataccccaggcacattttttcattgtaaatctcagggattccatatattcccttccccatgggcctaaaattctgcttttccttacttaggatactgtatgacataattgagtaatcttccagctggatagtctttctgggtttggaaactttcttctcagaactgtcatcccttgaatttgaatgtttgtgatacattcaaatcttaatttacctatattctactgtcataatcttttttctgacatatatttcaatatttcttattcaagaagacacaaatacatacacacccatgcacacctcacatcccaggctgggacattagccttttcagatatattaaattcaaggcacaagatattctttcctggtttttttttttttttttgagacagagtttactttgttgcccaggctagagtgcagtggcatgatctcggctcactgcaacctccgcctcctgggttcaagtgattcttgtgcctcagcctcctgagtagctgggaccctaggtgtgagcccccatgcccagccaattttttatttttagtagagatagggtttcaccatgttgtccaggctggtctcgaactcctggcctcaaggatccacctgcctcagcctcccagactgctgggattacagggatgtgccatcgcacctggcctctagcctctaatgagacagtctattcgtaatactattactgtt

SEQ ID NO: 79306 - DNA, 1058 bp, Homo sapiens
ttttagatttattattattcagcctctcacctgctttcaccatttcttttaattttatcatacttaaattttgaagtagtctgcgatgcatacttttgctttatttatttattattttttgtttttttgagacggagtttcattcttgttgcccaagctggagtgcaatggcgcaatcttggctcactgcaacctctgcctcctaggttcaagcgattgtcctgcctcagcctcctgagtagctgggatttcaggcgtgcaccaccatgcctggctaattttgtatttttagtagagatgggatttctccatgttggtcaggctggtctcaaactcccaacctcaggtgccgccctcctcggcctcccaaagtgcaggcgttacaggcgtgagcacagttttttactctttattggctcccagtttgtcttggaattctgcattgcctattatttgcttcctttaaactttagattttccttccttgcatcctttttgcatatggctgccagaatgattttcctgaaaatattttgaacccattgctaaacatataagcctgaggagagaacatgtgctattgacctttgcactgtctattctgtcaaacaaagtgaattgaaccttgctgaataaatgtttgaaagggtcaccatttgctcaaaaatttgaatgactcccagttgtttacaagataaagtccaaattctactttctgactttcaaacctttttatattcttcttcagccttattccttactgtttaacattatcaagctggtgtttactctgtaatataccttgcttaagcacaactccatgcattcttcctttccttgcctgtcagagcctactcagggatgtttgccctgcggctggcactgttctaatctctgatgttatagtaatgaacaaaagagaagacaaagtcccgttttcttggagctgacgtttgtggggagggacacatagtaaacaaatacgtgatgttaggtggtaatgagtaaaatgaaaaggaataaaagtaggtaataaaagatgattgtttattctgact

SEQ ID NO: 79307 - DNA, 1669 bp, Homo sapiens
gtagatgacactgtgatacctgtctttaatgcacccattctgtgcatgtagagactgaggtggttgtaaaattacagtactgaactttggaattaggtcaattcttctcattatgataacggttttggatgtatagccccttctgactcctggaatcctttatttccacagcacttcccatgtatccaaacagaggaaaaaataattagtagtatagtgcttgcttcagcagcacatatactaaaattggaacgatgcagagaagattttcatggtccctgcacaaggatgacacataaatttatgatgtgttccatatttattattatttttaataataaaaaataaaaaaaatttgtatggtgtgtaagtgaatgatctaaaaaatttcctttgtgccctaaatgacttgtgtgaactctgtgatctttgccaatgtgattattcttcctgtgttcctttacttgttccattcatagtgaccctcagtttcttgccctaagtgctatggtctaaaagcttgtgtctccccataattcatgttgaaatcttaacctccaagatgatggcattaggagatggggcctttgggaggtgattagctcaggtgggtagagccctcaggagtgggattagtgctcttaaaaaagagactccagaccgggtgcagtgggtcatgcttgtaatcccagcactttgggaggctgaggtgggtggatcaggaggtcaggagtacaagaccagtttggccaagatggtgaaaccccatctctactaaaaatacaaaaattagccgggcacagtggcaggtgcctgtaatcccagctactcaggaggtggaggcaggagaatcgcttgaacctggggggggcggaggttgcagtgagccgagatggcgccactgcactccagcctgggcgacagagtgagactctgtctcaaaaaaaaaaaaaaagactccagacagcttgttagctctttcttccacatgaggttacagcaaaaagacagatgtctagaagctggcccttaccagatactgaatctgccagtgccttattttggacttctcagcctcctgggctgggtgaggtggttcactaccagccttggcaccatagtgagactcccatctctacaaaaaaaaaaaaaaaaaaactttctgttgtttgtaagctacccagtttatggtattttgttacagcaacccaaacagtctgagacgtttagcttaactcctgtatgcactagatacagtctgcactttgacatcaatcacttattttatattttactggactcctgttgtcagatttttccaccatcgatttcttctgttttccctcacaggtcacagcatatttgtggaggaaggtgagtaattatgaagatttcttggccactataaatttacgctgaacaattccaaataggcccctcctacttcttggcaatcatcttattaattgcatttttctgttgtctcatattccttcttcctctttaactcttaatagatgccatttacttctatataagtgaaaaaggaaaacagggtacaagcttgcacatttttttttcattgtaaccatgacaaatcactgttctttcatcttattttgtaaattgaacggaagaagaatcctgctgccacagttaactttacctc

SEQ ID NO: 79308 - DNA, 1078 bp, Homo sapiens
aaagtatgcttggttttagtgtgttttttcccataacattgtgtcattgtaatggaccacatctcctgtaccatgaatttttttttacttttttcttttgcccctcagtaccagaaatattaacaggtaacaggtaaagtgcacgtcatgaggaattcagaaattcagaaattacatgaagttttgcatcatgaatttatttttgagggtgcacgaggcagttacccagtctctgtttgcaagtagcctgagttcagatgaactcactgatggcctccatctcttctgactttgcaaacgttgaaaaacaaacccacacaaaatcttgaagttgagagcaacttagtttccttagtgtcatccctctgctcccctctcctccccaacaactagtatggtttccagctagtaatcacaatgtttctatagctctgatgtgcctacattgggatagctacaattagtattatagttttctgaagatgtttgttccatcatgctttctagaaggtaaatctagcactagatgagatcagtattagggcctgtgttttttctcagtgttgacatcacagtgctctatacaaagaagatgctttggtgcaatcagctgtcagttcagttggtgggctagtgcacctttctgtctccctccctccctccctccctccctccctctttcctctctccttctccctctgtccctctccctctctctccttccctccctgttttcccctttgcacctcttctttctttgacagggtcttgctttctctgttacccaggcttagtgcagtggtgcgattatacttcactgcaagctccacctttcaggctcgagcgatcctgcctctgcctcagcctcctgagtagttgggactacaggtacctgccaacatgtctggctaattttttaattttttgtagagacgagatctcactgtgttgcccaggctggtctcaaacttctggactcaagtgatcctcccaccttggcctcccaagtgttgggattataggcgtcagccaacacacccatctgtgaataattctgaagttggtagaacagcttatt

SEQ ID NO: 79309 - DNA, 1039 bp, Homo sapiens
cggcgagggtggcgggtcctgggcgccctgtgctgcggggccgagaggcgctcgggtcgcggcgggatcggccggaccagacagggttaatggaagagcctggccagtcccgcgcggggcccccgcagcgacagccttggccgcggggactggagtcctgagggggagaagcctgccgttctgaaggctcgggacttctgccccaaagacttcgccgccgagaactgcgggtgcactgcctcagggaagaagttgagaattttgccaggtcatctctgccagggcacagttcatcactgtgtgtttagtgtgtttcggtgaagctctccaagtgtgttgaatcagcgtgcctagcctcaagggtgcatcgtgaaaactgaaaccaaaggaatgatacaggcctgctttgtgtgtgtcttcccactttaagcttgttttcagtacaaatactcttgctttaaacctgattggactgtggcgagcggacatctgttcaaaggaggggccgagaccacagtacttctgaagggggcttgataatgtggaaacattttaagttttctctccggactgttttgctctctcaattcaggcaagttactgaagtacgttttttatctagaaaaaggtttgatgtagtctgtaaatggtccttgtaaagtacattgccatctcagaattaaaagatccactctcatttattatgcagaagttagtggtcattctttcctgtagatagtttatctcatgtaaagacccacccagcttggtttaaatttttttctcactgacgtataaccatcagctttgatacttccattttcaggctcagactttgaatttaaggaaactaaagatgactttattttcttttctcttggttttttttttccaaaaacaaaaaataaatccattacatgttaacatagatgataagagtgacatcttgcatttttgcaaatctttttaatgcctggtttaatagaagattctcagatctacgtcagactgttgtggttagcacaccatgtaacctctg

SEQ ID NO: 79310 - DNA, 1055 bp, Homo sapiens
tatatatgttttgctttctcacttgatgagcggaaaataccctttaccttctgtttgacttctgcagaaacgtgtgtgattgtagaggctcaaatagcaattaaaacaatactgaaagtatttttaacactaggcatccttaagtgacggtataacttacatgattttgttaataaaaatagaaacaactatggtttttaatggactttagacattatcagagaagattgttacttatttgaactgtttccaaaaatcaaatggggacagaaaaggaagcttttaaaaagtacagtctttctcctagaaacccttcctaaaatctttggtgacatcgtaatcttatccctgtactttccctccttgtgtctaatcatttgccaagtcctgtcattctacctttgcagcatctcttattatatctgcttcctctattccatctctactgccctagttctgacctttgtcatctttccctaggatcattataatagataactagtgttttccctatctagtttgtcacttaccgcctaactttatactcttcttagttttaatcacttacctccctacttcagaaccctgctacctttagaaaacaaagtaaatgctttagtaacattcaaggccttccccgttccctgttccaagtctgtttttttttccactgccatgtagatctttgttcattctatgtagtggctaattcctaaagatgttctttactttcttttcttcatcctgcttttcatctctttgaaaaaccttcccccaccaagactcaaatcaaatgttgtctctttgatgatgacttccaagatccttctagtcatacttaatcttctctcttaatttttcttatactgtaatatttgtaactctatagtttgatatcatactatgctgtattactactgcttaaaactttctcttccacattagttttttaaactttgttggtttttttgttttgtttttgagacggaatctcactttgttgcccaggctggagtgcagtggtgcgatctcggctcactgcaacctcacctccc

SEQ ID NO: 79311 - DNA, 1489 bp, Homo sapiens
gcaaattggggtgcttttggaattttcataggtgagcagcagccttcccatcccctgctccaagttgtactttacttagctttttaggattagatgttcattgatgtccatttgtttaatgatagtgaactggtagaatgaagattattaagagattggaaagaagtagccagacgtggtggcttacgcctgtaatcccagcactttgggaggccaaggcaggtggatcacttaaggccaggagtttgagaccagcctggccaatatgacgaaaccccgtatctactgaaaacacaaaaactagctgggggcatggtggcgaacgcctggaattccagctacttggaggcttaggtaggaggattgcttgagctcgggaggtgaaggttacagtaagccgagattgtgccattgcactacagccagggtgacagggtgagaccctatctcaaataaataaataaataagaggaagaagtcacttaaaaaataaatggatatcaatgagaaaagagaaatatttctagataaaaattccatctacttatgatctaaacattaatgctattttaacaaaagaaacatgtaaacgctttgattattcttactgctagttcctttgacaggtaagattcccaactcttaaggcaaaatgatacaaaaagtaattcatttggttaatgaaaatttgaaaaaaattattacattcttcactcatattctgcatatcttaaactcctgaaatagatattctaaacaatttaaaattaaccctgttagcaaaggatatggtttaggaatttttttttttaaactgctcacttgttttattgtgaatgaggaaaattagtataattatttgtatttgtttcaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagaggtatgatgtatccttcgctagtttgattgaatcaaatattaatttttagttcgtttccatattaaagttagatgaatgttaaagtttatttgaaaaataacaccatcacacgaataaagtaggacctccttagagaaagttgtaatgtaatcgtagcacaatacatatatattctgctcatatgcatattatctactctccagacagatcatacagatatgatctctaggtcataaagtttaagaggcaaagattatgaggcttctaaaaaaaaattcagccagaagtcattgtcttttcataaaacgatacaaaaataattcctttttggccgggtgcggtggctcacgcttgtaatcccagcactttgggaggccaaggtgggcggatcacctaaggtcaggagtttgagacaagcctggctaacatggtgaaaccccatttct

SEQ ID NO: 79312 - DNA, 1008 bp, Homo sapiens
ctgtaatcccagctacttgggaggctgaggcaggagaatcacttgaatccgggaggcagaggttgcagtgagccaagatagcccattgcactccagcctgggcaagaagagctagaccccatctcaaaaaaaaaaaaaaggagtgcacaacctagatccctcacatgtgcagttcacaatagggttcgtgctcctatgggaatctaatgccaccatgatctgacaggaggtggagctcaggtggtaatgcgagcaatggggagtgactgtaaatacagatgacactttgctggctaacccaccactcatcgtctgctgtgcgtcctggttcataacaggccgtgaaccagtaccaatctgtggccctggggttggggatccctgataaagattatctgtggactttgtatatgacctgtattttttcccagatgtcaattgctttaattattattttttctctaattttaagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggtaccttttatttttgcattgttatttcctaagttattttgcataatggagctattgatttttttctaaaaattttaagtaataatgaaatgtagctcaaattatatgcagcatgatctcatgtagatagaaaaagggaactaaagatacagtgttattatttacaaatgtgtataatgtgtgaactcgtacacattcttggatttgccatggattagtacaagtttatagcaacatacagattcataatttttttctgaggtaattaataattgccaggtcaagtagaaggattgagtttgctcattaagtaagaaaacatgactgtgtttttttttatagtacttttattgcgctttcttaagagtcaaggtttagtctcttgttttta

SEQ ID NO: 79313 - DNA, 1379 bp, Homo sapiens
gggattacaggcacccgccaccacgcctggcctaatttttgtatttttagtagagacagggtttcaccgtgttggtcaggctgatctcgaactcctgaccctcggtgatccacctaccttggcctcccaaagtgctgggattacaggcatgagccaccatgcccaaccagttttttttttttaatggtcttgtttactttttgctttattttggaagttaatagttattttttttctatgacaaaattgggaatatttttgtagccgcctttttttttctcttcttgagaaggtagtgagtacatttaaacagatgagatttttccatttccagagtctctattgcatttccaaagggagtatgtaggcagagaagtccaggctgagacgctccctgcaaaggctcaggtaacttaggccattatttcatatgattcagtagttcatttcctgtttttcagtaaaaggatcattttcatttgctctgtccagaggatctcatctgcttctgtcttagaactgttttttgtttgttctgagacagaatctcacttccgtcacccaggttggagtgcggtgggcacagtcatggttcactgcagcctcgacttcctgggctcagctgattctctcacctcagcctccagagtagctgggagtacagacacgcaccaccacacctggctaattttttaatttttagtggaaacgaggtcttaccctgttgcccaggttagtcttgaactcctgggctcaggtggtctgcctgcctcggcctcccaaagtgctgggattacaggtgtgagccaccttgcccagttgcagaactgttttctgttttttgttatatttttctgtagcccagcctctctagtgtacttcagctatgtgaggtgctaaatttactaacaagatattttctattttttaccctttagatgaggtagggactgaatgtatgtcattgaacttccttagaaacttgtattttcactcttattttatactagaaaatgttagagatttaggctgggcgcaatggctcacccctgtaatcccagcactttgggaggctgaggcaggtggatcacttgcggtcaggagtttgagaccagcctggccaacatggtgaaaccccatctctactaaaaatacaaaaattagcagggtgtggtggtatgcatctgtagttccagctactcgggaggctgaggcaggggaatcgcttgaacctgggaggcggaggttgcagtgagccgagatcgcaccactgcactccagcctgggcgacagagcaagagtctgtctcaaaaaaaaaaaaaaaaaaaaaaaagcctgggcacagtggctcacgcctgtagtcccagcactttgggagg

SEQ ID NO: 79314 - DNA, 1245 bp, Homo sapiens
atgggatttcaccatgttggtcaggctggtctcgaactcctgacctcacatgatccgcctgccttggcctcccaaagtcctggattacagatgtgagccaccgcacccagccacctataatttagtagggaatagttctaaattcctcagatatctgctaactgtagttcagatagctgtttaactgccaacaagttggaaatttcagtgaagtcatcctttaaaaaaatgtaacttgggaccttggtaagactttccacagctttttgaatgtttgttttcacatttttattctaaattatcaacataagtgtgatatttgggctgtttcttttgcagaaaaaattaggatttttcctttgaaaagcaaattgcagcagatttgaatcaatataaaaggttgaaattagtaggagagaaagagcaaaaagcactaaataatttcaacttgagaacatacagtttctttttaatagttctgggcaatttgaagtaaatctacagatggcctcaggtggcagatgtgtgaattgtggtggagggagaaagcatatagccatgaaatacctcaaggcaggatactaattttacagaactgaaactcctttaatttccacgattaacgccaataaaagacaatcttgacttattttttcaactagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaaggtatttcaaatttaatgtgtgagttaaaagactgtttctgcttgttagatgatttgcttaaaaagagttgagataccactataaagttcttttaggcaacaaggatgaaatttaatgttttaattagaaatttatttaaggctgggcacggtggctcacgcctgtaatcccagcactttgggaggccgaggcgggcagatcacttgaggccaggagctcaaaaccagcccggccaacatagcgaaaccccgactctactaaaaatacaaaagttagctggatgtggtggtgcatgcctgtagtcccagctactcgagaggctaaagtaggagaattgcttgaacccaggaggcagaggctgcagtgagctgagatcgtaccactccactccagcctgggcaacagagcaacactcttgtc

SEQ ID NO: 79315 - DNA, 1063 bp, Homo sapiens
ttttcctatgcaatagagcaatggtgaaaagaatgaaaaatgtgagaccaaagagaaaggtaagtgtgtacagaaggaggaagttgttttaggttctgactgagatcttttaatcagaataagcatcaggttttatacaatgagattcttagcattgttgtctaatctctatgtaagctttatcatttttcctagtctgtacaattatattgaaaatgtctgaggttatttttatgtatttatcatggggggatattttatgaataattttaaccttacatgttaaactggtcatatgcagttgaaaaatgtcaaaaccaaagcttgtacttgttttcttttcaacatgcagtttagcaataatggttaagagcatggactctcagaagtcaaactgccggagtttgaatactggttcctcctctccctttccgcctggttttcagaatgttgcttaaacattctacctttgtttccttgtctgtaaagtggagataataatagtacttatttcatagggttgttgtcagggttgaatgagctaatatatgtaaattcttagaatacatggtaaactttaagtaggacttattatcatttatgactaggttgtagatttaattttttctccccccatccatcctgtggtcaaagactaaattatttaacagtcatttacatcccccataaaaaaaaaatcgaggccaggcgcagtggctcattcctgtaatcccagcactttgggaggctcaggaaggaggattgcttgagcccaggagttcaagaccagcctaggtaacatggtgaaacccctgtctctacaaaaaatacaaaaattagctgggtgtggtggtggatgcccttagtcccatctgctcaggaggttgaggtgggagaattgttcgagcccgggaggttgaggctgcagtgagccacgatcacaccactgtactgcagcctatgacagtgagaccctgtctcaaatccaaaccagtaatatggaaattatccataggtggcgttgatgctctagtgacaaatatgtgacctaaacaagactttg

SEQ ID NO: 79316 - DNA, 1044 bp, Homo sapiens
actgtcctgcgcaatgagcctttggttttagagggaggctatgaaaactggctcctttgttatccccagtatacaacaaatgctaaggtcactccacccccacgacgccagaatgaagaggtgtctatctcatgtatgtatgtgaaaatttttgtttaaaattgctttggtaaaatatggtttaaaattgttttcccggtaacattcttggttgtgtgtgtatttgtcctattagagagcagtttgttttcaggcataaaaatataagcctggaagttcacattttctttaagactgttgtaattgttttttcacttagtttacatttaattactgcattaacacgcatgagaaatgtaagtactgtgtatggggtttgctattctaaaaaacatttttatttttggaattttagtggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacaggtatgttcttgattttaacattattctcgcttttgttttaatattaaatatatagtatagctgggcacagtgcctcacgcctgtaatcccagcactttgggaggctgagaggggcagatcacctgaggtcaggagtttgagaccaacctggccaacatggtgaaacccccctctctactaataatacaaaaattagctgggcatggtggtgggtgcctataaatccagctgtttgggaggctgaggcatgagaattgtctgaacccaggaagcggaggttgcagtgagtcgagattgcaccactgcaccccagcctgggtgacagcaagactctgtctcaaaaaaaaaaaaaagaattaaatacatagtatagaaacgaagtttaatatataacctttaacatct

SEQ ID NO: 79317 - DNA, 1057 bp, Homo sapiens
gagatcaggccactgcactccagcctgggtgagagtgagactctgtctcaaaaaaaaataaaaataaaaataagacagcatgaaagtttgtatatacaagagatgggttcttctgatgtttggaaggagagatctgtataaaatcagccacagcataaggcagaatatcataattgctctacaaggcactggagcacagagcaaggagaatattctagctgagaagatcaaggacgtcttcatggaggagacagtattttatctgggctttaagagtaggattggaggatagaagaaacaagtagaaaattctatgaccaaaggcatagggcatgctctggggccagtgaacagttttggcatatgtgggcgctagtctctgttggagagaggaagttatgatagtagataagattagaaggatggacaagagtcatcaagagagacttggatcaaatttgaattttgtcctgtaggcacaaggaaccattaaagaattttaaacttgagagtaacatgatcataactatacttttaaaattagggaaaaatagatcaagccaccaaaatgtaaatggaaacaacatttatttttgtttctgttccacctcttattgttaacctcatccccatagtggttcttcctactttattctcaaatacatgcaaaaaaaaagacaaaggattttttttaagaggcagaaagagaagtgaacaggaaaaaaattattttttctacactaacctcgttttctttttcttttcttttttttttgaaaacggtctcactctctcacccaggctggagtgcagtggcgtgatcacagctcactgcagcctcgacttcctgggttcaagcaatcctcccacctcagcctcctgagtagctgggattataggcacatgccaccacgcccagctaatttttgtattttttttgtagagatggggttttgccatgttgcccaggctggtctcgaactcctggcctcaagtgatctatccggctcggcctcccaaagtgctggtattacaggcgtgagtcactgcgcctggc

SEQ ID NO: 79318 - DNA, 1345 bp, Homo sapiens
actattgggagagtgagagtggttacatccatgagattaggaccatgtttgtcggggtggggggaatcgtgaatccgttttggctgtatggggtttgagatacatgtgttgacactcaaatggaaatattgggtaggcatttggatacctggaagtggaacttaagtctaagtatgcccaggtctaggttttatgttttagaataaagacatttttaactcttttgtatacaaaacactcaggaagaattgaaagtgttgaatcaagaggatgtaagttccagtgatgtttgaatatctaccattcaagttctgttttatgagaaatcttgacactgagtaattaacaaatagatgtgctgatagatgttgtctccacaaagtgacacttcttttatcacaacttgatctcaagaactgaggttatttcctgatttttgacaaaaatgttttgctctggttttgttgctctagattgatcgtactaaaaaaccagcagtcaaattgcctgaagagcatagaataaaatctgaaagtacaaaccatgagcagcaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaaggtaagcagaaacagtacaaattgccaacgaagtgaaagaaaatgtatatgaaaatgtgaaaacaccagtggcattccataaaagggcaggcatttcaaatagtcttttcaggggtgatagaatgtactgatctatccacatttgctcatctattctcctttgaggccagtgccatacatttatgaaatgattggttgggaatgaaattgctttttgtatattacatctataaaatgcaatatatttcaaataattgagataaatagctacattcttcatttttatgt

SEQ ID NO: 79319 - DNA, 1152 bp, Homo sapiens
tccctgctacttgggaggctaaggtgggaggatcacctgagcccagaaggtcaaggctgcagtgagccgtgattgtgccgctatactccaccagcctgggtgacagaatgagaccctatctcaaaaaagagtaaagccttctctgattagtaaaggacagacaggatgagagcagtgccagaaggcagaacctcgctgtcatgaactggagcctgttgatgatgaggagaccatgcagggcttgcagccaaaagaaggaagctgaagggatgtaagcaagtcagattcagatgagaatctggtggtgagcctgcaaataaataagtagtttaatgtagtgctacagtatgtgaataatttcatgttgacatcaagaatctactgtaccttgcttaacttttaaatttcctttattgtcttttgtaacaacttttatttgcacaggtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagtaagaaatttgatttttctaagttgcagagactctttagggttgctcagtagcactgtatttttatagcagtttaaaattctagttggtgatagttcagtgcttgtttattcaaatagtgactgtataagagaattataaaacatcaggtaagtgtaatatttgaagcatatacagttggtatttactaattaacaagcagtattgctgagaaatttgcaaatgttaaaatagttattggcgtttgtgacccacatgtatgtgaaagtaaaatcataaacaaatgatcttataaaagattatagacagtttgagcatttttattgtatgttatgtttatataatatgtatatgttattgtacatatccttattcttttctttttcccagtcccttgctgaaagtggaacatgcctttattcttacacatccttctaaaataagaattacttggctgggcacagtggcttatgcctgtaatcccagtactttgggag

SEQ ID NO: 79320 - DNA, 1037 bp, Homo sapiens
cctctgtcagtgtaattgtaatgttttgttctgcagtttttcctacgatggcaggtggaaacaaaaattacagacatctgtggacttcccgttagaaaatcttgacttgtcacagtatgttattggtccaaagaacaatttgaagaaatataatttgttttctgtttcagtaagtatctctttgaactgaagactttttgtttcaaagcaagtttaaaaaaagttttaagtggtttcctacctcatggaagagtaagaacaacataaagctttgaaactattggcgtattttaaataacaattttaactgaattgatttttttttctatcttgtttggcacagaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagc

SEQ ID NO: 79321 - DNA, 1935 bp, Homo sapiens
ttcaagaccagcctgaccaacatggtgaaaccctgtctctactaaaaatacaaaaaattagccgggcatggtggtgcatgcctgtaatcccagctatttgggaggctgaggtaggagaatcgcttgaacccgggaggtggaggttgcagtgaaccgagatcgcgccattgcactccagcttgggcaacaagagcgaaactccgtcttgaaaagaaaataaaaggttcctaattctccatttctaagaaatactaacttttttcttttctctttcttttttttttttaattgttgtgggtgttcaatgtagatctgaagaggaatgattatacgcctgataaaattatatttcctcaggatgagccttcagatttgaatcttcagcctggaaattccaccaaagaatcagaatcaactaattctgttcgtctgatgttataatattaatattactgaatcattggttttgcctgcacctcacagaaatgttactgtgtcacttttccctcgggaggaaattgtttggtaatatagaaaggtgtatgcaagttgaatttgctgactccagcacagttaaaaggtcaatattcttttgacctgattaatcagtcagaaagtccctataggatagagctggcagctgagaaattttaaaggtaattgataattagtatttataactttttaaagggctctttgtatagcagaggatctcatttgactttgttttgatgagggtgatgctctctcttatgtggtacaataccattaaccaaaggtaggtgtccatgcagattttattggcagctgttttattgccattcaactagggaaatgaagaaatcacgcagccttttggttaaatggcagtcaaaattttcctcagtgtatttagtgtgttcagtgatgatatcactggttcccaactagatgcttgttggccacgggaagggaaatgacttgttctaattctaggttcacagaggtatgagaagcctgaactgaagaccattttcaagagggacggtatttatgaatcagggttaggctccatatttaaagatagagccagtttttttttttaaatagaacccaaattgtgtaaaaatgttaattgggttttttaaacattgttttatcaagtcactgttaagtagaagaaagccatggtaaactgatacataacctaaattataaaagcagaaacctaactcactcgtcaagggaagttaccttttgaggaaagttaaagtacttttttccctatctgtatctatagcaacaacccagaacttacaaacttctccaaagattttattgattgttatatcaaatcagaatgtaaacatgaactcttgcatatatttaaaattgtgttggaacatttgaacatgaatgctgtttgtggtacttaagaaattaattcagttggattatcattatgtgatactggcagattgcagtgcaaccttatgccaataaaatgtaatttaacagccccagatattgttgaatattcaacaataacaagaaaagcttttcatctaagttttatgctttaattttttttctttttttttctttttcttttgtttccttggtactaattttaatttttatttggaagggagcagtataaagcttatttgtatttagtagtgtatctcatagatacagacaaggcaagagatgataagctgtttaaatagtgtttaatattgattgggggtggggagaaagaaaaagtgtattacttaaagatactatatacgttttgtatatcattaaatctttaaaagaaatgaaataaatttattgtttacagatgtttagtgagtttaatcattctgaaaaattatctgacattttcagggtgtcaatttgagtatcagtttttttaaatgaaccatttgtatacctgtgcttttgatctcc

SEQ ID NO: 79322 - DNA, 1784 bp, Homo sapiens
tatagaatgtgggtgggattacattaagaagtatcaatttcaaataaattcttgattaatctgactaccacaagggtgaggtatgtttgaatagaagaagggaagcatcagaaatattgagtttctccattactggcatattcagaagcaacaatatattctaattctaaaaagttcttgatccactatctagtaatttatataaactgacatcacagtgtccatgaaacagctctaacttctaagtttaattcagaagtgtgtagaattttagttgcttttttaaaggttttctctaaaatgccagaatttcaaaaatgcctaacattacacatgaattcaaagatattatgaaagtatccttgatttcttacctattgctattaaatttctttgtataaaactacatcttggtccattttatcttctgttccttaatcaaagatgcctgctaatttttattttactttgtcgtttttaaaaagtcacaatttaatcttaaactttttccatttgtgttgcaggggagcctgtcacagtgtatcgtttggaagagagttcacccaacatactaaataacagcatgtcttcttggtcacaactaggcctctgtgccaaaatagagtttttaagcaaagaggagatgggaggaggtttacgaagagctgtcaaagtacagtgtacctggtcagaacatgatatcctcaaatcagggcatctttatattatcaaatcttttcttccagaggtggttaatacatggtcaagtatttacaaagaagatacagttctgcatctctgtctgagagtaagtgtcagtgaatatttaatagtggaacataatttaagctttatattttaacttctgaaatatcaataagccaaatataatcttagtttaaatattaaacaagggttctccccaccctcccttttataggaaattcaacaacagagagcagcacaaaagcttacgtttgcctttaatcaaatgaaacccaaatccataccatattctccaaggtaaatctttaatttttttctgggatcttttattatatggatagcagtcccttttgaccttcatttttgatgttgaatatttaattatccattttgtagatcaattagaattttattaacaaaactgctagtaatatttataactattttttataaggttccttgaagttttcctgctgtattgccattcagcaggacagtggtttgctgtggaagaatgtatgactggagaatttagaaaatacaacaataataatggagatgagattattccaactaatactctggaagagatcatgctagcctttagccactggacttacgaatatacaagaggggagttactggtacttgatttgcaaggtaaatttattaaaatattgctaaggtgaaattctgcagtaggttctcacctattcatatgttatacagaatctgctaatttatagataaataaaatcttaggccaatagaagctataaaaaagcaagttaatcacagtcatagcatatagccatcagggccttgagtaatagaatctggctatctttttttgttcccccgccccctcccccacccccagagggagtcttgctcagtcacccaggctggagtgtagtggtgcaatctcagctcactgcaacttccgcctcccggattcaagcaattctcttgcctcagcctcccgagtagttgggattacaggcacctgccaccacgcccagctaatttttgtatttttagtagacaaggtttcacca

SEQ ID NO: 79323 - DNA, 3130 bp, Homo sapiens
tgcctcagcctcccaagtagctgggattataggcgcccgccaccacgcccagctaatttttgtatttttagtagagacgaggtttcaccagattggccaggctggtctcgaactcctgacctcaggtgatccacccacctcggcctcccaaagtgctgggattataggtgtgagccaccgtacccggccacaaatatatattttaagagaatagaattgtcttcaaacaatataaaaattcataaagaatagaaagacaatgttgtgggaaataacagaattttttattccaccttgttgaatagtcttatggtagttacatttacagtaaatacagttataataaataaatttattgttttatgaaacaagaactgtatgttagttttttggcctttcattcttaaaatataagaaaaaaagttaaaccgttatgcttcatctagagatttttgtctttaaggtttttgtgtgtgtgtgttttttttttactgaaggattggttacaagatagaccatcaaacagagaaatgtaagtaagctttttcttaccattagcttgcgaagtatcatagttattgaatgttgtcttttttcctgctctttacatcatctctttaacatttctttatgagtgatgattatttattctagcatctcctctcttcacatagatgagattaggggaacaagtttattatgaattaatataaaagttaaaatttattattttcatatagttgtaccataattacaactctactaaggtcttcctaatagtgatacaattctgattttattatttagtcctgtttctaacttattcctgaataaatttgttgagagacctagtttgagactttagttttgtacttgcttgatttctctatccatcattctagtcaaaaccttgcatctgcttttggtaagcactttgatgattagagcagtaatacacagtatgcattagaaagcctgcatacaggaagatccactagaaagctgatgtggtaatccaaaaccaaaagtggaaactataggcaatctgacaggttattgtccccagaaagtaaaactttttagtacatattagacataagggtaaagacaaatctaagataatctctgtgtttccatcctaggaattagtattgtagaattccaaaggatatgcaaaaaaataaaaaaaaaagtcttgttttgacacccacctgatactggaagcatggtagagttattctgtcatatggattacttgagcagagaagccaatttgggggaaattattattctgcagtgtttttccccttctgtgaatcagaaataaatctgggccaggcatggtgcttcacacctgtgatcccagcactttgggaggccaaggtgggtggatcgcttgagcccaggtgttggggaccagcctgagaaacatagtgagaccccatctctaaattagctgggtatagtggtgtgcgcttgtggtcctagctactcaggaggcttgaggcagaaggattgtttgagcgcaggagtagtgagccatgattgcaccacttcactccagcctgggcaacagcgagacctagtctcaaaacaaataattttttttaaaaaagaaaataaataaatctgaatatataaagaagaaaataaacctgggccacaggataagcagctgctcaaattgagtttcctgaccctggaatggcatttggaaggcccacctatagtcagacctcttcaaggaatattttcttttataaccaaagccatgggatgtaagtacaaaataggcacttcaagttggtgttaattccggtgtctaacaacagaacattgtcttgcagaatgctgaccctgagaattacccataaaggtggagctgattggcagccctttgagtgctgagaaaagagtgattgattagcagcaggcaaaggaatgatgttaggttcaaaatactttttgtaagaaaatgtttctattaaggtgaaaatcaacaggaaacaacagggtcagatagaatgtaggagctggaaagagacaggttatctactcccaaggtcctttctggatctggtcctttcattcctgagcaaggctacatagctgtgtaatgaaagtgctaagcctctaacccgttttcctttattctcattctgttctcttttccactctacctgtgtgtctagttgacactggaatccttggaagtaaaagaacctgcatttggtgccagtgtatgttgttataaataaatacagttaacattgggagaaatatttttcaacattagaaactaagaggcaaaatgacatctacttacttttctctcagttctttgtccatcaattctattgaaatatttctagcatcctgcaaagtcatctcaatgtattgttacagtactggaatgaatctccacgaatacagaagttatgaaatagtttattagtatagagccttcaatttggcaccaaactgctaataatatttatgcataaattggagatacaagttattaataagtagatacatatggatatatatatatagatatatatatctatatatggattgggattggcttaagggaaatggcaaatattcaaagggaatcaatttcagaatttccttaataatattttttatataataattgtataaaatcaaaaaattaaatgatagccaaaacttaaatcatagcacagcttatactatattttttggtgtttctttaggccatctgaagaaggaacattaaatggtgagtctgtgtggtagattgaacgtgaaaaaaatgagaatcttacatgatctgttacagcaaacaccacattattctaggtaagatattttagacttcaagctagaaaaagccaaggtattgaagagttcttccctcatatactttctccttactgtagatgtttcacaaacacacgaatcaccctgtgaatgatgatatctttactgtcacacttcctccctgctacttggtctctgctatacagcctgctccttttctaatattccatctgttttaacaaatgaaacttttagtcagctgagttattcttgaccaccttgactttgtactcacaaagtcctattgcatttacttcctaca

SEQ ID NO: 79324 - DNA, 1624 bp, Homo sapiens
tcaggaggcagaggttgtggtgagctgagattgtgccactgctctccagcctgggcaacaagagtgaaactctgtctcaaaaaaaaaaaaacaaaactctaagcttaaagtttaaaataacaaaaccctccagacatatatgtttctctaccatttatgttaaatattggcgggggtatgtgtatacacatacaaatatcccaggaagaatatgcaagaaatgaattacctttactgtccccagtcagggtgattgggaacaggagggggagaaatttttttttacttcatactctcatttattgttgccttttcacaataaattgaatagtttactcaaaataaattgaataatttatgggcctcatgtaactcttgtgttcagcgtgttgaggaaaggttgagttatcttatgaaggttatactgtgcctagaatactttgtgtttggttagttggtattcataaaacttcagttgtgtagcttttttatattttttaattttcttttagcagaaaaaatcagtagaaggccatctaccgaagacactcatgaagtagattccaaagcagctttaataccggtttgtagatttcaactaaacagatatatattattaaatacattaaacttttttagataagatctacaaagtggtgatatttgggactatatcaaaaattcaaaaaaatttttcttaagaaaactgactttagcatagtagcagttacagaaaagtttcttacagtgaatagtcaggaattttaaagaaaaatttatgcagaataaaggcaggaatctctttttgtttgaattgaagctaattatatgaactcatttccagctaactgcgataatgattgattttgcaaattccctttaaaagcacacactgacaagacaaaaagctcaggaaaaggcagaaaaattactcctttataatcaagtattatatataagtcagtgctcataattttgctcaagaaaatattgacttacattcaaaatatatctgttctggcatagagagattatgttgttaaaatcatgttattgaaaaaagttatttcagtggggaaagaggttagttaacaaagagattcacagtaacaaatcctcctttctggagggactcttcctgaccctgagctgcacaactttgcaacaaattaaagcctaaccgaagatgacctcacaatggcaatttagaactcatgggagtcaacttacataaacggtatttgatttctgataagatagtggaattattggttatagatgacaaaataagtatgtttaaagtgatgatggacataaaaaagttttaaatataaaacatgagaaaagaaggagatactattcaaaaagactggcaaatttgaaaaactagaaataaaaaaaaaactcggtgggggctgtgtgcagtggctcatgcctgtaatcccagcattttgggaggccgaagcgggtggatcacttgagatcaggagttcaagcagcctggccaacctgacaaaaccctgtctctactaaaaatcaaaacttatctgggtgtggtggcacatgcctgtaattcagctactcgggaggctgaagcaggagagtctcctgaaccagggaggtg

SEQ ID NO: 79325 - DNA, 1065 bp, Homo sapiens
gcaccctacgcctcccgggttcaagtgattctcctgcctcagcctcctgagtagctgggactacaggcatgcgccaccacaaccagctgattttgtatttttagtagagatggggtttcaccatgttggccaagatggtctcgatctcttgacatcatgatccgcccgcctcgacctcccaaagtgctgggattacaggtgtgagtcaccatgcccagtctgagtttttattattataaaaaattcatttggatggatttatgaacagtaggaaaataaggtgttttggtgcagcttttgaaattggcattgaagaaaataaccataatctataatacacccattggtgtccaggtagaataaagcatattgagctaaatagatcaagggactctaatactacttagagtaatgggttgaaatttagttcaattattttcaaattatatgtctgcacaatatttgcagaataacaatacttctgaaaacactttgaaacgagtgagttctcttgctggatttactgactgtcacagaacttccattcctgttcattcaaaacaaggtgagtattttgaccatatgaatagtgtcagaaaacatactcatttacactttaaatgtattttatgtttgtcaaacacatgagcagtgaatggtgcaggagtcagaagacgaaaattctgatctgccatagtgactgtaaccttgaataagtcgtaatcctagcattcattagaatgttttattagaatatgttttacaaattgtttattctgtaaagatggaatagaaaaactttttgtaaatctgctgcttttagcttttgcaaatgtatctgttcatctgtatcatgttttaatctgtatcatcacttattcaacatatttttctagtttaacttttaaaaatcatacatttttggttcaaaattaaaatacacacactctgaaaattttctctctcactctgttcccacatttaccactatttgtctaccctttagagtttcatgcttatacagtcatgtatgacagtacaatcttatacctctcattttttaca

SEQ ID NO: 79326 - DNA, 3366 bp, Homo sapiens
tctgtttctgttaaaatggtaatgtaaaccgaacttctttgttgttctacaaaccatttttacagctctgtaaacaataacaattttagtacattctgtgtacatgagactaatcatactgtgtcaaattatgcttaaaattttacagggactttcaaattagttcttaaatttctctgagtagatacgtgagggagaggtatgagagagatagcggagggatgttgtataggaaaaggaaatcagaagaggaggaggaagtacctgattgtattctgctgacatcacactggtgaagcaaaaaagaaagataattgtctagtgctttagaagcatagtagtaaaagtttaaaaagtgcagatgatggatgtagtcttagaaaccctgaataattcgtaagaattatgagctaaagttgaaaccttgatagctcttccttgattttcttctccttttcctcccatagaacttttcttaacagaagaagatcaaaagaaacttcatgattttgaagagcagtgtgttgaaatgtatttcaatgaaaaagatgacaaatttcattctgggagtgaagagagaattcgtgtcacttttgaaaggttcagaagccctttagttaaaatcggttatatgtcaaaatgggatctattcgttatatttcttatacatggtcattgttaaatttattttgtcaaacaataagcatagttacagttttacatgatgtattggaaagatcgttcagttctattaatacttcatataagtcagttggtcagtctcttatttttttaccctagttacagaagatagaagagtttactgttctttactgtttggagggagaaaagtaaaactgtcctcactattttacagcattttttattatcatcattattattattatttattttatttttatttttttgagacagagtctcctcttttgccccggctggagtacagtggcacaatctccactcactgcaacttccgcctcccaggttcaagtgattctcctgcctcagtttcctgagtagctaggattaccggcgtgcaccaccacacccagctgatttttatatttttagtagagacagggtttcaacatgttggccaagctggtctcgaactcctgacctcgtgatctgcccgcctcagcctcccaaagttctgggattacagacgtgagccactgtgcctggccagcatttctttttttctgttggcttcactacattctggaagcatatggtgtttggtaacagttacagtaacagtaatggtagttctgtatatatgtagctgtatatacattattttgtgttactttgatgtggggtaattggaataagtagcctgtggaacaaaaacgttttttgaaatcttgcattttaatataagattagcactggatccttcttaaacataaggtaggccttgtataattaaataactgtaccttattttatatcttgtttaaatgcatgtgaaatttttctctttttatcattattatttgaggctacaaaataaaattctacattattttttcacatttgtaaaaaaagcttatttctctcctacagagtggaacagatgtgcattcagattaaagaagttggagatcgtgtcaactacataaaaagatcattacaatcattagattctcaaattggccatttgcaagatctttcagccctgacggtagatacattaaaaacactcactgcccagaaagcgtcggaagctagcaaagttcataatgaaatcacacgagaactgagcatttccaaacacttggctcaaaaccttattgatgatggtcctgtaagaccttctgtatggaaaaagcatggtgttgtaaatacacttagctcctctcttcctcaaggtgatcttgaaagtaataatccttttcattgtaatattttaatgaaagatgacaaagatccccagtgtaatatatttggtcaagacttacctgcagtaccccagagaaaagaatttaattttccagaggctggttcctcttctggtgccttattcccaagtgctgtttcccctccagaactgcgacagagactacatggggtagaactcttaaaaatatttaataaaaatcaaaaattaggcagttcatctactagcataccacatctgtcatccccaccaaccaaattttttgttagtacaccatctcagccaagttgcaaaagccacttggaaactggaaccaaagatcaagaaactgtttgctctaaagctacagaaggagataatacagaatttggagcatttgtaggtaagtttggcaaattcgtatttgtatatcaatattatttacttttcaccttagaaataatagaaatatgtactgttacaagtcattatcttttcatagagtataattataaaatttttaaaaagaatcagacacctgtgattctggtactttgggaggctgagtggggaggattgcttgagcccaggagttgaggaccagcctgagcaacatagcaagaccccatctctacaaaaaatttttggaagtagccaggcgcagtggcatgtgcctgaagtcccagctactcaggaggctgaggcaggcgaactgcttgcacccagaagctgaaagctgcagtgggctgtgatcacacaactgcaccatagcctgtgtgacagaatgagaccctgtctctagaaatgaaatgaaaaaaaaaaaaaaatcagaagtaggggaaatagactgaattaggctataagagttatattggcacataacctctttgatggaattttaggttctgtcttttgaatttgaatatcttcaattgggtttcatcaactcttgttgaaaacctaagtgattcttaagtacttggagaacctcataggggaggttagaatcaactggaaaagaacagtgccctataaatagatgaccatataatttttttacccaaaccaagacactttaaaagtgaaagggtgcactattaataattatatcagaacaacaatggaaatctaggaatctactgggaaaattagtacttatggtgtacctatttatatattcacagagaacatttcaaaaaggaatgacttattcttatacctatgatagcttaaataagataagaacaaaaaaaaatgtttattttggcagtaacacattaaagaccttagtgaaaactttcatgcatagagattattcagacagtatgttaataagcccatggaaaattgccacattaaggccagcctaggaagttatctaggcactaaacatgttgatattacttctaggctatatgggattcactctagatacatagatataacttttcctacgttaaata

SEQ ID NO: 79327 - DNA, 1074 bp, Homo sapiens
caggagaattgctttaacccaggagccggaggttgcagtgagccgagatcgcgccactgcactccagcctgggtgacagagcaagactccgtctcaggggaaaaaaaaagtttggacatttttcttacagaaatattatcatatggttgatccaggaattttaccctctttagtgctcgtcaggttaaaccctgcctcgaagggtaaatataacacctaaatatactttcttttctggaatagagttgtaaaacagatagcacccacatttctcacaacatctttttgtgtttgaacactcttaagctggggttcctatgtctccttgcccagatgcttttgctggaatctgtgaaacagatttgtacataatcgaaacttactttaagtaaataaataaccagaaacactcatgaatagcagttactgatgaattactatttttaagttgtttttgtttttttctttttttctctctaaagtgtgtgcaaatgattctgttatccctcaaatctgtggtcctgggacgtggttgactccatttcttcaagcagtctacctctttgtacagtatatcattatggttaatcttcttattgcatttttcaagtaagaattttgttcaattgtttgttataagatgatttaatatgcaattctacatattttgaaggaaatttatagaacttaaaatctaaaaattttattgaggcttaaactactaaaattatatttgaaaaattacaaataggagatgctttttctaatcaaatgagttctaaattttaagtttgattatctttcaacctgcagttttctttataaatttaatcgttatctgggatttttcctcggttgccaacaaatacgcattcaatatagaaaattcatcagtaattccactgttaatatttgggtgtacacctttctatcattttttttgcaaatatatgtaaaccatttttcttttcagaaatagtatttttatttaatttatttatttttgagacacagtctccctctgtcacccaggttggagtggcacaatcttggctcactgcaaccttagttttc

SEQ ID NO: 79328 - DNA, 1466 bp, Homo sapiens
tatacctaaataagtagatgggaggtgaagttttattatagcattctgcttaattctttgaatccttaaataattatgtcaaaatgtacattgtaatttaacaatgaaaataatttttcaatgaattactaggttttagctcaattaggccctttttgaattttattgaaattaaagaattacaaactacatgacttacaaaagtatttgtttcccagacattggtgtcttttagtttttcaacacccatgctaataattcagattgttttgtttggctcctaggaagttttcatatcccaggacaaggcacccatggattcagggtgggtgggaagtgttctttttttgtgtgaagtgggcaaagtacaattaccagaggcaacatggaaaagagagagtctgtgcttccattataagaacagagaagctttaggaaagggcagttgtggaaattgattccctaaatctgtctgtgtctctgtacttcttgaaaatcttcacgtaccacagagataggtacacttcagtttgaaccagtgatacaattcattatgtagataaagatgcccatgacttgcttagcttaatagatttttttttacgtaatctcctagatgttaagatttatatagtgatgaaattcttctgaaagctatcactaggaacaaaaagaatctcaaagattttttgtgtttaatggatttttttggtctattagaacattagaagcttttagaaagatttgtcatagtgtttaaacttccttgtattttaacagtgttcattttttaacaggtggccaatatgttctacattgtagtgattatggctcttgtattacttagttttggtgttcccagaaaggcaatactttatcctcatgaagcaccatcttggactcttgctaaagatatagtttttcacccatactggatgatttttggtgaagtttatgcatacgaaattgatggtaagaattgtatatttacagatttatcttttggttattttgtgttttaaaaccaatattgaattatagtaatattgcatattttcagaagtcaaactattaccaacctaagccccacacaaaggcgttagtgaactccagaagaaacatacaaattaattggaagaaaaaatattttagaatttttttagtggcaggtattagaagtctagtctaaactgtcctaggacacaataagggcatttattaactcacataacaatattgagctaggtctagtggtctttagggttggttaattcatagctaaggacacttgttctttttcttccggctgccaactctataagtttcccttatgattctaagactgtcattagcaacaggaggaaagagacactgtttatcgatggttctctttagaggaaaatgtccctttcatagaaattcccttttgaacctgtcctttcatttcattagcttgagttggcttc

SEQ ID NO: 79329 - DNA, 1066 bp, Homo sapiens
attagttaggtaaatacagctacttaaaccattgagttatttactttctacaaagaaggcaggtttggcagctactaccaggatatccaggtgctgccttaatttgaaataaaacaatttttcaaaagtattttacaatccaggtctagagaactgggttgtaatctgaattttcagcttcttagttggatgaatctctggaacctgggagacggaggttgcagtgagccgagattgagccactgcactccaccctgggcaatagagcgagactctgtctcaaaataaataagttaataaataaaagctatgtgaaattctactgtaatgttatagttgaatgctgtatgtgttttaataggaataaactgattacacttttttttgttgttgttaaacctttagatctttatgtctgaagctgggaaagtaaaccagaagattaaagtatggtttagtgattacttcaacatcagtgatacaattgccataatttctttcttcattggatttggactaagatttggagcaaaatggaactttgcaaatgcatatgataatcatgtttttgtggctggaagattaatttactgtcttaacataatattttggtatgtgcgtttgctagattttctagctgtaaatcaacaggcaggaccttatgtaatgatgattggaaaaatggtaagttgacagatgtttgataatactcgtgggtttattgattttttaaaaaatcacaaaaatgttattaacatagttttatttgagccagtgaatgtcttttattttgtgtttgtttgcctcatacttcacatctgccattccttaagagtttctcatgctcaatcccaatcccctatacccatttagtgctttgcaagataatgttagctataccatctatggtttatgtctgtaggtaactcctttttcctgtcttcactgatccaggctttttttttttttttttctttttgagacagagtttcgctctgtcacccaggctggagtgcaatggcactatcttggctcactgcaacctctgcctctcaggttcagcgat

SEQ ID NO: 79330 - DNA, 1081 bp, Homo sapiens
tgacctcagatgatctgcctgcattggcttcccaaagttctgggattacaggcgtgagccaccgcggcgtgccccagttgtcttttttaggaatactgtttggtttggggaggaaggaggcaggaaacatgtgttccttgatgattatggtggtgaaattctgcagtaattttaatatattatgatactgtaggtatgagttaagcagaattgtgtggcatatgctgagaacataaacctgattgtaaaatcccttctgtgggacgttctaaaggttgacaagagttgtagaacaacacgtttatactctggggaccatttatacaccaataaatgcaatgtctgtgctgaagaagagatatttctaaaattgttttaataaaggaaactaggagataatttacagaggttcatttaatgtctgtttttgtgtgtgtttgaaaatgttcataattaaaagatttattttgtaaccaatgttatttatgtaacctttactttttcattagttggcatatttaggatttctgatgctttatacatttgtggttcttgtacaaatggaacagttaccttcagttcaagaatggattgttattgcttatatttttacttatgccattgagaaagtccgtgaggtatgtctttagtttttttctaccaataatttactgtatacatggaagattttctgttttgttttgttttgggtgtatacgtaggggggtgtgtgtgtgtatgatgacattgtagaagtgtagaacctgtgtaattttgctgttcccaaaataatggcaaaagaatagagattagtgagtatgctgtatactttgttgccattacagataaaatgatttgtgttagaaatgtagcctataaaaatgtaacctgtattttgtttgtttgttttatttcctgaacattcacatttttgctctctgtcactcttcaaaaagtattaaatatacttagctaaatgacttttaatttacctacctgatttagccaattaggtaggtaagttataaataggtctttaggccaggcgcggtggctcacgcctgtaatggcagcaccttag

SEQ ID NO: 79331 - DNA, 2195 bp, Homo sapiens
taaatctatcctatacccttattatcataataatcaaatgttttgttactctttaaaacagttaaacttgggcctctttaaatacaatatataagtaaaaaatcaatttgttgttttttttccctctactgctaggggcaaaatggctaatcacaagatatttaaaatcttttattgtttttattctttgttttgtttttattatattcttgaaggtcattaatttttaaatgcaaaattatgtttctaaaaatttaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggtaagcaggaaaacattttaaagtaaatataagtttgttctgaataattgtacaaaagaatttttttttttttaattttaggaagtgtttaaagaagtacggattttggatagtaatgaaggaaagaatgagatggagatacaaatgaaatcaaaaaagcttccaattacgcgaaagttttatgccttttatcatgcaccaattgtaaaattctggtttaacacggtatgtttttaaattacacaagcataatgtttttaagagttaggctttgggggaccattggttcggaatccatactaatgttgatataacttagatcactgaaaaggcatttcacatttaaaagagtgatacatttgccttagtttcatttaaattgtcatcatctagagtgataaacactaacaaattttagttctaattggaaccaaaaatgtacttaacaaatatacaataccattggcctttgtaagttggtagcaaatactaatcaactagtaaaaataatgataaaagatggaccaaaagagattctgatacacagttataattttttgtgctttaggattttgcagatgatacataaaagtctagaaataaacctgtttgcagtgttaattgatgatgataaaaagtaatccagattgtttatatggttttatttatctgtggcttatttctttaattgtattaaagtgtatgcttgattaccttccatataattggcttttctcttgctttatggaaaaattgattttactagcaggttaaagagcatatgtccatacaaggatggactcacctgttattttggttgaaatgtaggtgtttatgtgttgttttggttgttttgtgtggagaatgagcactaggaaatattagttggctgtcttgctggtgctactttccctagcaatggaccaacctgaaggaacaggtgatacagcaaatgagattagcccctacttttaaccagggactgagtaaatgagttcttaactccccgtcataggaaaacccttaatgaagatgttttttaactttgttgttggggagattttttcattttcatcaacaagaatttgtttctttggtgattgctttttcacccacacatgtgaccattaacctgagactaacatttccttacacctctatatgaaaatgttcttgttccttcctattcagaggctggaattgcaaatatcagttatctgatctaatctccaaattctgtctccactgatgaaaatagggcagtttgcttacatttgcattcatgtgaatggctgcgttaaaatagccaacatgggtgactacaggaatttctcttttctttctttactgcagtttactccctagcctgccacagataatcaaataaaggatgtgacttattctaggactggtggagacaagacataaaagtctagaaataaataaaagacagatgagaggattcttacccataatttttcaagggtcaataagtgtgggttttcctctgaaatgaaataaatactcacatgtatttatacataaactttagcacctctctgtaacctgttttgtaaagagtatcaaaggtgggctgtttccttacctgggtcaaagccacttcacattttttccactttttggggttcaactttagtgactgggagctaagaaaataccagttgtctgtctgtcttgtcttgtctttttttcttttcttttctttctttctttcttttttttttttttttttgacagagtctcgctctgttgcccaggct

SEQ ID NO: 79332 - DNA, 1442 bp, Homo sapiens
agtggggtatttagagggcagtgataattgttactgaaaataactctttaacagggatcctatggttacttagtgggacttcaagattcagatgtttttcataattaggttagtccctagtcacattgtttttcctctctaccaggtaccaactgttttctgtgtttgaaatactacataaacttttttgaacagagcattgtagcattgtgagttttgattccctttgagattatagtttgatttctaggaccgggagaatgtgctctggattcaccttctcaatcttgtacataatgcgacatattttaatattttgtgatttccacatagatgtagatgtctgaaaacagagttatggttttaatgcctcataattctgtaagtgtgtgtgagaatattaaaaagtaggaagtattaatgtatataagaatagtggtttaaaattgcagtttgttaatctgagtatattttggcttttatctttttatagtgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtatactttagaaataatttgatataaagcatgtgattagataaaaagaacagaagaattagtctaaatgtgtagtaaaatgccttgatgtgtgagtgtaatggtggggggtaaagagggagcaagatggatgattggcatttcatcccaagtggtataatgggcttcttttttcctctacttaacttttgaatccttttcaggtgtctataatgattatggcctctctttgagctagaaggggaacaaatggcaaatattggagattatggcccctagcagccttgaaaaaagttactactttatgaaaagattattcccaaattctgaaattcaagacctatctactaatttaataatctgttacttttaagttacttaaagtatattggatgagtatattgatatacccattatagataagtatatccatgtggcctgtttttatgattaaaaatttgggtaaaatggcatgtacctttggttttgtcatggtgatagatactgctttgaactttgctttttgttatcttatatcttttaaaataaggtgcagaaatgtaggagtcagaaatcaggcaaatagtttaaccataggccactgaataaccaacagaaaacctgttacacaattacaatttcttcatgctttgggattttgcaagtaataagtaaaattttagaaataaacctttttgtttatagaggcacaagctgagt

SEQ ID NO: 79333 - DNA, 1082 bp, Homo sapiens
ggccagtatggtctcgatctcttgacctcgtgatccatcctcctcagcctcccaaactgctgggattacaggcgtgggccaccgcgcccagcgtacattttcatatttaggtatgataataaccaaattaaaatgttttaataaatgtttacctgactcctttcattccagttttacttgattaagaacatgtataacaaaaatgttatctaaccctttattaaaattatgttctattagaatattagttgaaatatttaggcccttaaattttggaaaatgtttattgcaaaggcatttttgttgaaacagcattttcataaaatgaattatgagctataataaaaatcaagtttataaaatttatgctattgtgcagttttatggagctgaataatgtaaagatattttactaaaattttcactgacataaatttcatatggccttattataatgagctttataactttattttccctggaagattgatacagttatggaagaaggaaagaagaaaagaaccaaagatgaaattgtagacattgatgatccagaaaccaagcgctttccttatccacttaatgaacttttaatttgggcttgccttatgaagaggcaggtcatggcccgttttttatggcaacatggtgaagaatcaatggctaaagcattagttgcctgtaagatctatcgttcaatggcatatgaagcaaagcagagtgacctggtagatgatacttcagaagaactaaaacagtattccaagtaagtggtattttatcatttgaaaacattttaaaaattcaaagtaggtattgtttgagtggctgttacagtgccacgtacttaatggtgatgtatttatatgtataatcttattggtacaattgacagaaaattatataagtatatatttttttaattaaaagaaactttctgcctctatgaaaaagaggttattatatttgcaactcaagaattaaatatctcagcaagaaagaagaaatgcagcctgggcaacataggcagaccccgtctctacatgaaatttaaaaattaactgggtgtggtggtacttgtc

SEQ ID NO: 79334 - DNA, 1027 bp, Homo sapiens
catgaagcttggtggcatagttaagtacaattattatgtctttccctttggattgtaaatttctttgaagtaggtattatatctcattttctcccttttttttctttttttgagaaagaatctcactctgttgcccaagctggagcgcagtggcacgatctgggctcactgcaacctctgccttccgggttcaagcaattttcctgcctcagcctcctgagtagctgggattacaggtgcatgccaccatgcccagctaatttttgtatttttagtggagatggggtttcgccatgttggccaggctggtcttgaactcccgacttcagatgatccgcctgcctcagcctcccaaagttctgggattacaggcgtgagccactgggcccagcttccattattttcttttagtatgtgtagcacatttgcgttgaactttgttggcattttactgtccctagtggacagatgtaaaaattaaaaggattattcattgtgctgtagtaaggtttatacctgaactataaagcaatgtaaaataataaaaataaaaattgatcccattagcaagacaagtaattttttaaattgtatgactcaaaggtgttaagataatactgtagttactttcagcatcaattattgatgaagttttaaaacatttaagggcttgcaacatgataaagcagtagttctcaaactttttgattttcagggttcctttacattaaaattattgagaacttcaaagagcttttctaaagaggttttgtttgtgtgtgttggtattttagaatgtaaaaatgagagttttaaaaaatatttgtttttattaaagtagcagttatatttacttaaaatttctaaacttatcccatattaacataaatatttgttcttatttcttttttcttaaattagcacccttctgcctgatactttttttttgttttgttttgtttttttgagacgcagttttgctcttgtcatccaggctggagagcagtggcacaatcttggctcaatg

SEQ ID NO: 79335 - DNA, 1305 bp, Homo sapiens
tttcagtcataaacatctaacaggataataaaaagttgtgtgggatgcgggatagtttctttctgagtagaattctccagcatattgcatgatttctgatgtcccttgaccctacccattaaatgttagtaacagcactcaattattgaaataatccttcccacaaaaccttccctaaacactgagagcattgctttaaggtattctttcccaagatttaattgatgatggattctgttttttcccccatgtaacacttattctcctacagaagtagtgtttgtggaatattctttaagaaacgttgttctagagaggtcttttaatctattccctaaacacctaaagtcttattagctttttactgtgttgcatctttctaattttgttctaaaactgttgggaacaaattaaatgtaaatcctaaggacttaacatttaaaagtgtttgtataattagaatatgtgaaatatgtatttattaaatttgatactcctaggttggatccttggaacaagctatgcttgatgctcttgtaatggatagagttgcatttgtaaaacttcttattgaaaatggagtaagcatgcataaattccttaccattccgagactggaagaactttacaacactgtaagtctacattaaaattctttattgactacattttatcttttgggaaatgttactttacctgaatatagccattcctattgataaaacccttaatgtcttccttagttatatgaaaaaattatagccagtcttagtatggattggttgtattacagtctgaaaccctttccttgtttttagaacccattccctgtcaccataaccacatagggctattaagcctacctctctttcctgtgtatttccctttccctccccttatcaaaactagaggatcaacttcttaattatagggtgattatgtttcttttgactccgttgtctaatggaggaattatgcattgcttttttctctttttttttttctttttttacattcattgtttgacctcatggtataccccttttagcttacatactgttttcattttttttgtaaaggactcctgaaaacttactattctcgtaacaaagactttcacattttattccaaatttttattgtattagcattgaagatatactacccttcttagtggttttctgtgttatgaatatgagtttactacccaaatccttaacttgattttcaaagatcttcatatattgccccatctacttttctcacttggcctttttattgccccccaaatccagggcggggcgg

SEQ ID NO: 79336 - DNA, 1034 bp, Homo sapiens
ggctacttctgaatggtggctgacaccagctgtgtaagttaactaaagaatggtggggagatgtcataagtgttcgtgctgggcactgtggctcacacttgtaatcctagcacactgggaggccgaagtggcaggatcacttgaggccgggagtttgagaccagcctggtcagcagagtgagactgtctctacaaaaaagttaaaaaattagctgggtgtggtggtgctcatctgtagtctcggctacttggaggctaaggcgggaggtacacttgaacccaggaattcaaggctgcagtgagccatgatcacctttgcactttagcctgagcaacagaccaagaccccatctcttaaaaaaaaaaaaagtgttcaccttttaatggagataaattaattgaacctgtcaactattttctttattcgattaggtactaatgcatctgcatttgaccagcttatccttacattggcatgggatagagttgacattgccaaaaatcatgtatttgtttatggacagcagtggctggtatgtaaataatctacatacacaatacaattaaattacactaagtaataaaaaagtatttgcgggaactgtgacctgacttgacattttacctttctgccaatagttcaaaaatagtttagctaagtatttctacaccattccgatccagtttaggatttaatgtatgcctctagataaaaccttatttttttgtagagtatatagatctctaagaatcttagaactgaaagaagctttaaaactcatgctctgtataccagagagtccattctagcattccccctgatgtttagacctattccttttttagtcttcctcatcctactaaatgggaacaacttcttcctagtttctaagatgagactctttagtgttatcctttacttttctctttctcatgtattccaatccaattccatctgtaaatcttgtcagatctagtttcaaaatacctaattttatcatcctggtctagtctgtcatccttcttttgtgtta

SEQ ID NO: 79337 - DNA, 1038 bp, Homo sapiens
gaggccaggagttcaagaccagcctggacaagatagacccatctctacaaaaagtttaaaaattacctgggcatggtggcatttacctgtagtcccagctacttgggaggctgaggtggaatcacctgatcctggaaagttgaggctgcagtgagctgtgatcatgccgctgtattccagtttgggcaacagagcaagaccctatctcacaacaaagaaaaattagctgggcatggtggtgtgcactctgtagtcccagctgttcaggaggctgaggcgggaggattgcttgagcccagggtttgaggttacagtgagccattatcacactgctacactccagcctgggtgacagcaagaccctgtctccaaataaaaatgtgtcactttcttaatcagctgaaaaataagtgtttaaaggttataaggcattagttgatagaatataaagataggattttaaaacatgtcatcttcattatgaagggaaaatttgaaaactagtggtatcttttaggactaagggattgaagcacacacacactgatcctcttattgtctccccaaagacatccaacagatataacaacattatagcgaaaaatcttctcagaaattagaaactatgacggtatcccatctgtctacctgaaagttagtgtagagtgatgtgccaggagcccagcacattaagaggatactgtccttttatttacaagaattttcttgcatattagaccataataaattgccaatacatcaagcatttttaaaatactgtgataaaatatatttatatcatctggaatcatggtatcaagagatcacaagtgataggaaacctagaaaccaaaaaggaaaaaaaattaataaatgggagtgcataaaaataaaaagtaaggctgcgtgcgctggctcacacctgtaatcccagcaatttgggaggctaaggcgggtggatcacttgaggtcaggagttcaagatcagcctggccaacatggcgaaacctcgtctctactaacaatacaaaaattagc

SEQ ID NO: 79338 - DNA, 1051 bp, Homo sapiens
agttgtgatagaactgggcagatgaaagagagcgggaaggagactttcactattaattttaatgttttaacattttatgttttctactatttttgagccatgaaaatgtattaagtattcaaaaaagaaaaatgtgagttcctatgtttaagaacatcgtggtgaaatactagtttatacatcataagatcttcaaattatttttatacaatatcttatgtaagtactgatattgccacacacatactttttgataaaattcacaaagtaattcaaagagaaaaatcactccgtttcatttattttccttctaacatttgtgttgggagtctcatgtaggaagaaataatcccacccaaggtgaagtatgtaatattaatccattattttcaaaggtcttacatggatctacctgtacttcatattgatcctacaaataatggaagatgaaatcagtgaattatgtttccttttattccaggaatcttcctgatgcagcagagcccgatattatttccactatcaaaaaaacatttaactttggccagaatgaagcacttcatttatttcaaacactgatggagtgcatgaaaagaaaggagcttgtaagtagatttcagcagaaatttaaaaagctgataggccatttttctttcattcaaaacacattctaaactggtgaaatacttttgtttttatttggattttaaactttgaaatctttattaaccataaaaatatgtcatttattggtctgttcaagttgagaggtatcatagaaggaggcctgtagttttttatatggtattgagactgtatttgtgcttctgttttaggaaaagttttaggaaaagtaactaggtctcaacagataatgttcagtaccaaggaagaactataaagagttgttaatggtttctctaataaaatgtttggaaaaaaatttttaatgtgcttaagcctattaaattaaagatcagtgctgctttgtttcaatcatgtaaatgtgggcataagttttcagagataaaatttttagcaagcctataaa

SEQ ID NO: 79339 - DNA, 1024 bp, Homo sapiens
catgagccaccacgcccggccaagactgtcattaatttctattttaatgtctcatttggaatcagaaatatatattttaaaaatgaataaaaatcaatgttagaagttcaactaatgtattgtaaagcaaactaaaaaattactgtttacatttcacgtcaagagctcagtaaaatatggaaaacaaatttttacttttaagtagtgaatatataaattatttgctgtctattatatattggattttctaattttgtcatttagagaacagcttttaagatagtgacaaagtattcattatttaatttacttacgtgaactggtatcaggtggagtgcttaaagtcaagtcaacatagtcttagaaattatgtttttactttttaattttttttcagtaaaatctaaaattagagtactgaattttgcctaatttttttttcttggagagaaacttgcttgggatgaaataattttttaatttaactttgctctttttagggattggccagggtgtccctgtggtggcacttatatttgagggtgggccaaatgttatcctcacagttcttgaataccttcaggaaagcccccctgttccagtagttgtgtgtgaaggaacaggcagagctgcagatctgctagcgtatattcataaacaaacagaagaaggagggtaagtgtatgacaacattttaattaattttatttatttatttatttatttatttttgatacggagtcttgctgtgtctcccagcctggatagcgtgcagtggtgcaatcttggcttactacaacctccacctcccaggttcaagcgattttcctgcctcagcctcccaattagctgggattacatgcatgagccaccacgtctggctaatttttgtatctttttagtagagatggggtttcactgtgttgggcaggctagtcttgaactcctgacctcaagtgatccacctgcctcagcctcccaaagtgctgggattacaggcatgagccaccatgcctggcccatt

SEQ ID NO: 79340 - DNA, 1876 bp, Homo sapiens
tgcatgagccactgtgcctggccacaatatcttttatatattgtagtttagtcacttaataatctgataatagtttatttgcactatttagttatttattgcttctctctttgcatgtgatgatgaaatatataattctgcagtatgggtcaagatataatcatgtgtttcaacccattaatgattaatcctcagctgcttaaaagcttacgctttttgaaacattctttgtcatttggtatttatttctgtatgtaaaatagaattttacttcttacttgtctttacggattatttcaaaatttattttacatcatactgtatttaatcctgctcactaactcttttgtttgctattgtttaggtggttgctccttatcaaaccttattgaaccccctgagcaaattgaatgttttgaataatctgcattcccatttcatattggtggatgatggcactgttggaaagtatggggcggaagtcagactgagaagagaacttgaaaaaactattaatcagcaaagaattcatgctagtaagtgaattcacaaatttgttattgttgaaattgtcctgggctgtactaatagccaaattcaaagaaagtagaatgttctttgaagtgctctttcttacatagcaagataacatatgaaacaaccaacagtggttgatcttagacaaaatgataagaccaaggaaaagaagtgaaaattgggtactcagttatcaaggctaaaaccaaaaaaggttcattggaagctctgttgttattgcaattccatttcagcccaaggaattcataaatattctttttttttttttttctttgaggcggagtctcgctctgtcacccaggctggagtgcagtggcatgatctcggctcactgcaagccctgcctcctgggttcacaccattcttctgcctcagcctcctgagtagctaggactacaggtgcccgctaccatgcccagctaatttgtatttttagtagagacagggtttcaccatgttagccaggatgatctcaatttcctgacttcatgatctgcccgtctcggcctcccaaagagctgggattacaggcgtgagccactgcgcctgacccataaatattcttaatgtgtgatttattctaatacatggctgtgaaattcaagattgaaaactaaaagggaaaaaaatcactgaaagaaataaatcagcttaaaatttatgaaatgagtatcactgtttggctaaatgtgtcttaaaaattgtattcctgggactgatttttctttccaaccatgtctgaattttctggttcaacatctaaatttttatttcaaataaaggaaaatttgtaacctaaggaccccaggaagttgagctctgtggtaaagtgaaatagaaataaaaaaactacagaacagtgtttacagattatggtggagtcagaacttttgctaaaagttaagaatgggctgggcgtgctggctcatgcctataatcgcagcactttgggaggccgaggtgggtggatcacctgaggtcaggaattctagaccagactgaccagtatggtgaaaccctgtctctcctaaaaatacaaaaattagccgagcgtggtggcgtgtgcttgtagtcccagcttcttgggaggctgagacaggagaattgtttgagcccaggaggcggaggctgcagtgaggtgagccaagatcgcgtcactgcatttcagcctggttgacagagcaagactccattgcaaaaaaaaaaaaaaagttaagaattgtttatagtcctacagataccttttttttttccattttctctgtgcaccgcaagttattgtaaaagcaaaaattcatattcttcactaattttatct

SEQ ID NO: 79341 - DNA, 1157 bp, Homo sapiens
gtaatcccagaactttgggaggctgaggcatgagcccaagagttcaagacccacctgtctctactgaaaaaaaaaaaaaaaaaattagccggctgtcttagcacgcacctgtagtcccacctactggggaggctcacaagggaggatcgcttgagtccaggagtttgaggctgcagtgagctgtcattgcgccactgctctctttcctgggtgaccctgtctttaagaaaataaaaaaaacaaaatgaataaactttttttatgaacaggtgtggcaaaacatgttggagatgccctcaaagaacatgcttccagatcatctcgaaagatttgcactatcggaatagctccatggggagtgattgaaaacagaaatgatcttgttgggagagatgtaagaattatttttaaaatttcttatgtttgaaattatatgtaaacaaaattatagtaagaatagtgccagtttaaaatatttatgattatattatacttttcaaattaagtttaaaaggtattttcctgaggtttacttctgaatttttggaaatgcataaatataaataattcataactataaataattaagttcataaatataaatgctgttacagtgttggcacattttgctttcagtcttttatgtgtaaaattatttcacattttccatataagctagtctttgtaattaaatttttaatgactacatgacatgagaattaattttattctcactaagactagggaataggagttaaatgctagtgttttgtttgaataggttaaagacatgtgaattggttatagatatttatcaacactgttaaaaagaattactggctgggcgcagtggctcacacctgtaatcccagcactttggaggctgaggcgggctgatcactggagatcaggagttcacgaccagcctggccaacatggtgaaaccccgtctctactaaaaatacaaaaattaactgggtgtagtggcctgtgcctcctagctacttgggaggctgaggcgggagaattgcttgaaactggaaggcagaggttgcagtgagctgaaattgagccactgcattccagcctaggtgacaaagcaaaactccatctcatacatacatacatacatacatacatacaattactgaattata

SEQ ID NO: 79342 - DNA, 1145 bp, Homo sapiens
aaaacgcaacactttagagcaggatttggcaaactatagcctgtgtgccaaatccagcccaaaccttgaataaagatttactggaacattcacttatttactgtattagtctgttttcatactgctataaagaactgcccgagacttggtaatttataaaggaaagaggtttaattgacccacagttcagcatgactagggagcctcaggaaatttataatcatggtggaaggtgaaggggaagcaaggcaccttcttacacaaagtggcaggaaggagaagtgccacgcgaagagggaagagccccttataaagccatcagatcttgggagaactcagtcactatcaccagaacagcattggggaaaccgcccccatgattcagttacttccacctggtctctcccgtaaaacctggggattatagggattacaattcaagatcagatttgagtggggatgcaaagcttaaccatatcagtttatatattgtctatggctatttttgtgctgtaacagcagaggtgaatagttgtgacagagatggtataccctataaagcttatactgtttagccttttagaaaaaggtttttgaccctactgtagagcaaagcattatttccatcactttccttctagtggtaaattgatacaagaatggcaatccattgcctcagcagcagtaagaagtagctttcaaaaattaatttgtaacatactactgtcttttattctatatcttccctatcacatatacaggttgaatataaagagggcagattactttcattgtctaaaataaaacatttaagtcagcttgcaaacatctaattcattatcagcaacttttttttttttttttttgagacagagtcttgctgtcacccaggctggagtgcagtggtgccatctcagctcactgcaacctccacctcccgggttcaagtgattctcatgtgtcagcctcccaagtagctgggattacaggtgcccgtcaccacacgtggctaagttttgtatttttactagagatggggtttcactatgttggtcaagctggtcttgaacttctgacctcaggtgatccgcccgcctaggcctcccaaagtactggggttacaggtgtgagccactgcacctggc

SEQ ID NO: 79343 - DNA, 1021 bp, Homo sapiens
actacaggtgtatgccaccacacttgcctaattttttaaaattttttgtcaagtcagggtcttgctgtgtttcttaggatggtcttgaacttttgacctcaaggtcctccagccatggcctcccacagtgttgggattacccgcgtgagccacagccggtgtaaatactatttctgttatatgcctatgccatgttttgtagatgcctcatgttaaatttagatgatgaattcatcttagactaattatactatttcagtgctatgatgaaggtattaatatatagatatcctaaaatcaaaaagcttatttttatacttatataaaatataaaaattttaaagcttatatttgtcggttcattcacttttaattccattttttcattaactctaattttttgaagggtgttttaatctcacctttttcttttaggtgtttttgtggtcgcttggtcaagcaacatgcttgttttactgcaagtcttgccatgaaatactcagatgtgaaattgggtgaccattttaatcaggcaatagaagaatggtctgtggaaaagcatacagaacagagcccaacggatgcttatggagtcataaattttcaagggggttctcattcctacagagctaaggtatgtcacatattggatttttcttcatttatgttgttatttaaataataaacatcacaatttgtgtagcaatattgacaaaaagttggtctcagtaatttatttgtatattttaaagtacaaaggtgcatacaaatatagaattgtatctttctggtggattgaacctttcatcattataaaatgtgttttgtttcttgtcatttttcttgacatggtttgctttttctgcaatcagtgtagttaagccatctttcttccttttcggttttaaccttttatgtttaagagatgtcttttaattgtttttaaaaatgttgtctgctgtgtatttaagtttaaatttaccattatgttattagttatctatttgtctcacttttttct

SEQ ID NO: 79344 - DNA, 1546 bp, Homo sapiens
tgctgacaatagtgaattttatgtttttggttactggcatttgttgtattccactagcgagttttagacttgctatagcatgcaattagattactttggatcagtttgatcctttcaggtcttgctcttaaactttgtcagggcatgggctgtctaggtctgatttttttgtttttttttgttttttttgagacccagtcttgctgtgttgcccatcctggagtgcagtggcacgatctcggctcaccacaacctctgcctcccaggttcaagcgattctcctgcctcagcctcctgagaagctgggactacaagcgtacgccaccatgcctagttaatttttatatttttaggagagacagagtttcaccatattggtcaggctggtctagagctcctgacctcaggtgatccatccaccttggcttcccaaggtgctgggattataggcatgagccaccgtgcctggtctgtctaggtctaatttagtccttctaatttaatgatactttttttgaggaccctgtcataagccttgtgtgttatgagatctctactctggctggtgggaacataaagtgttccctgccctttatgagcttcagaaattgtttcggctattgctgtccagtagcttttaactttgccttaagtagttattctttttttttttttttttttttttttttttgagacaaagtctcactctttcacccaggctggagtgcagtggcccaatctctgctcactgtggtctgcgcctcccaggttcaagtgattctcctgcctcagcctcctgagtagctgggattacaggcacgcgccaccatgcccagctaattttttgtatttttagtagagacggttcaccatgttggccaggatggtatcgaactcctgacctcaggtaatctgcccgtctcggcctcccaaagtgctgggattacaggtgtgagccactgtacctggccaagtagttattcttccacatgcttaaggagacccttctgcagatacttggaactttctcgttgtagctccctcctctttttgttttctacctcacaaactctagctgccttggcttcctcaaactctcatctgatttttaagattatatcaaatcaatgagactgcccagctccactaggttcctacttatggtgttatagtccagtatgtgcttctgggtagaaagccatctgtctttgtaccccagcctcagacaccattgatcacccttttgtcactatatagattagttcacggtttcttgaattttgtatacgtggaatcatacaaatatataatcattggtgtctaggttctttcactcagtatgatgattttgagatttatccattctgtagtattattagtggttcattcacttctctttattattggatagtattttttctttctttctttcttttttttttttttgagttggggtcttgcttgttctgtcgtccaggatggagcacagtggtgtgaccaaggctaactgcagccctgacgggctcaaccaagcctcccaccttag

SEQ ID NO: 79345 - DNA, 1035 bp, Homo sapiens
gactgtctgccaggcgcggtggctcacacctgtaatcctagcactttgggaggccgaggcaggtggatcacaaggtcaggagatcgagaccatcctggctaacacagtgaaatcccatctctagtaaaaatgcaaaaaaattagccgggcatggtggcaggagcctgtagtcccagctacttgggaggctgaggcaggagagtggtgtgaacccgggaggcggagcttgcagtgagctgagattgcgccattggactccagcctgggcaacagagcgagactctgtctcaaaaaaaaaaaaaaaaattgagactgtcagttaaaaaatagttatttgaattataaatcaaggtatacgtgaactataatatctactgaaaaattaaactaggtatataattttttttgttttgtattttatgtattttatatactttaaaatcagaaagtttttcacctgaaataatttatttacctttttgtgttcaatagatgccttccaggatgtcaaatttgtcagcaactcgtcaggtaagtttaacataactataccgcacaaatttcggaaaataaataaaactaatctattagaaatatgagttagaacacagtggcatgaaactcacatgctattatatttgatgggtactttacctagacttggaaggtgaagggtcagtcaaggctgtttgaaactcaggtgaagctacctaagaagagttgtaaagttgtgtctgttgagcagaagttgaaggacaggaattttaggcagcgagagcagtgtatgggaaggcctgatagtgaaagacatcatggttctgtcaggaaactgcagaatgtaagatggagatttgagagatttgggcctggaaaaatgagagtttcagttactctacaaggctttttgttgcacatgcttttgatttcatgttaaaaggatattgtacaggcaattaataacatgctatattagtattattattattttgagacggagtcttgctctgttacccaggctggagtgcagtggcacaa

SEQ ID NO: 79346 - DNA, 1032 bp, Homo sapiens
gtctcgaactcctgacctcaagtgatccacccaccttggccccccaaagtgctgggattacaagcgtgagccaccgcccggtcatgcattttattttgacaagtgcagagacacatactctggggcaatccttagtagattagaaaagtcattaaatagatttctggatgggtgtaactctttgttaaaagcagcaggaaaagactgggcatggtggctcttgcctgtaatcccagtgctttgggaggctgaggcgggaggattgcttgaagctaggagtttgagaccagcctggccaacgtagataaccccacctctactaaaaatataaaaatcagctggacgtgatggtgtgcgcctgtaatcccagctccttgtgagactggggcatgagaattggttgaatccaggagatggaggttgcagtgactccagattgcgccactgcaccccagcctgggtgacaaaacaagactctgtctcaaaaaaaaaaaaaaatatatatatatatatatatatatatattatatatatacacatatatataatatatatatatataaatgaaataaaacctgtagaaacctatcatgaatgtatcaacaaaagtatcaacaccctgctcactgatagataatgggttgatatggcttactcgcagtgtgaacgtccaagcgtccaagttttctgttttgttttttttggatagtgttttgctctgttgcccatgtcagagtgcagtgacatcatcatggcttactgtattcccaacctcctaggctcaagtgatcctgccacttcagcctcccaagtacctaaaatgacaggcccataccaccaacctggctaattaaaaaatttttttgactgggtgcggtggttaatgcctgtaatcccagcactttggaaggctgaggcgggtggatcaccaggtcaagagatcgagaccatcctggccaacatggtgaaaccccatctctactaaaaatacaaaaattagccgggcgtggtggcacgcacctgtagtcccag

SEQ ID NO: 79347 - DNA, 1030 bp, Homo sapiens
taaagtctgtgaaacactgtttacccctcttactatcatataaacatgtcaataacataacaccttaactatccagctgccagacttctggaaaccttaacctttggaaacaaagctccttgtggaaagtgagcaaaaagcttttgagctaagtcatcaataatatagcaaccctgagacagagttcactgattgaaaaatgtgtgcaaagtgaaatttaacaggcttagttttctgctttctgctggcagtttggtagtatgctggagataacaggaggaaagttacctgagaagcagactattactgttaggaggacactggagaaacataattagactagaaagatagggctatacattagcctttactatatgaaatgatagtcttcctagtctaatttatcatacccagtacccggaagatactctggactaagagaagtgtgtaataggctttaggcacatttttgcattagctaatgtgtcggcatttagctgtggccattgctctgaatgctttgtgtgtgtgtgtgtgtgtgtgtgtgtgtatttatttatttttgagacgaagtcttgctcggtcatccaggctgaagtgcagtggcgtgatcttggctcactgcaacctctgcctcccgggttcaagtgattctcctgcctcagcctcctgagtagctgggattacaggcatgtgctaccatgcccggctaatttttgtatttttggtagagacggagtttcaccatgttggtcaggctggtctcgaactcctgacctcgtgatctgcccgccttggcctcccaaagtgctgggattacaggcatgagccacctcgcccgacactttacatatattaatcccgcaggaaaattctgtgatgtcaatactgttttctccattatttatatataaagagcagagaatcaaaaatcacttgccaacggtcacaaggctaataagtggtagagtaggtgttgacctgccaaactacagaaacttggagaaggcttttgatattcagggacatg

SEQ ID NO: 79348 - DNA, 1023 bp, Homo sapiens
taaaaatgttcattgggagaaaaattatttttaaaactaaatttttatagtagtcctccattactggcaattaaggagcaacccacaaaatgtcattatgtggttctttgattaggcataaaaagtattgcaaacagcttttctattcctttggaatatgaatctttttaatgtctaaagttaacctgcaacattttctagtaggacaagtcaatgtaaattaggtaatttttgcctgttttataccttctgttgcattttgttcaaatgaaaacattttttaaaacatgattgaatttttacttctcagataattggtttgagtgtggaatttcttttttaacactttgatatgtaagttagtgtaaattaatacttttataacactactaggctttatatttttatggaatgttttaaaatttgaaatttttgaagtgttaatttagcagtactttatcattatgtgccaatactgacaagaaaaacaattttttatgtatttaatatactatggtattcaataaattctattttaaaataaaatttgaatttgttttattttgaatgaggaaactaattgaaaatgaactaacagtgtgctagatagatcatgttcatataacacaaaaatggtaataattgcttaagaaattatgtagctatttaggttttacaaattatccttaaaacctagattctggccgggcacggtggctcacacctgtaatcccaacactttgggaggccgaggtgggcggatcacgaggtcaagagatggagaccatcctggccaacatggtgaaaccccgtctctactaaaaatacaaaaattagctggacgtggtggcatgcgcctgtagtcctggctactcaggaggctgaggcaggagaatcacttgagctgaggcaggagaatcacttgagcccgggaggtggaggttgcagtgaccgagatcgtgtcactgcacttcagcctggcgacagagcaagactctgtctcaaaaaaaaaaaaaaaaatag

SEQ ID NO: 79349 - DNA, 1965 bp, Homo sapiens
tgtcccagagtcagcaggtattctcacagtgactcatgaggccatttttagttttcccatttgtatgattggacactgcctggaatagtgtcctggaataagtgtcaggaatatcttccttttgttctggagttctcactgccatgaagggcagtattcatattgggaaatggagataacggaagatccagagaacacaaattggctttgagtcatgtgattaggcttcctgagaggttcagtgtcaccctgactatctccttagaagtgtggatgttgaaccagaacagtgctccagaaggagtgctcagtttcatagagcaatctgtgttttttagaaaaagaatccttttgctaatgtagtgaatattgggggcaagttgaaattttgcatttcctaacgtcttttatttatgcctagatgatggaccatttggattgtgcaacaaatgaagaaaaccctgtgatatctggtgaacagattgtccagcaataatattatgtggaactgctataatgtgtcattgattttctacaaatagacttcgactttttaaattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacatatggtctgtgtagtttccgagatgtactatatacagtatatttttctaaaaaaaaatgccttgacccacccctatacttttttttaacgaaatctgtttctttcagctctgatggtagatacaagtagttactatttctgaatgggttttactgtaaagaattatgcaaattggccaggcgcggtggctcacgcctgtaatcccaacactttgggaggccaaggcgggcggatcacgaggtcaggagatcgagaccatcctggctaacacggtgaaacccctctctactaaaaataccaaaaattagctgggcgtggtggagggtgcctgtagtcccagctactgggaaggctgagacaggagaatggcgtgaacccgggaagtggagcttgcagtgagccaagatcacgccactgcactccagcctgggcgacagagtgagactccatcccaaaaaaaaagatttatgcaaattatatctgctctgtagaaataactgtttaacaccatgcaagaaggcggttcaacggtgaaaatttggaccttatatcactgcagaggttagaaatacataattttggaaatataagtgcatatttttgtagtatttttttaaacccaatcctttcataaacttgagaactgaaattacttcagactgcacgtgtattatattaagaacatttttccagatatagagaaacataatatatagaactagtcactaaaaggagacagacactgaaatctagttttcattggtttgacagccttttttttttaaatgtagcttaaatttcagtactaacattcagtttcactttggtatttctgatctttgcaatttggttctgttaatgttaaggtttgattttttaaaaaaattatttttcttaagaaattatgtattaatacatatggctcatcgttgaatacagcattcctaacattatcccacattcccccactcccacccgttatctttttttcttcctgatgcccaccccttttcccataggtaatgattcttaatcttggtggaggatgtacaaagtgcggttcagagaaaagaattggcaacaacagcaagagacttggtgttagtctcagtttaattacaatacaaggaagagttgagtaatttgccgcatctcaagaccttgtatctcagttttctttttttttttttttttttttttgagacggagtctcgctctgtcgcccaggctggagtgcagtggcgggatctcggctcact

SEQ ID NO: 79350 - DNA, 1023 bp, Homo sapiens
catcttatgtttcatgtagtgaactgcttaatgttatctgtcttgatttggcttttgtttttttccccttagaattgctacaaactagtgaccttaaatctaggggatatctttggcaattagaagacctcaaaatggttttgggtcttgaaatggcttgtagagtatcagcaggttttttatttttttattttttttatttttttgagacagggtctctctctctattgcccaggctgaagtgcagtggcgcgatcttgggtcagcaaagcctctgcctctcaggttcaagcaattctcccacctcagtctcccgagtaggtttgggattacaggcgcaccaccacgcttggctaatttttgtatttttagtagagacagggtttcaccatgttggccaggctggtcccgaactcctgacctcgtgatccacctgcatcggcctcccaaagtgctgagattacaggcgtgagccaccgcgcccggcccaggttttgattttgtaagctgtctccattagttgagacagttgtcagccaaaagccttagctcacgttgtattctttctgcctggcaagtcaagagaccctgtttcaagatgattccaccctcttgttcttcttccaaaaaacactaaagccttcagaaccacttttcaaaaataggaacatttatcttgctgatctttccttcttctaattcttgatgaaggaaaggaaaaaagtgcatcgcaatactgaaatttaatcactagtctaaaagtctttaacagtcttcacaaaggcattaaatacttttttctatttttagtaattgtatttgagttgctgaaacactgaaagcatttaaacagtttcttcatccttcatttccaaatataagacaattttttatgagaatataggcagagctgaagtgaccatttgagaaaagtttaactggtaatttctttttttttttttggtcggagtctcgctctgtcacccaggctggagcgcagtagcacgatctcggctcactgca

SEQ ID NO: 79351 - DNA, 1033 bp, Homo sapiens
accgaggctggagtgcagtggcacgatctcagctcactgcaacctctgcctcctgggttcaagtgattctcctgcctcagcctcctgagtagctgggtttataggcacgtgccaccatgcccggctaatttttgtagtcttagtagagacggggtttcaccatgttggccaggctggtctcgaactcttgacctcgtgatccgccccgcctcagtctcccaaagtgctgggattacaggcgtgagccaccaggcccaacccagcacatttctttggttcggtgattttttttaaaaaaataagataaagaagataagggttttaatatgtagaataaaactatacatagtattaaccataagatatctttttaaaagtaatatttaaatgtatattcatatatttatttgcacttgaaaaacaatttaatgccttcatttacatttaggaagattgacctttaattttgtttctttctttgacagtcatgtgtgatacttctaggccttctcctcctctatgatgtattttttgttttcataacaccattcatcacaaaggtatgaccatatttttgaaatgggtgaagaaacatgctaaaaaatgatcatcttaaatctgctcctagattattaattttgcagatgtttaccactgagtgaattctaattctcttaaaagaactgtcattgaaattggccttttaactttcaagcttttaatccattttgttagattttaaaatgtctcttgactgatataaatatgagaatatctgtacttttcttccctttttaaagtattttttcttatgagctaaatgtttactgtaggcaatatagacaataaaaaaaataaaatatcatttctgaagccctagtttgagactaagaaagagcagcacgctggaaatcggaaggcctagaatgtagctctgtaaccttgcaaccataggcaagttacttagccctttctgcttgcatttactaacgcgttgaatgagggagtactgctagctattcatcttccacct

SEQ ID NO: 79352 - DNA, 1023 bp, Homo sapiens
agctatttggatctgtgttaacactggtattttgttaacagctgttttctagagcgagacgtgttaatgcacttatgtctgatatatgttcttctgaggtagccttttcaactttttcttagtgtaataatattcattattctactaggacagtaaaattaccaaatatagagtatatgaggggttttgttgttatgcttgctgtttaataattgaatagtcagaaatcagccaggcatggtggtgtgcatgcctttagtcccagctacttgggaagctgagacatgaaaatcacttgaacccaggaggtgaaggttgcagttagccgagatcatgccactgcactccagcctgggtgacagagtgagaatctgtcttaaaaaaaaaaaaggaatagtcaaatcatagcaattaaatgatattacctcagtgatctatgtcttttgaaaggcttcatctaaacattgataaagcaatagagtaatattttttgattttaggtgggcttggattttacaggatatcttggggattgctttctgtctgaatttaattaaaacactgaagttgcccaacttcaaggtaatgtatacaatactactttgctagttaaaataaatttttaaaagacaactttattaaggcataatttacctacaattaaatgcgccaatttttggcgtactgtttatgaaaattttatgaatgtgtaactttataaccactatcccagtgaagttgtagaacatttctcatctcttccaaaagctctaccatggcctttgcaatcagtccttaacccccaggcccagacaaccactgatttgctagctaaactattgtttttttttctttcttttatttgtataaatttaaggggttcaagtgtagttttattacatggatatgttgggtagtgatgaggcttatagtataaccatcactcgactaatgtgttttgtccccattaagtaatttctcatccctcaccccttctaactcttccaccatgccgagtatccc

SEQ ID NO: 79353 - DNA, 1005 bp, Homo sapiens
ttataatttgaaacaatacaaaagtaggagtattatttgaaacctatatagtccaatatacattggacctacaggtgtttaaatttaaatttaagtaaaattaaataaaattaaaaattgagtttttcattcttattagccacatttcaagtgctcaatagccacatatgactagtagctactatattggacagcacagatatagtacattattcatcatcacagaaaattatattggactgataaacattttattacgtctcatttgttttacttaaaatcaagactttcaaaattgatatttcagtcacttcttatgactgtggttaatatttgctacttcttatatcaagtgaacattgtacttcatctgcagtgttaactattttaatctgttttttaggattgcatgtcgtggcaaaaacatggaagtgagacttatttttctctctggactgtgcatagcagtagctgttgtttgggctgtgtttcgaaatgaagacaggtatgaatactcaatgtatttgcttttagattaaggatgaattgtttcctatcttgccctgatacttattatgattattatggaatttttttgcttctatgccagaacaccagtcttgtaatgaactacttcttaaataagcagatcttatgttaatgcatttgaactcatatagagaaggaaatatgaattatgattttaacacatacactgaaatagactttaaaaatatacttaatttcacgcctgtaatcccagcactttgggaggccgaggcaggcggatcacctgaggtcgggagtttgagaccagcctgaccaacatggagaaaccccgtctctactaaaaatacaaaaaattagccaggcgtggtagtgcatgcctgtaatcccagctactcgggaggctgaggcaggagaatcgcttgaacccgggaggcggaggttgcagtgagcggaggttgcagtgagccaagatcgcgccattgcactccagcctgg

SEQ ID NO: 79354 - DNA, 1040 bp, Homo sapiens
cctgacctcatgatccgcccgcctcagcctcccaaagtgctgggattacaggcatgagccatcatgctcggccaacgtcatctctttcaacaattttgcctgcagaaaaaaatgtttcaaaagttagtggttgaaaacagatcatctctggagagtagcatttaagaggtttttactttctagattaaatatttctttgtagggtacagtttttaaaaagtacattacttgctataacaagatagcttagaaaaataataaaataaaaatattttaataaataaaaatacattgttttcttcagaaacagatttaaattggtgttagagataaattttttaaataactgtacttggctaagatttgctaaagttcctgtgtgtttgtacagggaaaacttgaaagcagtgacaactgaagatagagaaatgaggaaaaagaaggaagaatatttaacttttagtcctcttacagttgtaatatttgtggtcatctgctgtgttatgatggtcttactttatttcttctacaaatggttgggtaagaagtcatattttatgtttgctactgttaacatacattcttttcactgactattactagatttatcttttcctttaagccattctacctggaaaacgtatgtgaataatttggttaatattaatttttttttaattatcagagtgttaggtctctgttactctgagataaaaatattcagattaaaaatacaatatgtgccaggagcagtgactcacacctgtaatcccagcactttgggaggccaaagtggacagatcacctgaggttgggagtttgagaccagcctgaccaacatggagaaactccatctatactgaaaatacagaaattagctgggtgtggtggcacgtgcctgtaatcccaactacttgagaggctgagtcaggagaatcgctcgaacctgggaggtggagtttgcagtgagccgacattgcgccattgcactccagcctgggcaacaagagcgaaactccgtcttaaaaaaaaaaaaaaaa

SEQ ID NO: 79355 - DNA, 1006 bp, Homo sapiens
gggtgagacttcgtctctgaaaaaaaaaaatagtgaagaaggctgtgtacaatggctgatacctgtaaccctagcactttgggatgtcaagatgggaggatcatttgagaccaagtggtcaagaccaatctggtcagcatagtgacaccctgtctctatttaaaaagaaaaaagaaaaaatattgaagaagtgagaatgactgataattatgttttattgtgtgaaccattgtcatgtacggttgttaataaataattattgatttttctcaagtatttttctctctgggaaaatagggaattttaaaatacttaattctaagcctaaatatttctaattcaaaagatattgtcttaaaccaatattgataaccaaaggcagtatttataactgaatgcatttaggatgaaatagatttttaacatgttaaaaagacatttcttattttcagacttccattagtttgatgaatctgacttccacaccactatgcaacctttctgatattcctcctgttggcataaagagcaaagcagttgtggttccatggggaagctgccattttcttgaaaaagccagaattgcacagaaaggaggtgctgaagcaatgttagttgtcaataacagtgtcctagtaagttataaaaacaatcatatcttattttgagttcatgatgtgaaatttcacaaaaatggaattaacgtctttgtgtgtggtttagaggctgagttttgaatgatctgatggcaagattctttgtaaataaataatcaagatctaataggcatttacttggaaagtttttcagtttttctattcctagagcagacaagactttgttaggaacaaatatatatatatgcatatatatagagatatatatgtattacacatatgtaatatgaatatatcataaatgctatatatattatagcatttatcagtttaagttcatgttaaaaggattcaattttgagaacttagagtgttaagaaagaatacct

SEQ ID NO: 79356 - DNA, 1048 bp, Homo sapiens
agcagcggcggtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctggtaagggggcgggaaggcgcgcaggcctcccaggggctgggcggggccggggccaaggccggggctcccttcccctactcctcgcccggcctcccctctgcccgcacctccgcggcctgctctcgcactcctctttcctcccctcctctttccattactcatctctttccttccaccctcctcttttccaccctctttcccccaactttcccgccccccactcggttcccgcccattgaagtctggcgaaatacctaccgcaaaaagatcagaggagccccttaggttgcgttgaccttgatgcttctcgatagttgctcactgtcccagcatatttaaaattgacctctgggttttattgtctaagcctttcttaccgctttttacccttgggaagaaaaaaaaattatacaaggcgccagtatgtttagcggttcgaggactgcactttaattgcactaacacggatgtctttttaaaattcccttcccccactgtagctcctgcttcgccttagggctcatttgattctgttatgagggttttttttttttggagggggggttttaatagcagtaatttaaaataacttttaaaagaagacaccaaaatgtaatgcttttagtggttttcagttttctgcctaatttaaagggatgggtggggagcgtcggttaaatgtaagtaagaaatatgtgttcatagatttgttttcatagtcacagagaagtaatagtgttttaaaattcagcctcaagtaattcgagcttcagtgtgggagtggggtgtcaggaacccggtgtttcagtttttgtttctagtgacttttacttag

SEQ ID NO: 79357 - DNA, 1047 bp, Homo sapiens
cctactgtaaatcaaggagcatcatctgtatgtaacaccttgctcttagcagtatagaaggactactgatgcaattaattctgtcatatgatctacgtagtttttgaagttttgattctcgttagtatattagtacagggctgggcgcggtggagtatagcctcaggcttcaacagtactatcacttctttggaatgttatttagtttctttttaacttgattcatttttgatcccttggtcagttcccataatgctctggatcagggcctgcttgaatattaaattcccattgtttccttctgggaaggtctctgcttatccaatctggagcctatctttcttccttgtcctggatctggtagactattgagaaaagtccttacaaagatttcctgggaactggatttttaaaatgagtgcatgtgggaaaatactctccaagtgcaaaggggactctgtttttacctctacttatatttccagctcctcggggaaaataaaagtattacaggtcaaatctctttacaagtagctcaacttgactgtctaaatatgtggtatggagtagagttttatttcatggattactgcttgcactaggttagacataaactgggctgtggagaacttttggttaaatagagattttcattgcaaaggtatttgttgtagaggaatttacccagtaaacagatatcttccagctaatgtttttaccaggctgattcagaccgggtagcaggagcgggaaaacactgtggacacagtctgctggctagcggtcaaggcagaggcaagtctggcacaggcaaaagtctgtgtgaaatgtggacctgagtcatgaaaggaggggaagaaactagtatgtgtcattctgaaaaagctcttcttagggctctttgggctgtaaccactgcctctctccatagagagtcacagggcctcacttggctcttcctgctgcattttcagacttaaaaggaagccaccggccgggcgtggtggctcatgcctgtaatcccagcactttgggaggccgaagcgg

SEQ ID NO: 79358 - DNA, 1113 bp, Homo sapiens
ccacccccgcggtctcttgcgccctctggtggcctctcgcgagaacgacgctgaacttgttcaggtgggacgccaataaagatttcttattcaaaaaacaggaagtgcctacggaggccgggccggcagcggcggccgggcatgaagccgggcggctacgggatcgcgggcggcggcggcatcgcgggcggcggcggcgatgagcgacatagtggagaagacgctgacggcgctgccgggactctttctgcagaaccagcccggtggtgggcccgcggccgccaaggcgtccttctcctcgaggctgggcagccttgtccgcggcatcacagccctcacctccaagcacgtaggtgcccgccggcccgggagctcagggacatcggagtgaggcccccgcgccaggaggccctggccgggcggcgagacttcagggcctctggggttagccctccggcggggctcaggggctgctgtgtcggttcgtcctttcgtctgcctggaagcttcactttcctgctgggactgacagcagggaagccgagtttccacagttagttctgacactgactctttgatcgggggcacatctctgtaacctctgagcctccgtgtgttttctcaacgttgtggtggaaaagtactgatacataattcataggttttttgtttgttttgaggattgggtgagatgtcaagcgtgtgaaaatacctagtgcgatggaagtgtcagacattatttaccttccacaaagttttttttccctactcagtttccttctctcccccggtgccttcaactgaacaacagttcagatgtcgcatacctgaagagatcctgtgagcctcttgttgaatatctttggggagcttgaggttcttgggttacaacaacgtgttgggcaaagaaaaagcacagttctctcaaaatgtaaaatttgctaagtctctgcctcaagtgggctttgaaaatgagcagttataaaaattcttaaacttttaaaatttttaaatttttattgacggagtctctctctgtcgcccaggctggagtgcaatggtgcgatctcgatctcggctcgctggagccttaaggttttaaaaattttaatt

SEQ ID NO: 79359 - DNA, 1057 bp, Homo sapiens
gaaccactgcgcctggtcaatagagctgatattaagaagtctgtttaaccttattagtttaatggtcagaaatgcttctttatagaataaaactgaaatttattaaagtaattttaaatatcttgttcttagcttctcaaatgttagctatgaggattagcagtgtcttaaaaaaattttctctctatagtcaacctttagggctgttaggaaaaattcttttaagcaattaaatattctattcataaatgttcaactttatatcagaatctcaagaaggaagtattttagaatagtaaaggttagaacacgttctttattcagagaagttgataatgtcatgtcgttaaggactagcattattcataagttatattgctctgtgctatcagatgacggggtgaaggtgacagatgtcttggtaaacattctgagactgagtgcacacaatattccacttgtggaaccctactccgcccaaaacacacttagatcttttaaacttgttatattctttcctccaagtagaatgtcctttaacattctctttctctctttccatattccaaatcaaattttatttctcctgtgatcactcaggtggctcctaccatctgttaccttttgttatcttttcatatattaatgtcttagctcctgaactaattttaagatccctaaaggcaggaatttttttttcgaggcttcaaattagtttttattagtaatttgcttttcttaaaactttgatttttcttaaatattatacaaatatggaatgtaagctcttccagtcatattcacgattttcagttgtcatcccaaaccttgaaaattcacctgtcagaattttcatatgttaaagtctttctaatggtgttgctctttttagcttctgaaagactgtatttgtagtttttttctcttctttggtttggttttgatcaaagaaggaaaacatcaaaaaggaaatttcaaccattgttgagcattttgagaaaagtgaaaaccaacttcatccttttcgtttctaaggaaaaatgtgttagatgtgaat

SEQ ID NO: 79360 - DNA, 1163 bp, Homo sapiens
gtgggagggatcgcttgagtctgggcgtttgagaccagcctgggtaacatagtgagaccctatctctacaaaaaaaaaaaaaaaaaaaaattagctcggtgtgatggtgcatgccttggtcccagctacttgggaggctgaggtgaaggattgcttgagcttggaaggtagaggctgcagtgagttttgatcgtgccactgccttccaacctgagtgatggagtgagactctgtctcaggaaacgaaacaaaacaaatgctttctgggattttcctcatctctttcttggcccgggtcagatttgtttcaactcttaagattgtgagagtaatagctctgctcctccgacctctagtgaaggtgttggaattggtcatgctactacctcttgattgtaagaattggaagtttccgttttctcctgttccatggtagacacagacagcatggatgctgggtaatgatggttatagttaacattagaatccctgatgaaaaggctgaaagaattgagaagaacgaaaaacaatgagcatggagtcagggaatcaggtcaagatagactatgtggagaggcagtaaaatatgggggtttaaaatatggactgacttcaactgtctgggtttgagtcctggctccaccatgtgatagattggaccttgagaaattgcctttttttgggtctctttttttttttttgagaccgagtcttgctctgtcgtctggtctggagtgcagtggcgtgatcttggctcactgcaagctctgcctcctgggttcatgccattctcctgcctcagcctcccgagtagctgggactacaggtgcccgccaccacgcctggctaattttttgtatttttagtagagacggggtttcaccgtgttagccaggatggtctcgatctcctaacctcgtgattcacccacctcggcctcccaaagtgctgggataacaggcgtgagccaccacgcccagtcttgggtctcattatatagggataaaaaggcctatctcattgtgtggttatgaggattaaatgaagtaatgcttataaagtacttgacccatagtgactgtctaattaaagtgttagttattatcaatgtgaagcctgactgagaaaattccttggagtatctagattatatgtacatggca

SEQ ID NO: 79361 - DNA, 1110 bp, Homo sapiens
gtgtgtatgcatttgcatgtgcacctacatattatttttattttaaaaactatttccgagttgcttgagagcaagccccttgagattttagttcccttgagagcaaggaccttggctagagttcctgatatgtttctgtcttaagaaaatgtttgctaatcagtgttctgattttatgaatattgttcccttttatatagtagggtacctttgtattctaatgttttagcctagctttacaaagggaccattctccaggcttttgcttctagaaatcaacttaaggtcagaatccatttgcctgtgagctcctgactagcactaattgggctacatcactgttggtattatagtgttacttttttctgtgtttatgaatctcaactactgattgaaacctgcagtgaaaacgtaaggtgatggagcatgtacacacattagaaatgattgtcttaattatattttattttatatcatgccagcctatcctaacgtggagctctagttggagttactggaatttatgttttaaaatcatgaattttatattaatgcatcagatcttattggtctaaaaaagacttactgccatccattgttatcaggaagtaacttgggaggcatttagtgaatttattaaattcattaactcactatcttcctttttcttgccttcatggataaatttggataatacatatatacaaagatgagtaagctagtccttaccttcacagcactcaggtgaccagtaattaggctcagttattaatagagtggaactttcttataatgttatggaacattagaatgttttctccttttttgtctcaactctaatgagattttattttaacataaatcttacattttgttggacattattgctcaatgtagcaaagtaaaaagttataaccggattctaaagtatttaattgaaaaaaccaatttactggaaaagtctgttgtatttatggtcttttatatctatttgaatattttcttgtgttttgtagttttgtgcttcttagatttattaagatttatcttgatcttgttcacaaatgtttcttcatttcatgtggttaagactcatgccagacactggct

SEQ ID NO: 79362 - DNA, 1052 bp, Homo sapiens
tggaagtagggagtaaagaggtaattttcccctctttgtggccagggttcggaggcgtgggtgttagagaaagcctggtggacagtcagaacttccactcctgatcagcgataatgaggccactccctcatagtgtcactggaggccacaaaggaagcagtaatgaggtacccctctctctcccaggcagggtagaatcagttgatactccctccaacaataaccaggagcctctccatccccaggtatcaaaggagacagagtagagagcctggattccattcccattgggtgatacctcctctctcctgccagaataatgtcagtagatacttatttaacttaattaaagtgagagtaaactctattctgagggataaggtgtcagaagaacttcacattttgtttgagcatacataatccaacccaaaatatctatgatgaaactgcagtgtcataaatggtggaacattattaatttttaatttagtaatttatgctttatagcattttaattagtaccaagagagtaaccaagagtactgaagagtaaccaagttccatgttgtatttttaagtttagaaaccctcagttgtggccgggcaaggtggctcatgcctgtaatcccagcactttgggaggctgagttgggcagatcacttgaggttaggagttcaaaaccagcctggccaacatggtgaaaccctgtctctactaaaaatacaaaaattagctggccatgatggtgcacgcttgtactgccagctacttgggaggccaaggcaggagaatcacttgaacctggggggtggaggttgcagactgcatctcaaaaaaaaaaaaagaaattctcagttgtattttacttcaccaccacagagaggagacagcagagtggctgctctttcaattatgaacttatacttagatatttgtagagttggagaataaaatgacttagctctgggtgagaaaataatttaaaaatcaatttaattcattttcagctcaattatgcctaaggaaactaaaaataagtgctgtttttgaa

SEQ ID NO: 79363 - DNA, 1017 bp, Homo sapiens
ggttcaagtgattctcgtgcctcagcctcctgagtagctgggattataggtgtgtgccaccacgcgtggctaatttttgtgtttttagtagaaacggggtttcaccatattggccaggccgatcctgaaatcctgacctcaagtgatctgcctgccttggcctcccaaagtgctgggattacaggtgtgagccactgtgcctggcttatttatttttactaaagtttaagtaacttttctaaaaagtactatgtcagtgtccacaggaatgtctttaaattatgagttgaaggaattaggtccagtcatctgtgtgggttcattaatataatttcgatctgagcatcataccaataggagtcctgaattctggtcccaggtcttcctattagtacaatttcctgttattgtacaatttaagatgcagttgatgttaattaatgatttctcattgttctcttttatatctataaaattaattaatttcctaccaaatagatagaaatattgaaagaattaatgaagatattcataaattgatttgaacttcttggaaggaaaggcttaataatatcatcatcatatatgtctgtatattatatataacatagcatatactatatgttacttatatataatattacttttgtatattacattttaatatatataattatatatattacttataataataatatacttctttccaactttttctttttgtaaatttgcttcaatgtctacttgggtgtctatataaatattccttttaattcttatggaagaaatcattcaatatctttatttcaaatggtatatgggacctagttaagagtaaaaaattctgtttataaaaatagcaaagatttaaaaagaattttttaaataattttagattcaggggatacatgtgtgggtttattacatggacattttatgtaatgctgagatttgggcgtctattgaacccatcacccaaatagtaaacatagtactgggtaggtagtttttcaa

SEQ ID NO: 79364 - DNA, 1035 bp, Homo sapiens
tctttcctaattgagtttttttttagcttccaagggaggtaaaaaggtaaaaataaaggatagttggtctttaatcacctagtaatatgaagacttacagtagacatttaccaaatggtagttgatttattactgtaagtatttgattagatcatcctcaaagtcctttagagtttaaaaatggctattagttccaggcttgaattattgtggtagtgaatggtaactttgacagttttttgctttgttttaaatatgaacctctgttattattttaaaattctagttctcaattttgaaccatatggactctccttttcttcatctggcttcactggacgacagtctcctgctggcatttctcttggttcagatgtatctgggaatagtgctgagacaggactgaaagagtaagttcatttcttattaaaattgaggttatgggagtgcttaaatgtcttttagcgttccatttgccttctgctcctgcctcatatcatcatggtcattatttgcttattttaggataactttcaagaggtctattgtttcagtggttttcacataattttctttttttttaattatactttaagttctagggtacaggttcacaacgtgcaggtttgttacatatgtatacatgtgtgccatgttggtgtgctgcacccattaactcgtcatttacattaggtatatctcctaatactatcccttccccctccccccaccccacaacaggccctggtgtgtgatgttccccttcctgtgtccaagtgttctcaatgttcaattcccacctatgagtgagaacatgcagtgtttggttttttgtccttgcgatagtttgctgagaatgatggtttccagcttcatccgtgtccctacaaaggacatgaactcatccttttttatggctgcatagtattccatggtgtatatgtgccacattttcttaatccagtctatcattgatggacatttgggttggttccaagtctttgctattgtgaatagtgccgcagtaaacatacg

SEQ ID NO: 79365 - DNA, 1032 bp, Homo sapiens
atttacagtagttctatttttgtataacttaagcagttaagtgaaaattaaatgctctgaaatttttaactaagtctggagttctgcagccttaaatcaaatcctttgactggagggtagagggatgttggctataactaaaataaaatctagagatcaaggttttacttctggtatatagaatataatgtgacagttgtttttaaaaggccatgggcattgatatgttttgaaagaatgcctcaagaaagtaactattagcagttatttaagttgacttgattttattatcaacctccttaggacaaatagcttgaagctggaaggtataaagaaattgtgggggaaagaaggctatcttcccaagaaggaaagcaaaactggtgatgaaagtggagctctgcctgttcctcaagagagtataatggagaatgtagatcaagctataactaaaaaggatcaatctcaagttcttacccaatctaaagaggagaaagaaaagcagctgctggcatcatcattatttgttggtctaggatcagaaagtacaatcaacctggtaagtaatcggttctattcctgtaagaatctttgtcatctgtctgtacaaaaaaaactggctctataaaagctcctggctgtcgtctatatgtatagtgaaaagtggcttccccagttcttactcaccatcatttcccagctccagaaccactaatgacacagctttttatattcctgaaagagaaaatgcagttggctcaacttgagtcaggtgttctctgtagcccagtcagtggacaagggtcaggctccaaataaggttacaggtatgaccacagccactctcacccctgtgggtggacggggcagttctcaaagggaagggggatgaataataatcgttcaacagtattgatatatctttgtaaaaagtactcctcaaaattgtattacataaattctattctcccagaacattattcagctctaagaatgatcaataatattgctttgtaaaatgaaaaaatactt

SEQ ID NO: 79366 - DNA, 1048 bp, Homo sapiens
cccgagtagctaggattacaggtgtgtggcaccatgctcagctaattttttgtattttttagtagagatggggtttcaccatattgcctaggcaggtctagaactcctgagcttaagtgatctgcccgcctcagcctcccaaagtgctgggattacaggtgtgaactactgcacctggcctagatttaattctttgagaaaccaccatatcattttcacagcaactgcaccattttatattcccaccagcaatgtaccagggttccagtttctccacgtcttcatcatcatttgttattatctgtttttttctttaatattagccatcctaatgtgtatgaagtatagtatctcactgtggtttcaatttgcagtctccttagtggttagtgatattgagtatcttttcatgtgcttattagccatttgtgtatcttcttggagaaatgtctgtttaactccttttgcattaaatcatttttcacttttgttttgttttaggcaatgaagggctattggcctgtcagctgctcccatccatcccctgcttactgcattgccgagttcatgcagatgtattagccctgtggttcagatcctcctgttctactcttcctgactatttactgtatcagtgtcaaaaggtgatggagggatcctagcagaagccctgctaaattttactccatcaagatcaatggtttacatagataaacttatttaccaaagtaaaaagaactcatggtacttctaatgaaaatggggattattacaagtgtggtttatatgttttctttgtgattcctggtcaagaaagatccccaaaactgtatccctaacctttaactcaggattgtacagtatgtttaggtccctcaaaaagtgacctaagctaatgttataaactgctaatgatttatatatcacttagtgtgtagagggactgaaaatatttattttgttataaataattttatagcacgtttactctagtgctagctaatttgtaataaagccaagtctcagttttctgcattaaatggaaggg

SEQ ID NO: 79367 - DNA, 2191 bp, Homo sapiens
atttcttgcataataggttcctccttttgaatagatcagattcatccccaggctctcagcagtgtcatgatgaaatgagtgtgctgacttcaggggtgtggtggacactggtagctagccttatcagctccctccttattcctacctctgtcagcagcatgcctcgccccttacctaattctgctgtgactctgacagagaggaagtgccttctcactttgcaaaggaatgcagcatgtcacaaaggaggtgctccaattttttgtgtccttacttccctatgtttgcctagttactgaggctaggtcgagtgtgaagcaataggtgtaagatgctgagagcacatggacagctaccagggagatctgttgcttggttacagggtgtattcatgagtggtagctgcagttgtcgtgagagacatgcttggcatacagagctgtctaatgggtgggagacatgtaatggtagatttagggctgggagcatgattttgggtctgcccaaaggaacatggtgtcacttttgttctttctgacccactaaataaaaagtagtgtaacagggtttcactggaatgtttattagaaagtttacactttttatatttttatgattttaaaaacaaacaataatagaaaaacagattttaaggaacttcagagcagtatatattctgtctaaactcactgaatattttaagttgtaaatcaggtgtccaccaacctttatttttgcattgcaggagatgtgactgtaaagtagggagtttttttttttgagacagagtttcacccttgttgcccaggctagagtgtaatggtgcaatctccgctcactgcaacctctgcctcccaggttcaagcgattctcctgcctcagcctccctagtagctgggattacaggcatgcaccaccacacccggctaatttttttatatttttagtagagacaaggtttctccatgttggtcaggctggtctcgaactcccgacctcaggtgatctgcccgcctcagcctcccaaagtgctgggattacaggcgtgagccactgcgcccggccaaattatttttgtgggtagattcattctctttacctaatagtcataatttagtcagtgaagggacaacatctggggtaagagctatggaggaggtgctcagctttgtgagttttgtgccaggcatctttgctgaaaatggagatggcagcaagtgtgaatctgggggaatataagggaagacagaaaagccttaagagtagacggaggaagaagggtaccagaatagtccctgtggaggcaggcagatcagagctcagggtttgaaagtgggcctgagtaagggtcctgctagagaaactgcagatggaagctgagcagttaccaactgctaatgtgccaagtataccaagcacagcatgtgtcctgtagaggagcattattttaaacaatgttctactatcatctaccaaaataattgtggtaaaagtgtagtattttattttttccttttatgtcagcaatattttaaaatattgatctgtttatcttatatttttatggataaatgtagtatttgcctcatgattgtgagccactgagagtgcactgaacctattcacatgtctttaagatgttttgctgtgttaaaattttaggagagaaaaatacaagtgaataattatttaataggcatttattactttattttggagttgaattctgtcatttgaaaaagttcagtaatgtaataaatacaaagtgatctgcactgttttttggtctatgttctttattaactaagtagctgaataataagtaatattatttaaacaataatttggtagacatcagctaaaaagagcaggagcaattagaatgggatgaaaagaatgattttttcattacagcccccaaagaatcttgtctcgttggctaaaagtaaagatattgctatttctctttctgtatgatggtcagagagaactttgtgggcttcagacaagttatagcatggattgtttctcaggatgcctgtccatatctcctgctttcaccttaggctgaccagagcatttaaagcagaacattgtttccatcatgccttcctttgtagatgtctgaagatgccagaaacacagtaaatcaattagaaacttagtgaccaaagaatctgagtgtgctggc

SEQ ID NO: 79368 - DNA, 1197 bp, Homo sapiens
ccaaatctctgtgtatctaaagcccatatacctttgcatcccctgcagcatcttgcacaggggcttgcataaagcagatcattgttttctcagttaggattaggtttggggcaggaaaacaaaaataatatttatttagcaagttagaagtgatttttctcttgccgggcgcagtggctcacgcctgtaatcccagcactttgggaggccaaggcaggccgatcacgaggtcaggagatcaagaccatcctggctaacatggtgaaaccctgtctctactaaaaatacaaaaaaaataataattagccaggcatggtggtggaggcctgtagtcccagctactcgggaggctgagacaggagaatggcgtgaacctgggaggcagagcttgcagtgagctgagaatgtgctattgcactctagcctgggcgatagagtgagactctgtcaaaaaaaaaaaaaaaaagaagtgatttttcccttatgccaaaagaatcctaaaaggagggtagcccaggactgggaaggtggctccttgtgttggggacccatgctccctctgtcttgccacaccagcactcttggcaccctacctcatagtcccatatggctgcctgggtttcagacatcttattctcatttagccagcaaaggatgaaaagggcaaagcatgcattctcttccttaagggaggcttcctaaatgctgcacatgacacttttgcttatagctttttggctagaacttagtcacatggtcatatccagctgcaagagaggctggggaatatagtttttaactgcacatattgccattccttctttctttcttttctttcttcctttttttttttttaagagacagaggtctccccatgttgcccaggctgctctccaactcctgggctcaagcaatgcacccacttcggccttccaaagagttgggattacaggggtgagccaccatacctggccatattgccatttctaataaaattgataggggagactgggagaacagatattcacaacccatacagtgcctctgccacagctactgaaagaaccaaaaatataaaaactcactaagaagtttaaagccctatctaatatatgagattattattacaaaacacttaactcattttagataagttaattgtcctgacttttaggttgaaaacagcccaatttttct

SEQ ID NO: 79369 - DNA, 1043 bp, Homo sapiens
ttatcatttcccacttagataagctcttaggaaagaggcagtgggtgggaaggttgggctttagtgagatcacttgggccaagggagcagaagggccatgtttttgcttttggtcttttcgtaatatatttttaactccttttgttttgcactaggtttggagattgacaggccatggcctaattcattcatttaaaagtgaacatgctaagcagtccatatttcgaaacattggggctggagtcatgcagattgacatcatccagggcaatcggctcttctcctgtggtgcagatggcacgctgaaaaccagggttttgcccaatgcttttaacatccctaacagaattcttgacattctataaagattggggttttatttttatatacatttcagttaaaaggcacactacagtcatcactaggcaattctgctttctaagcagttgtattgaaaacagagaatctctgtgtagaatttgaatatgacccaagctgagtattatctaaacaggttggtggaatgaatgcgcatgtaccttattatgctgacatactaaaaaaaataaaacctagtattgtatgaaggatagctattctttacagcatttagcaaacctgattcagaaaacatttgagattagcaaattagtaacttgaaataatgaaaaggacgtttataccaaattaaggaagaaaatgttgctgatttgggtttttcttcctgttcttaccactgactgaagcatgcctgcagtctcctcctctgttgaatgaaggataatcataaggtgtttgttaggagcgctagaccacctggaaaactttcttagctgtggagcagtgcgcagtgaccagttctctgctgtgagaggccgtttccattctttcctgctgaatatttttcctgttagtgtttatactgagctagtactgtaacttgcaaatgagtgcaaatttaaatgcaatgttttactcacaatttgcacattcacattttttggactgctagtttttctatttaaatatttgccttcatgtta

SEQ ID NO: 79370 - DNA, 1110 bp, Homo sapiens
atcaacccctatagggcaggaatttatgtagcatcttctgcatctgcttatacaaatgggctttaattttatagattaccagttatgtaacttagatttcttaaaactgtatacagataactaatttttattttgaaatagcttttatgttcttgtgtttatgtaatagtcacattaattttgctcttttggctttgtgttgtgtttatttgatgactgttttattcggtttaattttttcttgattttgcaaattcatttttatcatctttaagtggtggagtggccatttcagcttgaaatatttcactgtctttataatttcattccatgcatgtgttttgtgtttgtgacggtgtggtggtatttagtctatagaagaacatgtggagcaggtcaaccaaaactgcatagcagaagattgccacatcaaggtagtattccaagatcttgtatttagctcattctttaaagttcaaggagctaacgcctcatctctgatactaaccatgacctgcccaactggctaactactcagagaactcatagtactcccataccacttcagtggcacaggggaggagatgcttcactgtatctggcttgctctgtcttgcccttggttcttctctttcttgctccctgtcccatcttcacttgtcactttttctgttttaagcatggctgtttcatcttcttgattctgccttttctttccttcccatcaccaaccctaagccattgcatcttcctctcatcagtctcttttattcctttcgaagtatccctctttacaacttttccttatttctgtctcaccacccttacttcaaagggtggtttctttgcggttttctatggctttttactccactctgtgcctcttaatgtatacacattcttattgcagaatatttatgcacttttggaagagctaagagagacatactactgtataaattactaataaaaatatattagccatgttttataattaatcagtatcttaccatcacagtggaaattggggtgattacaggacatcagagaatttaagcaaattttccaaagctagttttcaacacattaaagttactcttaccctttttt

SEQ ID NO: 79371 - DNA, 1002 bp, Homo sapiens
aggatcaacaaagtgtggtatattcgtgcaatggagtgttactcagctataaaaggaatgaagtactaatgcatactataatctgtatgaacttcaaaaataggctaagccaaagaagccagacacaaaaagtctcatattgtctggctccatttatatgaaatatcctgaataggtaaatccatagagacagaaagtagactgtggttgccatgggctagggggagggagaaataaggagtgactgcttatttggtatagtgtttccttttggggtgaggagaatgctttgaaactagatagaggtggtggttgcatgacatgttaaatgtactaaatatcactgaattgtacactttaaaattgttaattttattttatgtaaaatttgcctcaattaaaaagaaataatagtggttcatcctagggtgttagttatggtcagagtgaaaagtgatcatattctgggtatagtttgaggttagagccaatggatttgttgatgaattgtgtctggggtagggaagatagaagagttgagataaaattattttctgtgatggggaggtttaggagaggagcaggttgacttctactttctggccctcccatacccaattcctgaatccttttgctatttcttttgtgtatcactcatatacaacccttcctctactttttaccacccaccatattagtgcaggctgttcttatgtcatcttccatcttcctctctaattgatcagacaagccatacctcattgtgtgactaaaacttaagaggtgttagtgagaattgcccaaaacataagttcccaggttcatagccacagacttgtcctaacctaactctagactgttgttgatattacttccctccatgactcctgtctaccaaaagtaatttactcctcatttacccaaaccttctttgattatttgtttatattgtccttttccattttcccattgaacttctgcccttcttttaaggcacactat

SEQ ID NO: 79372 - DNA, 1045 bp, Homo sapiens
ctgacatacgtcttatgattttatatacccttataggtgtgagctcacttattaatcttttgagttcagcccaagatgaagaccagccaaaactgaacattttgctatgtgaagctgttgttgctgtttacttaagtttattgatacatgctcttgccacaaattcctccagtgaattatttcggcttgcagcccacccattaaataatcgaatgtgggctgctgtttttggaggcggtgtaaaacttgttgtgaaacctcgaagacaatcagaaaatatttcaggtaagatacgtttgataccagtaatgtatgtaaatgttaatcattttgaatgttaaaattttttttaatgtttcaagaaatttcactttgaaaataagcgatgcttaaagtataatcactcttgttatgacagcaaataattaaacccatgatataataaacatatagtttgttacttttatttttatagaaataacatttttgaggttgataaagcaggacatgtttgaagaagattaaaaatagaggaaaggtaaaggtaaatacagaaaaaatgttaaggaacaaagtcatacaaaaagagtagttcctaagacaataaaatgaaaaaaaaaaagcaaaaacaaaacggatagttcttaattacagaaagaagaaaatttaagtaagtgttcaaaatctttagcgcataccagcagttggcttcagattaaatgtatggtcatgtgcaagatagccattccaatcatacacacagtttttaaattctatttttttattctccaaaataggttcctttagtcttcaatgtgatagtattattccattttccttgtgtgtttcttcttccctcatggccagaatatatttttcatcccacttttgaaaatggtatgatatggtgaggtatagactgatgccgcaggaaagatttctatcttgatgctgatatatagaaatcatcttaattcatccttagaaatggacatattacagatgagaaatcagtggcacacaagtttaatgacactaacctctg

SEQ ID NO: 79373 - DNA, 1087 bp, Homo sapiens
aataatatttagggacatttggttttaggtttaggtatttctaaaatgtgattctctgggttttagttcataactttaatttagggttaaacttgcacaactttgcagagaaaagaaatgcaacctactagtccctgaaactttctgcctactgtatcctagtaccagcagtagtctccttacctcagactttgtaaaaacacaaaataaaaattactgcaaatagaaaagattttaaagtattaaagtggcatctggaaaaaattctaaaggaataagtgtcatctgcccaacataataaaatttgttactttgtttaaaagaaacaataagcatttgtaactaatttcagtaattttctaaaataaatttttattagaacagtgaatgcattttaagaatttttgtttcttaaaataggtgtctaaaatagatgatatacataaagtgcaattttttattacctctcaggatgataaataactgaacctatttgttttagcagtcaaacagaaggaaatcagtttacaggaatggcttatcaaggacttcttttaagtgatcgtagaagactaaggacagaaagcattgaagaacacgcaacaccaaattcatctcctgctcaatggcctggtgagaatttaaatgattaaaaaaaaaaaatcttctagttggcaatttcttcctaaaagcctactgaccagtttcctgcttgttgctggatttagtgagtggttcctttctttctttgttttttgatgatgtttttctgctatggattaggaactattaagtactgcaatattgtctgaagactcaggaagttaaggcttcataaaaccagctatgttaaccaacataaaaaagcaatgtcttaacatccttcataaggatggagcacattatctttcttagaaatgttaaattagagtcttagaaaatcacagacatattttcacagacataccatagaaaatacagttagttgttctcgggcgtgtaaatttatgtattggggtaggagtgactattctgtggtacatatatcatgctgtctgacagtcctttttttcttgttggctctctt

SEQ ID NO: 79374 - DNA, 1643 bp, Homo sapiens
tttagccttggaggtactctccaaaattccaaaagtaaccaaaacatctgccttatctgcaaaaaaagatcagcctgacttcatttctcacaggatggatgatgtaccttcacattcaaaagctctgagtgatggcaatggaagttctggcattgaatggtcaaatgtaacttcatcacagtatgactggagtcagccaatagtaaaagttgatgaggaacctcttaatcttgattggggtgaagatcacgacagtgccttagatgaagaggaagacgatgctgttggtttagtgatgaaaagtacagatgccagggaaaaagataaacaatcagatcagaaggcctcagaccctaacatgttattaacacctcaggaagaggatgatcctgaaggtgatactgaagttgatgtgattgctgaacaactaaaattcagagcttgtttaaagatccttatgactgaattaagaacattggctacaggttatgaagtagatggaggaaaactcagatttcaactctataactggcttgaaaaggaaattgctgccttgcatgagatatgtaatcatgaatcagttattaaagagtattccagtaagacatattccaaagtagagagtgatctgctggatcaggaagaaatggtagacaaaccagatattggttcctatgagcgccatcaaatagaaagaagaagattgcaggccaaacgagagcatgcagaaagacgaaagtcgtggttgcagaaaaaccaagatctcctgagagtatttctcagctactgtagccttcatggggcccaaggtggtggtttggcttcagtaaggatggaactcaaatttttgctacaagaatcacaacaggtgtgaatatcacttttttttcaatcttggttatttcagtaatttcagtagctcttccagttatagctataaagctcttttactactttttactagttaatctaaatatgttcagctcctctctttataggaggcagatatttatactctatgtgtcttagactgaagttttgataataaggagtaggcttaacagcttgagagtattcttgtgtcatatttatctatataccatctacatctagcatagtacctggtacatactgggtgctcaataaatttgtgtagaatgagtgagcgaacatattccctttacacaatgtttatcaccagtatttctgtcagagaactgataaaattttttaaactactttgaaaaaaataattcactatcacccacaggaaactacagtaaagcagctccagtctccactaccactgcctaccaccctacctctgctttcagcaagtattgcgtcaacaaaaacagtcatagctaatcctgtattgtacttaaataatcacatccatgatatactttatactattgttcagatgaaaacaccacctcatcccagtattgaagatgtgaaggtaatgtaaagtttatgatcatttgatattatacaccctgagaaggtaaatatgttatacctgtcttttaattcgaacttaggggaaatatttcaaagtgctacctttctcactcatgatcagttcaagactattagtccaatgaatgtaatttaaaagtaagtgttcttacttctggaga

SEQ ID NO: 79375 - DNA, 1069 bp, Homo sapiens
atcttttcagcttaatctagaggatgggatgttttaaaagttgataaaagcactttgcaaagtaaaaaatgctgtttcctatttatgtatacataaggcattattgaccttccttcttagaagaagtgaagagatgcttgataacaaatgcctgtccttgaagttattgttcttcttttagatttctgtttgaggtttttattttatattattatacattctgtagaacattttaaatttggtttaaccactttatgtttatgctcggtccccaggtcacagcatgatgaaaaaatgacaacatttttcagccacaactttaatgaagatagatggcgaaaagctgctttgaaaaatgctttttccttacttggaaaacaacgctttgaacaatcggctgcttttttcttgctagctggttcattgaaagatgccatagaggtataaataagaaaacacactatataatacttgtaaaagattgaaaacctaagaaggttgtagaggagattgtaacttttggtcatatgtttgttaggacacagaataactacagaggttgctgtacttaaaatagtggcactgtggtaaaggaaaatatgaataaattcaagggagaaacaaatgaaaaatttcaggctgggcatggtggctcacgcctgtaatcccagctctttgggaggccagggaaggtagatcacctgaggtcaggagttcaagaccagcctggccaacatagcaaaactctatctctactaaaaatacaaaaattagccaggtgtggtggcacatacctatagtcccagctactcgggaggctgaggcaagagaatcacttgaacccgagaggcggaggttgcagtgaggtgagattgtgccactacactccagcctgggcgacagagtgagactccatctcaaaaagaaaaaaagaaaaatttcatatatggcacattgcatttcaagactatgtgtaaaatatatgaaaaaaatgctgaaaaatagtttatgaatgtcttcttccagaccatcttgtgattctgaactgtttaaagtacataggtcacaa

SEQ ID NO: 79376 - DNA, 1035 bp, Homo sapiens
ttaccactaggtggtagtatcaagcaaggagttaagtcaagatgggttcttcttagatctatagacttggtatcttctgttgatggtactccttcactgcctgtttctctctcttgggtaagagatgggatattggtggtaggaatggattgtgaaatgcatgtatatgcacagtggaagcatgctgtcaaatttggagacactgaagctgatagttctaatgcagaagaggcagcaatgcaagatcattcgacctttaaatctaatatgctggcaagaaaaagtgttgttgaaggaacagctatttctgatgatgttttttgttcaccaactgtaattcaagatggtggcttatttgaggctgcacatgtactttcccctactcttccacaatatcatccaactcagctgttagaattgatggatttagggaaagtgcgaagggctaaagccattctctctcatttagtaaaatgtattgcaggtgaagtagcaatagttagagatcctgatgctggagaaggaactaagcgacatctctctcgaactattagtgtaagtggcagtacagcaaaggaaacagtcaccgtaggaaaagatggtactcgagattatactgagatagattctatccctccactaccactatatgcattacttgctgcagatcaagatacatcctacagaatttcagaagaaagtacaaagataccacagagctatgaagatcagacagtaagtcaaccagaggatcagtattcagagctgtttcaaatccaggatataccaacggatgatattgatttagagcctgaaaagagagaaaacaaatcaaaagtaataaatctttctcaatatggaccagcttactttggccaagaacatgcaagggtactttcaagtcatcttatgcactcaagtctaccaggccttacccgtttggagcagatgttccttgtagctttggctgatacagtggctactactagtactgagcttgatgaaagcagagataagagttgctcaggtaaatat

SEQ ID NO: 79377 - DNA, 1039 bp, Homo sapiens
attttatgtcttggctgttgtgaatagtgctacaataaatgtgggagtgcagttatccctttgatatactgatttcctttcctttgggtaaacacctagtagtgagattgctgagtcatatggtcattctgttttaaaaagagctctcttttctctatatcctcacctccaaaatacttttaagaagctatgtttcttaaataataacaaagtaatattctagctcctatttatagtaatgatatacatacattttgtaattttataatttatttttaaagctaaagcttcagaaggggcttcctctgagagtctactttcagtccctggacagaagaacgtagattcttctccagaaacctctcctagtgtgagccccatgccacattcttcatcaattgccaatcttcaaactgccagtaaacttattctgagttctagactggtgtatagccaaccccttgatctcccagaatcagttgaagtaataagagcaacgccttcagcaggtaaggtcactttaagactgggcagtggtagctcagagtgataaaatatatgaactctttagtggataaaatagatgaactcttctgaaatatgttctatgttgacattaaaataaagattgattttctattaatgatatgtctagatggttagaaacatgtctttattagaaataatttcctggctgggtgcggtggctcacttctgtaatcccagcactttgggaggctgaggtgggtggatcacttgaggtcagtagttcgagaccaccctggctaacatggcgaaaccatgtctgtactaaaaatacacaaattagttgggcgtggtggcacgtgcctgtaatcccagctacttgggaagctgaggcaggggaattgcttgaactcgagaggtggaggcggcagtgagctgacatcacactactgcattccagcctgggcgggcgacacagtgagactccatacacacacacacacacacacacacacacacacaaacccacaaaatttcctgtgataaatgtaat

SEQ ID NO: 79378 - DNA, 1092 bp, Homo sapiens
ctggttggaacatgggtgaggaggactgttctttttagcagaaagttttgggattttggggttccaaagttaggcttcatttgtttgttcatacatccttatcccaaggcacaagagtcccacttcttctcaacccttgcccttaccttcggtctggcagggttgtacttttaaatggcattgcacatctgcagaccactcaggcattgggccagatcttcagccatgtctgtcttgggctttaaggttgcaaaaatgaagaagatatgataccttgaagttatatgctatttttgtaaacattatagttttctctctgcttaactttagacttaacatgagaatgagtatggaaagttgaagtatttctttgaatgtattacattccattgccaatcagtgaatatttagagggggccttaaatgtccaagatgctgtatcatattgacattagattataatttgttggccattaacattttgtgttttttatttacagaaacttattggagaagtgtttaatattgtgagccaacagtctactgctcgacctggctgcattattgaactcgacgcaataaccaaccaagtaaaaacatgcttgtgaattggtgatattcgtatactttatcccatggtgttttatatgtatatgatatatgtcattctcagaataattttcttgtttgttattaaatgcagacaacttatgttgattcccatagtgaaaatctactaatgatttagggattatttttctccttgggaaaccaagaactgtatgttctcatttataagtgggcgctaagctatgagtatgcaaaggcatgcagagcaatataatggactttagagactcagaagagggagggtggaaatggaactagagatttgaaaaaccacatgttaggtacagtgtacactacttgggtgatgggtgcactaaaatctcagaattcactactagttcatccatgtaacaaaaaaaccacttgtaccccaaaagctatttaagtaaaattttttaaaaaaggaattattcttctccagttgaattgtatttgtagcaaaggaaatttgattcatttaga

SEQ ID NO: 79379 - DNA, 1038 bp, Homo sapiens
ggagatactcctaatgttccacattaggtaccagtgcacatttgggatttattattacaaagacagtacttgaagtcattagatctctaaaggcattagtaatagttaatgttcataaatatgactgtcagtcatcaagaagagatttatgtttagcaggctatttatgaagacagggattaagttttttttattccatttaaagtatcaaagatacagttgttttggtgcctaaaaaataagcttttgaatatctagattggtgagatgctagattggtgagatccattcattcaggtatttagtgagtacttactaaggtattctacaaataaataaaggagaagtcatgatgaaagatagggtggtatagtgtgtgctgctattagtaaaaacaagcttttaaagtaggaatgatctaaagtgtaatttgttttcactcagtaacttatttactcaatctttaatttttattgaggactcactgtgcataaccttatagtacatggaagaataaatgtgcatattgtaccaggtgctaagagtgttaaaatgaatagaagtagtccctactttcaaggatcttgtatctatagagtcatataaatatgtacatatagtatgtaataagtggtaaattagaagaaaaggctgatttcaggatgtgaaattcatttaattggcctccacttaagccagctcattggattcattgatgctgtccattccttctataaaatataggatggatgctcatagggaatagtataccaggctttgttgattccacaagttgacttgtaaccttaacaataataacagctgggaaagttatttaacctgaaaaaaatgctgctactactactactactaccactaccactactactactactactactactactactactactactactactactagcaaacttttatctagtgattattgtatgtcaggctgtcttctaaatgttttatatatattaactcacttaaccttcctggtaaccttaagaaaaatgtaatattact

SEQ ID NO: 79380 - DNA, 1018 bp, Homo sapiens
ttaaaagaagttttaaggcatctttaccaagctgtatgtttaggttggaaaattggaactttttcaagcttgattcaccattttaaaaaattctctggttagaatttgttatcagtgggtggcagcatctcattctgatagttctgtatctgagctggaagtcatatatgttagtatctagagttgaacagtagattttccatttacctataaaaacaactattctaataaaaatgtttccagtattgaaaaccaatgactatttttgagcatctactatgttctcctagatgtagagggaatacaaaatataagtttcagacctacctttaaggagcttttaatttagctgaagagagagcttattaataaaaagttaagtagcagtttaagacataagaagaggagtctaagggtggtatgtaattaattgccaaaaggatggccctagaagtgtttcattattcagaggagagagagagatcagattaaggtaggcatagaattctttattaaggacaatatttgggttcattcttgatgagtggataagatttagaaagataaattctttgtctttgcctgagtgagaaaattgcctggaagtaagtatagatacaggaaagtacatgtgtaaagcttgttccagaaacagtgagaaaaccatttggattggagcttaaggtttgacatagagaaagtctagaaaaatagaatcatagaactagaattggaagatattttaaaggtcacctggtctcaccagccatctgatgctttattcccctctgcttcattcctgccaatttgtcatctggccatcgatgagggagactcaactctaaatgcagctcattctatccttgaatagctcacacaatcatattgaaacgctatttgttttgtgtacattctacttgctagtgctagttctacttagaataaatctaatatttcttgcgtatgagagtacctcaagatattaaaagacagctttcttgtaacctgtgaaccttac

SEQ ID NO: 79381 - DNA, 1023 bp, Homo sapiens
atgagctaaacgaagctgcctttgtcatctctctcaactttattgctatttagatctgtggctgtggtcattttgttgtacaagcaaagcacttgaactttttttcttcagccttctcttaggccatgaatagagatatggtattacctaaatagagcaaggggactggaccataaagaggttgaaaatgacattttttgataagaagctgagatttggtattttgagaatagaagtcttttttttgagaggaggtaaactatttgcactgaatcatataattatgtttttcaggtttctttttcttctcggattcctgttgcatttccctctggtgatgcaagctctcttagtaaaaatatcatgatgtatgcctgtataaatgcgacaaaagattctcaccacacgctgttacaccaggaggggatgtctgtaggcagtcctcacggatcacagccacactctagatcccacagtacacatatgaacatcttagctcccacagtaatgatgatctctaaacacatagatggttctttaaatcagtgggcagtcacttttgctgataagtctgcctttaccactgttctaactgtatctcacaaatttagatattgcggtcatcgatttcacctcaatgacctggcatgtcattcagttttaccactgttattgacatcctctcatcataatgctctattgactcctgaattagattgtcagtgggactcagacaataaattaagtagattaatggaccctgtaaaacatataaaaggttcctcgaaacaacctcttagaaatgcagcaactcgtacatttcatgacccaaatgcaatctacagtgaacttattctgtggcgtgtagacccaataggacctttgtcatacactggaggagtatcagaattggctcgaattaactctttacatacctcagcgttctctaatgtggcttggcttccaactctcattcccagttactgtctaggtaagtgttcattgtaattgtgaaattaacac

SEQ ID NO: 79382 - DNA, 1046 bp, Homo sapiens
acggggtttacatatgaaattagaccatggttagtatcctgtgttcagattttacttactccaaagttaacagctttctgtggtaccacttttagttttgaattcttccttcccgctcttcctcctttttacttttctatttgttacacaagtatttactgaccatctgccttggatcaggtactctgctagcccctgcaaacatcatctaactctatatgttctttggaagccatatccttttctggggaacaggttttgctaaatggtagtaataatgatagggtgaatgaagttttaatttatctaaaagtagtaactgtagtaacattcaattcagacaaaagtttcctttgtttttttttctgactgtaaattggaaaagagatttagtttttaaagatagtatgccatttatttatagtctagtatgtaaatgaattatttaatgcttgtattgataaatatattttctggttcagatttatccctggatagagaatctgaggcaggtacaggatcatcagaacatgaagatggagaaagagaaggaagtcctagaacttactcacgacttagtgtaccaatgccactgcctacggttctgcttgatcggaagattgaaacgctgctaactgaatggaataagaatcctgatatgctttttacaatacaccctgtagatggtacctttctagtgtggcatgtgaagtatttggatgaatataatcctggaatatttagacaagttcaggtatattttattgatgaaatagttattacatttcttaaaatagtaaaaagaaataaatgctttgtagagttagcatgtttttagaattactgaaaattttggttttgataagcatctgagtaaagaatacttctttctttcagaagggatcagtgaccataagcttagcaaacttgattagttagaagataatgaatttggccttgaaatgcagtactgaatatttaaatatatgtgttgatttttgagggaattaataatattttgaataagattaagaaactaccctgaa

SEQ ID NO: 79383 - DNA, 1010 bp, Homo sapiens
cctgcagagacttgacttgcagattaagttatcaacacaggcagccaagaagctaaaagaagagagcaggtaagaataccctggtacaaatgtcaaagtctaaataaatcactattaagatgtccttgctgggccaaatctttcttttctcttttctttgccttttcttttcttttctttctttctgattttttttctttttttcttaatttctttctttcttaatttcttcctttcttaatttctttctttctttctttttttgctttaaaaactgcattttagttctagaaaggcatttttagtatataaactctaaacagagctgctgcctgatgcacaaggctttatctgttgcagtgtttttatctgttatttactataaaaagtttgcttctttgctttaatagcgtcactgtccagctagcacttctggatagcggcaaaataaaagtgtctctctcactgacactttcaagagaagtagtgtcatagaaaatacttgtaaaatattgatagttgcaaaacttgtcaaagacattgtctgttatttgttactgggtgtttcctacataagatctcatgtgaacttttttctttgttttttaaatttgatattagggcaaatctttctctctcctatagaattggtttccttttttctttatgatttgatttcaaaaaagtacaatctactgtgtttccttttttgctctggctattgggaagcttgcaactaaaattgatacctgtgttcaactcctataatatttcttatgattaatacattggtttccttctcctttccttagtcctgatttttttatttctattttattaatcttattgtatatatgccttttgttgttagtaccttaaatccttttgggaaagaggtagaatatagaaaacataaacaaatataaatatgaatataatttagtatagatttaaaatatatgtaaatataagcaaatataaatacataaatgaatgacattatttattct

SEQ ID NO: 79384 - DNA, 1040 bp, Homo sapiens
gagggatgctttgtgaattcccttcacaggggaatcattgtattttattttattaaaaaaaattttttttgagacagggtcttgctctgtcacctgacctggagcgcagtggcgagatcttggctaactacagccttgacctctcaggctcaagcgattctcctgcctcatcctcccaagtagctggaactatgggagtgcaccaccacacccagctaaatgttttgggggatactttttggtagagatggagtttcatcatgttacctaggctggtctcaaactcttgggctcaagcaatccatctgccttggcctcccaaagttttgggactacaggcatgagccaccacgcctggctggggagtcattttcagtacgttgtttttaagttattgatggcagttgttctacctaatttcaccatacttgaacttgtgaccaccctttggctgttactttccttattctataaactgtttcttagtgaccagacagtaaattcatatttcattgagttacactattcaatctaggttaagggagacttttgaaatgaaagcatttgatcagtgtacctccccactcccattcatccatccctaagaaacagaggatagtcctgcatcagtttgaaaggacacattttctagtctcagcattaattggatcttaggaagtgttgaacagagggtaggtgggaaagctatagagttttccagctcttccttggattggatcatgacttttcttagctttatatgaagtgaaattgccagaacagtagacccagctacgttcagacagaagtataaaacataccaaaggaggccaggtgcggtggctcatgcctgtaatcccaatactttgggagaccgaggcaggtggatcacaaggtcaggagatcaagaccatcctggctaacacggcgaaagcccgtctctactaaaaatacaaacaattagccaggcatggtggcatgcacctgtaatcccagctacttgggaggctgaggcagtagaatagcttaaacccgggagg

SEQ ID NO: 79385 - DNA, 1038 bp, Homo sapiens
attttagttagtggagacagtaagtagaaaaagaaaatgtatcttatattgataagcataatgaaaaaaaaaccaagcaggagagggagttggggagggctcgtggagatggctggaatttaaaatggtgtggccagggaagaccttgctgagaaggaggtaagggagggagctgtgcagatatctggtgaagaacattccaggcagaaggaataaccagtggtgcaaaggccttgaggtgagaacataattggcaccttccaggagtactgtggctggtgcttagaatgcagtggggtatagttggactagatcactttggaccttgaagaccattgtaagggctttgtctttttctctgagttgggatgcatttaaggggtttgagccgaagagtgacataatctgacttgtgtattaaaacgatcactctggctgctgctttaaaaatagtttgtagggaagctagtaccaagcaaggaaaccagataagatggtggcttttgcagtaatgcaggtgggagaggatagcagctgggaccaaagcagtagagaaggaaggaggtggtgagatgtggctggggtctggatgatttgctgatatgctgtaaatgttctgcttgtttgtttactgtttagtttgaatatctctcccctagagatgggcctgggcatcctggggatgggaaagaagaatctggagtttcaagaagctggctaggcctgacacctgatggacccaagttcttctgctagtgacttaggaaagatcattatgactctttcctaccatcacctttttagccattaatagccattaaaaactggcattcattattttcttaaccaacttctattgagtctggttggtttgaggccttgggctagatgctggggctagaaggtaatacatgttgttctctttttattcatggtgagtttttcagctactgctttctagtagtttctagctacttgagaagccagagaatttgtttcattgatgtttgtatcttctgtggctagcctggagcctgg

SEQ ID NO: 79386 - DNA, 1122 bp, Homo sapiens
ctctagaggcaggctcagggctctttgggcaaggcattccagggtcctaggtacctgaagtgtggtatagaaagtggcctatatgctggatgggcatatccctttggcctcatggttcctcccctggaggggagaggtacagccacaggaagactagtatggggttctctaaagtgcacgactcagggcagggcctctcctgcccagacccaagggcagtactgccaataagaggggtagaagccaccatttccctctgtgtttaaggactgtagtctcagatctctgtgtggcagaatgcaggattcctcctccagtgttccttccctctgacagtgacttattgatgttggtaccatcctggcaatccaggaatctcggttggatatgaactggcttaattatatgggtctcaatggccagaactgcattctctgctcagtctacttaccctaccaataaggcagtagtactcaatatttttgtttttcttctgatttaaagggagagtctttatccctaaagaaaagcctatagaaactcgtaaagaagaaaaagtgacccttgacccagaactggaagaagctttggccagtgcctctgacaccgaactctatgatcttgcaggttagtcctgaactctgggaactttcctgtctggctctatgacctccgagcatgcactggcacccatggcagcaggctttgagcttctcttaggtaggagaatgacaggttgacacaaggcattatggagctgtaagtcttgatgcaggtgacttaaactctctgagcaaatgttattttgctctatttcagcagcaaataatacccatctcacaaaactcaagagttactgtgagaaattaaagcaaacaagtatgaaggagtgttgagaatttagagaataaaacaacagctcttttgctttctaaggagctttcacatttggcattttatcatcacaacatttctataaagttcttgttcttcccacagtcattgttccattttgattcagaaaacgctaagaagtccattagccttctagtcttaacaatagcaacatgataataattattattatttaaaatgcagatagaaaaaggtcaaagagtacaa

SEQ ID NO: 79387 - DNA, 1325 bp, Homo sapiens
aatgcagtgctaaactaatgaagcaggtgactgcagcctttggctcaagctcacaactctgataactgtcagtgcctgaggttgtgattggtgacattctgacactgcccaaggcaactcaccctctattcctcctttctcccctccctttcttccaattcattgtcttttttttcctcttttctctgtaatttgttactaaacaaattccagaatttgtttagtagctgagtgttcctgagttgcctagtagcaataaaacaagtgaataggaaaataattaatatattattctatttagcttgtaaaacacatggaatctgtttaagatagcccttgtaaaattgaacatttacctgtattgtaagtacccacatctgtgtctctgaagtcctttgaaacatctcattatcttgaaatttttttaatgtttgagaacaccataagcagaatattctaacacctttggcccctgaaaatcctttaattagtttatggcttcatctccttatctatttaaaaaacatagtaaataatgtttatggttttcagtctgatttttccttccctttcacccatttaggtgtgatgtgttggagtcaacttgtacaggcttgccaactgttatattttcaagaattttgcaaactggttgttcaatacagccattatttaaaattaaatgatgtgcacttacaactgaatgaattatattaaggacagaagtaacaaatactgtactcaaaaatcttacattttactattttctaacctcttagattatttacatctagtaggtatgtatgtagaaatattaccaaacagtatgctactgaacgtatcctctcaactccatgttcactaccttcttgttactacagtggcttgaaattggccatggtagaaatatttacaccacagaaattagcaatatgtaagaaattggggttttctccctctccagattgctggttgataaacattcatcagcacaccactgggtgaaattatacatttttttatacatatgtttcgcttatcatgttgccgaagggaagaacatttctcttagatgtcttttctcctctttggatttgttacaaacctgtttaagtgctgagtccctgacctgcctctccaagtaagcctttttcctttttttttttttttttcttactctcattcttgccttgactcttaaaatcctggaccctatagagcattccttgcagccccacagtgctgtgggctgggggctaaagcagttcttggcaaactctggcagaaagcaagaaaaaaagaatcagaattcaatcatggctgtt

SEQ ID NO: 79388 - DNA, 1044 bp, Homo sapiens
cccaaagtgtggaagtggtagctctttcatgatcatgggcacagttaatcctttgctatccattgtgatggggcataatgtatataaaatatttttctatgtatttgttctgccagatactgtgttgagatatttggcaatatctggataactgactgaagggagataacttctccccaggcctatctccctcccccttttagagttgtgcaggtccactttaagtgtaaaatcactcacctggacttgtgggcttgtatcaccaacatctattatggcacatgtagatgacatttaggagaaaaaccttagaagtctagaaatcatatgattagttcagcactgcagctccccatctgcttatagtgtataactggaagctctttcatcctcatcagcatgattaaatgacttcgtttctttcatctttggagggtataatgtaaataagtgtcgtgtgtgtatgtgtgtgtgtactgtcagatatctaactaggtatttggctacatctggacaactgattgaagggagatgctctctccccagtcctcttcccttgtcctttttagaattgctgcaggcccaggttaaatatgaaattactccctaggctttgcagtttatgttaccaaccaccacattttatagctatgtagaggatgactcttaggaaataaatattagaagcctagaaatcatttagttgttctagcaccaaatctatccatttgcctaatgtatttaacattccatcctcatcaacatgatgaagcccctttcttccatctttgtagggcacattgtatataaatattttgtacataaagatcatcaaataccataatggggtatttggcttcatctggaaaattgactggagggagatgctgtctcccagccctgcttccctcgtccctgtccaagttgctgcaggcccaggttagaagattaccaacctggaggggcatgcagttcatcttacaataaaagcccattcatttaaaaactcagaaatcatcccagtgcctgtactcctcaaaccaa

SEQ ID NO: 79389 - DNA, 1120 bp, Homo sapiens
aggaaaggtcctagctctgccttccacttgcagcttccctttacctcctcttattgctttcatctcaaatatccctgctactcaaccaatcctaaagctaaagtactgagatgcacacaaaggaaaggtgtgagagtgcttggaagcatccagctgagcccactggatgaaaatcagacgatagggcctcctgttgtaatatactagccagagaaaagcgccaagaacttcagggatattattcactgctttattgctccctaaccctagatcagattggattttactttgtagttcaggagttaagaagtcaaattgctgaccgaggtggggaaggatgatggaaattaaaggtttacatttgtttaatggcagaactgagatttgctcagcttatctctttcccatctgtctgtaatagcaatgactgaataatcagtagaccaatggaagaggagttgcaagtttaaatttgtaacctgactctgggttctgttctaggaatagtgcatgttttagaggctttgccagttgggatacattgttgacttgggggaggatgaaggagagaactgatgacctagacatagaaaagagtagttaactaactagatgttcttctgatctcttccatggtagacattctgagcacattggcccagttagttggtatggtgaaggggcaccgtactaacagatttggagactgaaacctaatcccatcaccaacacttagcaggtatatgatcatgggcaattcattcaattgcctgccaattatagactatatagggggaagagcactggatttggagtcaagaaacctggacacttggctccacacttccttagctgggtaactttgggcaaaccgcttggtctctcaagcctaaggttcttcagctataaaatgggaataatacttcactaactacctcacagagttgtggtaagaatataatcagataactggataaaaacactatataaactggaaagcgccgtacaaatgtgagagatcagttttattatcaaatcactgttttccactgcctcttgaatcggctttattctaaccaaccattacatctttctcatcttttggagtatgggtaattga

SEQ ID NO: 79390 - DNA, 1005 bp, Homo sapiens
ggtttaaaaacaaaaacccttatatacatggaatagttatattttaattaagcatttattttagttgttttcatccattcaagcaaaatgaataagcagcatttttcattgcacttaaaaatgtaaaatacctgcatgccactaatctgtaacattttaccagttcagatgcctgtaatgtgtgactttatgtgtgtctgtgttgttttgaagagaataaaggaaataatactttgcaaactgtttaaacaagtgtttaaacttctattggcaacatttattgggctaagcagttattgaaaactccgcatagttttattttccatttgaaacttcaatcaaatcaagactattatattcattagggaattaaagactaatttgctttttaaatgtgaagttgaacactgtgtggaaagtaaatgtgtgatgaagcaaaatgtataaagtatgaaatattatacttttaccctggataattattcaggaccccagttggcccaaataggtgcaatttttaatcctttgaaattagccagccagacctaatgctaaggtaaatgtaaactgttttaattaattaagatctttctgctttcgaaggtataatgtatctatttctgtcaggaatgatatttccaaatgaaaatgtaaagaacattgggaaataataaactttcctttcaaagtaaaagtaaagactggttttatatggctaatttttagacagtgtttctttaaaacaaatggttggcatcatgttcttagatgagcacatttgcagaaaactattaaatgcccttatgatgaagaaacaagacaactgcaagtagccataacagagagaaataacttgttatcaaacaaaaatgaacacatttggctaaatagttaaaaatttgttagaatgaatgggaacaggagtacagaaagcccaaacaggttgactattttaccctgaattttttacactaattttggatttacattattattctctttaaa

SEQ ID NO: 79391 - DNA, 1078 bp, Homo sapiens
tgctttccaggaagtccgtctgcgggcgcgggtagggagtcgcaccggccatggtggctgaggagggagaggttgctgcccgccggccgcccgactccaggctccttcccgacgggtccgtctcggggagcaggggtgcgcgggggctgcttctgcgcgaacggcccgggcgggggacgtggggcgcgctgggcgtcgcccgccggtctaggcgcgcgaacctggcgttcccagtgaatcacccgcggcccgggcgcccgggttcgggaccggccccctcccctcccgctgagccgcggccgagctggctccctgcaccctacccagcgtcgccgggacgcgatcacaccgagatggcaccgagcctccttcaaaggcttcggcttgttgaaagtggggcggcggagtgggggagccaaaacttagggcacaccctttttgtgattgaaatgtggctgcccttgcattcaccggtttgatctgtctgctcttagaattaagttcctagctcccaggcagcacagctggatccggctgggaagtttgtgtgttagtttgttttgaggacgtgactgtgtcgttatatttttgcttgcgggggatggtgtgtttcctccgcaagcctgcattctgattacaaacagaaatgggaaacagccacagtttctttttttctttttaatgtttagttaagaatcgcatttccaacttgcccttggcctctgttaaaaccaaaagtcatctggcaatgaacactgcagtaaaacttaccccaggaggccatacttcaacaggaaataagcctgtggagatttaagttagttatgtgcagcctcccttggtttgtaacattttcatgcagctcatgtctcctctccttttctgagaaaccttcagattaatttttttggcagattaaattgattaattggcccgtcaaaaatatattaggcttggaaaaatagctttgccaagtctcatttactcttgctagtttcttcttcctaggcaccttttcacctttaagagtcagcaatcataatagttacagtcccctttcttacacattcctacgaaa

SEQ ID NO: 79392 - DNA, 1030 bp, Homo sapiens
ggattgcttgaacccaggtgtttgaaatcagcctgggcaacatagcaagaccctgtctctacaaaataaaatagattagccaggtgtagtggtgatgcctgtagtcctagctactcaggaggctgaggcaggaggattgcttgagcccaggagtttgaggttacagtgagagacaatgattgtgccactgcactccagcctgcgtgacagagtaagaccctgtctctctaaaaaaagaaaaaaaattatatatatatatatatatatatatatatgaatgacatggttcctgtctaggaccttattctctttgggattaggcagatatacttatgtatagtccacagcacttgtaagagccacctgtagggaataaaaacgtggtagatattcaggagagatattttccagttgcaggagtggggaacaactaaagtcaatatttttttccattcactggtcatctctttccccaggctatactgtctatactgtttgaatgtatgtgacatatctacatagagtatagtggaattctgtaaatttattttatttggaacctgagatgagccagatacatgaacataattagaaccggatgtggtggcacgcttctgtggtaccagccacttgggagactgaggcaggagtaccacttgagcccaaaagttccaggacagcctgggcaacatagcaagaccctgtctcaaaaactaaaacaaaagagaaaatcaattatatctgagcaatatcacagggaggatgagaggctttgcggataaaagtatacctggatagagggagggagaaagataaagaggaggatccagtaaacagtagaggaaaaaaaggcttttagtaaggttttctggtgtcagtctgatgtatactgatatttaggctgtgttgtagctggcaaactactcttcacacttttcagttgctctttaatatgcatgagctctctcgattagagtagatgaggagggcattattctctaggccgtgtggctaaagcgctatcatccct

SEQ ID NO: 79393 - DNA, 1073 bp, Homo sapiens
tcatagtacttcattaggcatgaggttttctacatttagggcctaaggtcaaggtagtggggcagtgtcattttcttgaagaattgactctcttttgccctactattgactgagttcgtgcttttatcccacctcatgagaattataccctaactccaggagttaccaaatctctttttgagtggtattacattccccacctccctcatgaagtacaaaatacattatgcaaattttaggccttgtgcctcttgaaaaacctattgtaactactactccctttcaatctgaaaattaatcatgataataaagcttgatgtatctccaggcccctgacgttgattagagtaataccagtggtatctctaagtcagaagtgtgctgtgtctctgaaggtgcatataaatgccttcaccatgtaagagtgaggcatggtccattgaggagcattcattcttaccagctggggcaccgtactcatgactcagtggtgagcaatggggctagatggtatgccatacctggagcactgctgatcttgagaggaggaaaaagagtagtcagagttggaagagctagaaaggctttggagaggacagacttcagctagtctttgaattgtgcagcgtgtggataagatagagaggtgaaattcgggcctggggtaaaaaggattgtttaagaagagtgacatcattgtgggaaacaaatgaggcggccagctgaagatgaactttggatatctgtgaggccctgaggaatctagcctgattaaagcagaggattcctagtgattcttagagcaagtaggaaggggagttttatcaaaatcacccgagaaactgtcaaactacaaacacctaacaagaaacatttctaagtaaaggagtaaaatgttaaaagcagtgttttaggtgactgtaggcaagatacagatgttagagcaggaaaacaggagcttagagtcagtttgcttgtctagagcctggtctgacagagggcttagtaaagcagtattttttacttcctctttttatgaggttccagaagtttctctaggtcttagaaccttt

SEQ ID NO: 79394 - DNA, 1083 bp, Homo sapiens
ttcaacttgctctcagcatgatttcttttagacctggcctagtttattttaggttttatgtgttcttcaatgcttactaacttggtggattaagaaaattcttgcaagaggaaaaatgagtcatggtgatacttccctttgggggagagaaagaaaactctcagattaatctcaccattatgcacttggcatggattcagcattttgattgatggctgagcattgataaatctttccctgtaagccacttcatatcatatttggttttgttcacagtaggactggtagaagtctctttttcagttaaccagcagagataaagaactctgtaaccttattaccatcagagacttgttcgtatgatgtcatttcttttttttaaagatattttgagtttgcaacaactgggaaaaaacatttcccagtctacccagtctattaaacaaacaaaccaaaaaattaaaaactgaaaaacatttggtgctgagaaactgggtatgctaagggtgtggctattttggcatccatctttggtatgcacagagtgggttcctctttgaccttgccctgtgtctctgatgctgcagctccactaagaagaagaaaaaggggaggtgggacagaactgggagctggtttgctactattcgtcagaaaaggaagtggggcacctacaagagagccacgaagtctctcagcagggtcttgttgaaagattgtttttgaagtggtatgaataacctgtcaagtattttcttgtaataatcacagaactaatctggctactttctactttaaggtagtcctccgtgatctgcttctaattacatctcttctttattctagccctaacaagtttttctgcactgccttcagatttcaaactattttctctgcaatctataaatttcattttttaaaatgcaagatggcattggtagcaatggcaggaaagacagggctacttaggttgattagtttccatgggacttttacacagaataatcaaccactattttttcaactactgtgtgcaaagcagctatctcactgagctgtgctaatatctgagtcaacaaaccg

SEQ ID NO: 79395 - DNA, 1071 bp, Homo sapiens
atgaaataacttttcgaattctttgaaactcagtagctgcctttgagcttttccatgacttttctctggcaccttccaccctttcctccactttatccaaatcaagttgcttttggctctctctccagttccccacttctgcctccatatgtttaatgacatgactgtcctaaactacttcagtatccttgttttcaaacatctcctgaaattttttcctcctctaagaaatttttctcctctgtgcaggaagggatatttttagtacaatgcagcagatggttacctttttgatacacgccaacctctgtctcttcagagcttctatgccaggtggctccagtgtagaatgcctctaaaagattcttcatgaccctaaatctaattgttccctttctgaaagaggctgaccgaattgattacatttccagacattggtagaatagatctaagtaacttcttggcaatacagcagtccactgtggagcagacatgaatatatgtatgtaagctttaacttgcaaggtggatgttgtttgtcttataaattacacaaggctaagatagacacccatgacccttgaattgttattccctgatatgttggaggacgggcagtgaaggaagagcctgaaggtcgtgaaggtaatggttgtttgctaggcttcttttctttaccacatttctttatgccaagacgttgattttaagtatcctctaaggactgagatggagttcattttataacgttgttgttactggatgatgtatctataccatagatcaaatcccttaaccataattactattataaggaaaagttcccagtacatctgattggagggggattactcaggataatgatgctgtttttatcacatcacaacagtatcttctgtaggcagttcaatctattagacctatttgaatcaaatgttttagaactggaaaaagtggctgggtgctcacgcctataatcgcagcactttgggaggccgaggcgggtggatcacttgaggccaggagttcgagaccagcctggccaacatagtgaaccccgtctctactaaa

SEQ ID NO: 79396 - DNA, 1012 bp, Homo sapiens
tataactgagacataggccagcacaggagtgaaagagagtattcatccagcttgttctcgtttggagaatggtgaaaattctcagtgctgattattagttcccatcatatttttacatagcatgcatattctgtctcaaagatagataaggcatagaaccttgtcatgaatttatcacttgaagaaatactgtgtcccagtcttcagtattttttactacctgtcattttgttttgttttgctggggactcctcctctctattgctggtatcatgctccgcccttacctagactaagaattttttttccctgtgttatttcacggatggaccagagccatggctgcaccttatatcctatacagagatgtgcattctgattctgtttgagctgctgactcacccggtatgggctcctccctgccttgcaccgcactccttttcttcctgctgggccttggggtacagccatttatgctttttggttgttttctcttttcctatcctgagaatggaatgcccttttgttctttcccaagaattccacatgcccctccctgcttttttaaaggtaaatttaacccagttgccttaaactaaggacttcccatatgctgtccaagttatttattcacagttatgttagctttccagaaaacctcctctttctcacctttctgagtatgtgatttctttggaggaaagacagacctgatcccttagtaaaccagaaagatcatgattataaacctgcctacatcaagaggattacataaccaccactgggcaattggtttccgctaagtccaaaggtaaaaactggctcttatttttgtaatcatattgtatgaaccctaaatgtcccttgtagacctctgaaaagtggtcttcccaggcactgaagctgatatttgaaatgggctatttacattagtcatgcagatgctggcatctccttttcagaccggtcatgcaatatcatttgaatgattcactgttaactcccttggggt

SEQ ID NO: 79397 - DNA, 1050 bp, Homo sapiens
caacctccgcctctcaggttcaagcgcttctcttgccttagccacctgagtatctaggatttgacaggtgcacgccaccttgtccagctaatttttttttttttttttttagtagagatggggttttgcgatgttggccaggctggtctcgaactcctgacctcaggtgatctgcccacctcagcctcccaaagtgctgggattacaggcatgagccactgtgcctggccaactgtttttgaatgcttactgtgggccatgttgtgtgcacagctcttggacgtgaagtactcttattagccctgacaacagttctatgaaatagatattattatttttaatttgcatgtgagaaagctgacattttaaaataattgggtaacctcaatattttacacaaagtcagtggtaaggattttaacccgtgttatatagtgtatcacttagcagtcgaccgtgttttctagttaatatgtatacatctacatcattcagacatgtgtataacattcctttctacgatgttttgtaatttgaccatcccccttctcatttttaagtttttattgtagaaatgttcaaacacacatagaagaagagagaataatatattcattacccagtttccgctgtttttaacatttgccagccttgttttattcatcttctgtctcccttcctaacccttctacttttttttcttgacgtattttaaagcaaaccctgttcatttgtattacatacctataaatatttccatatgtgtgtctcacaaataaaggcttttcttttaatgtaatcatgatgccatcatcaaacttaaaaattaacggtattttcttcatatcatgtaatacccagtctgtgtccagatttcctctgttctctccaaaatgtcgtttcatgattggctcaaaaaaggttacacactgcatttggttgtttgtctttttagtctcccttaatttcttaacagttctcctccccaacctctttccttttttttttttttttctgtgccatttattttttaagaaactgggtttattt

SEQ ID NO: 79398 - DNA, 1050 bp, Homo sapiens
tgtaatcccagcactttgggaggccgaggagggtggatcacctgaggtcaggagttcgggaccagcctgaccaacatgatgaaaccccatctctcctaaaaatacaaaattagctggacctggtggtgcatgcctgtaatctcagctacttgggaggctgaggcaggagggttgcttaaacctgggagatagaggttgcagtgagctgagattgcgccgttgcactccaacctgggcaacaagagcaaaactctgtctcaaaatacataaataaataaaaggaataatgaaaggtgagaataatgagaattttttttaacctaaatgctagagaaatggtgatatgtgctctgctctgagtcagtagtttatgcaaatgctccatcgtagataagtcagataattatggaggaagctgcattatttgtattcatttgtagactaattcttaggtgtttgtataatttctgaatacattttaaagcaaaaaaaaccatatatttgattaatggaaactaaatataatgaaaattgaaatgtaatgatgttttatgttattgtctttcaagaatatcccaattccaaccctaaaagattttgcaaaggctttggaaaccaacacacatgtgaaatgtttcagtcttgcagccacccggagcaatgaccctgttgctactgtaagtaagcgacttgagaatatcaaaattatgacatgcccagggtgtgttacagtggtgatttttatgaacaagatttaccccttttttatagttaatgttttagctcactattaggcagtatattacttaccagctttttgtgtttattttttcctgtatttccttcctatgaattttttccccctcccagcttccccctccttcctatgaattttttaaaacataaatggaatcatgtagtatatgctgttctgcaacttgatttttcactctgcagtttatctttaaagttttgttgtatcaatacatagggatctaccacattattttaacatcttcagaggattccatttatggatccttagtggtg

SEQ ID NO: 79399 - DNA, 1035 bp, Homo sapiens
ctgagtagctggggctacaggcgcccgccacctcgcccggctaattttttttgtatttttagtagagacagggtttcaccgtgttagccaggatggtctcgatctcctgacctgatgatccacccgcctcggcctcccaaagtgctgggattacaagcgtgagccaccgcgcccggccaatttttgtatttttagtagaaatggggtttcaccatgttggccaggatggtctcaatctcttgacctcacgatccacccgcctcggcctcccaaagtgctgggattacaggcgtgagccaccgcacctgggccctcacccaggttttatagtctggtatgtaggtgtttgctcgtcttcctaaaaggactgttgtggaactgtcttctcactgcatacatctaggtcagtaatctctcattctcctatggttcctatttaattgcttgaggcttgtggcttctgtttgaaatagactttccagccaaggctgaattaaagaatatggtacttagaattttatttctacatgtttccaaaagttgactcttttaaattaggatgtttgccattgaagtatttttaaagatgcatcttagacaagaagtaaaacaagacttctcaaaaggagtgacatttcaacgtgttgccattctcttaagcttcagccatatttgagttcccattctgtaaaagtttctggagcaggaaaaaatagcacttcatttctttaatccagatcacgtggaaaatattagctcaaactctttctgtcctttttatgactgtggtttcccagaagagatgttagctgcttgcttttgaaaatagaaaattggtgtgttttggtgtattgttgattccaaatgtagtttgcaaagtcatgctaattgttttagtattgcttcactagttagcttctattttttccttcaggcgtttaatttggcttcttagagtagcgttttaagagaacttcataaagaagttctagctggacttcataaataattggaaagctttaaaaacacatagat

SEQ ID NO: 79400 - DNA, 1071 bp, Homo sapiens
gggatgttgctggtatcagaattgttattgcttcatttagacataaaacacttaagtgttttcttcactccgtgacctggagagttttccattttttaaaatacatgaacttggcaagggtgtgatttttctttatcaagagaacaaaatgccagaatgttaaaacagttaactcaaaatctagtcatctgtgtaggagctaaagcaggtctccagggagagagggtggtcgtctgtgcattccaggttactgcacttgtctgatgtgacgtagcaacacccaggtcttcttaaaacaaagtcatcagctttgccaggttacatactttatttaaaagtatagtgaggtcgaagttcattccagtgtttcattttaataatgtgggcattattaaatttttgtggaagctaatagtaaaaaataaaagctgttttcaccacctccctccccaccccccaaaaaaggcgtacagccaactcttagttatttagggtaagagaaaaaagaaaactgttaaacaatgaaatcaaagataataaatatgatagatttccagtatgaggcacttgcaaaacagtcatttaaactgatggttactgtaagtcagttggaagctggcatgtatgtaaattacttggtgttacaccatatccgaagaagttcctatgtgcagtgcagaattgcataaacagtatttaatcactgctacaaatcttccaaccaagaaggaaaactgctattcttcataaatctaatttttagtatatgcttcctttcatcttatacttttatcaatatttataaaagtcatttctataataaaagcagtctttcttgctcaaagtattaaggtgaacaattgaatagagtactgtggtcgggagactgatttgagactgcagagctgatgctgggtagagggtctggacttgtattcatgttctgtctcagggcagcccctggagcaggagatggcagaggcatttacagctgcagaaaacagggaggaatggaatctgaggtagccctggcctcaaaattcaggcctggctgtatcatttacagagatt

SEQ ID NO: 79401 - DNA, 1021 bp, Homo sapiens
aaacacatgaaggcacattgtggggatgattaaatataatattaatcatattccttactaaatatggctaacatgatgttaaaaacacaatttttagaccttttgatcctcagttttatgaagatgaatttgaagatgagaaagtgcttgacgaggaagacagaatcaggttaaaattaaaggtaccatcctacactttattccttttttacgtttttccttttataaagtaaagcagggatgacaacttgagacttgagcttgcgaaatcctcttatgattcttgttcaatagctctttagacctaggaattaaacaccttttcggaatatttttacgggaggaggtatgtgcccttttttatccctgtagaattgtcactttcttcttttggttgcagttatgctttttttgacataagtaaagataaaaatttttgaaaattgttagctacttccttcaggataaataataataaggtatatggaattgcctccacattttacagtgggtggatcctggcaatttcccacaacagaaatatctcctttcttcatggatattcaaactatgcacaaaagagaccttgtcattaggtggttccctcttgaaggcctgggacggcaaagtactaccaactgctttcacaggcgtgttgttcttccttaagggggtttcctttaaaacaatttttttttttaaatttaaaacttttgtgtgtttttttttgtttttgtttttgtttttgagatgggcctcgctgttttgcccagaacggtctcaaactcctgggctcaagtgatcttcccacctcagcctcctgagtagctgggactacaagtgcacaccaccacacctggctacaggatttcctaagagtttctaccaggggccccagtggtatcattgggcaggggaaattgttgttgttgttgttacttttgtgacttggagttcaccatatgggtagaataaatttagactcaaaaacagggcaaagcaccgatctcatgttttaatt

SEQ ID NO: 79402 - DNA, 1153 bp, Homo sapiens
tgggtgacaagagtgagactctgtcttaaaaaacaaaaaatacaaagggacgggaatttgattcctcttgatgggaagaatggcaaaggatttgcaggtacgtttgaaatccaccacacacatatttgccttctctgtggagctcttctgcatacactaatcttgtccttactgacagcctctacttttactcttctttcttcctggtgctattagtccaaactgggagtggtagttgtgggaggcttatcctgaagcctggttatagagaaagaaaagtgacatcaagagaagggaggcctaagtcatcatcatgtcactttcctaactcagaaatcttcagtgccagctatttcctggctaatcaaatggaaactcctctacctggtttttaagagccttcattctgactccagtctctccaaggcaacacagttttgtgtgtttgtgttaaacattttaccagtagacacctgtgtcagttgttaagctcttgtctcgtctccaaacctactcttctgtacctggcatggtggtgctggggccaggagtccacaaaccagatttgagcttcaccagctgccccctattagggggcgccaaaggaagactggaagcctggagaactaagaagggattgctccttcctgtttgcttatggaactttctggggggcttcctgttgacttgccattttctgtgagaggacccaccaacacttcttcacctcagcagaggcagagcctttctgcagctgcagagtccagtttgcagttttgccagcacttggagacccggcttcattttctcccctgagagacatccggaccagctgggcagcagcttttcctcaggtatgagttaagctccagggggccctttatgtaagtgtttaagtttttataatcccccctcgtccctatgttccctcagccccacaggtggaagctgttctttgcatatgctatctctgtgaactcttagagttcctctttttatactttcaataacctagtccacaactttaaaccgaattgaactttaaaatattctatctgtacagataactggtgtgttttctgtttcctgactagaacctgactaggtggtcaaggaaacgaatcctcaaagatggagtttaggagttggtgtg

SEQ ID NO: 79403 - DNA, 1224 bp, Homo sapiens
gattttaaacagaggaaacttgtttatagatgccctttaatgtcatcaaatattttcttaaaaacctttatgatgtttttaatgcattgaaacaaattgttccaaaaaaaccaaatcaacagtctttaaaatactgaattttagataatgaaaagaagtgaaatgctgaggaggcagagaaaaaaaatttgagaaattacctgatcatggtaaaaatatcctgacaggaccagtggttagacaggcagaacttcctcgggagagccccgccccttctgtggcaaatcctgtctccagtttcctgcacatcctactctgtgttcaaaggtttccctgtgagagattagttcacagttgctgacacctcacaatctccctcacaacctgcaggaaccgttactttgagttgtcagagggtcattcagctcatagctacttttcataaaccatcctaaaaatgttctttattgacttgtagatttgtaaaaattgtatctgtttaggaaggtgaaccttccggaaagagaaaagcagaagatgatgataaagcaaataaaaagcataagaagtatgtgatcagcgatgaagaggaagaagatgatgattgaagtatgaaatatgaaaacattttatatattttattgtacagttataaatatgtaaacatgagttattttgattgaaatgaatcgatttgcttttgtgtaattttaattgtaataaaacaatttaaaagcaagtctctatgtttaagaaatctacttttccggccaggcgcggtggctcatgcctgtaatcccagcacttcgggaggccgaggcaggtggatcacaaggtcgtggtggcgggtgcctgtagtcgcagctactcgggaggctgaggcgggggaattggttgaacccaggaggcagaggttgcagttagccgagatcgcgccactgcactccagcctggcgacagagcaagactctgtctcaaaaaaaaaaaaaaatctacttttcccaaagcgaactgattttgttaatgctttaaacaaacaaagtcttaggtctcagtgaattcctgctgctctctcaacccccttcctctcattccccacaaagaagccttctgggccaggctgagattctctcacaattctggagacttggagtccaaaatcaaggtgtgggacggccatgctgcctctgaagattcttgacagggatccttccttgcctctca

SEQ ID NO: 79404 - DNA, 1110 bp, Homo sapiens
ctctctgtgccaataggcagagtttttggtctcatttttatggagtttttagctctgtgagagaacttgctttatacaggggtttcacttcaaaatttcttcctcggccgggcgtggtggctcacgcctgtaatcccagcactttgggaggcccaggcgggcggattatgaggtcaggagatcgagaccatcctggctaacacggtgaaaccctgtctctactaaaaaatatgaaaaaattagccgggcttggaggtgggcgcctgtaatcccagctactgagaaggcggaggcaggagaatggcgtgaacccgggaggcggagcttgcagtgagccaagactgcgccactgcactccagcctggacgacagagcaagactccgtctcaaaaaaaaaaaaaaaaaaaaatttctgcctcacatggactcaagttttatcgcctgacccttgtaattcttactgtcttaacacatctcggggttagtgtacatttagtatctgccatctgctcaaatgctctaagctttctctatgattatgattctaggagctcagaaattcacttaagcatatttttttccctgcttttaatttatccaacctctctaggtgattaaagagggtttcagtgttgttcattctcctgccacacatacatctgtcacctctgtatgcttattctgtgattatgtgcctcttgaggaaaaacaagatgcatagagtcatttaaactataattttctaaagtacttgtgttgtgaaacaggtagaaaatactataagatggaggatacgccgagatgaagaaggaaatgaaattaaagaaagcaatgctcggatagtcaagtggtcagatggaaggtgagcacaaaacgcctgaagggtattgacatacccagaacgggtcagagggatcaagttttgaaatactttttagttttaaatttattattagttttagaaatggggtctcactctgttgcccatgttggagtgtaatgacatgataacagctcagtggagcctcagactcctagtcctaagtgatcctcccatctcccaagtagctgggactacttggtgtgcaccaccctgcatggattattaaa

SEQ ID NO: 79405 - DNA, 1043 bp, Homo sapiens
aggtgagaagactggccaggagtttcagaccagcctgagcaacagagcaagaccttgtctctactaaaaataaaaaaaaattagccagcagagatggcgcatgcccatagtcacagctactccaggaggctgaggcgggaggattgcttgagcccaggagtttgaggctgcagtgagctgtgattgtgccattgcactccagcctgtgcagcacagcgagaccctgtctcccccccaaaaaaaaatttataaatatgtattttaccctaaaatttcagtgcatcagactacaaaatgttggtgtttaacataaactgttgtcttaaaaccttggtgtgtgataggaaataaccctggacccttattttcttgagtgatgtttaagactacgctgaccagtcttaaagcatggtgtagttaattctttaagaacaaggaaccagggaaccaggtacagcttatgtacctctctgaggtcccctgtcttcagaaatactattatgtgtccttcatcctgataggttaagacctagcaatgtgtcctattatagcatcattactatttgaatcactttatataatagaaagcattttttagaacggcttctcaattaataatggcctatttgtggtttttttttttttttttttgagatggagtcttgctctgtcgtcgcccaggctggaatgcagtggcgcaatctcagctcactgcaacccccgcctcccgggttcaagcaattctccagcctcagcctcccgagtagctggaattacaggcacatgccaccatgcccgggtaatttttgtatatttttagcagagatggggtttcactgtgttggccaggtaggtcttgaactcctgacctcaggtgatctgcctgcctcggcctcccaaagtgctgggattacaggtgtgagccctgcacccggcatatttgtgtatttatatgtggccaacctattgtatgagatggaagacaggaatagtgacagattgttttgttttcaatctgaaaatttcaaacatacaccaatgta

SEQ ID NO: 79406 - DNA, 1395 bp, Homo sapiens
acagggtttcgctatgtttgtcaggctggtctcgaactcctgacctcaggtgatctgcctgcctcggcttcccaaagtgctgggattacaggcgtgagccactgcacccggccttagaatgttaattctaacagtttttgccagtttcttcattgcttttatgttgggatggactttgggactgccttactctgcctttttttgcttatgttatcctatgtttatatgaccccatagattctgattctggatctgactcagattctgatcaagagaatgctgcctctggcagtaatgcctctggaagtgaaagtgatcaggatgaaagaggtgattcaggacaaccaagtaataaggaactgtttggagatgacagtgaggacgagggagcttcacatcatagtggtagtgataatcactctgaaagatcagacaatagatcagaagcttctgagcgttctgaccatgaggacaatgacccctcagatgtagatcagcacagtggatcagaagcccctaatgatgatgaagacgaaggtcatagatcggatggagggagccatcattcagaagcagaaggttctgaaaaagcacattcagatgatgaaaaatggggcagagaagataaaagtgaccagtcagatgatgaaaagatacaaaattctgatgatgaggagagggcacaaggatctgatgaagataagctgcagaattctgacgatgatgagaaaatgcagaacacagatgatgaggagaggcctcagctttccgatgatgagagacaacagctatctgaggaggaaaaggctaattctgatgatgaacggccggtagcttctgataatgatgatgagaaacagaattctgatgatgaagaacaaccacagctgtctgatgaagagaaaatgcaaaattctgatgatgaaaggccacaggcctcagatgaagaacacaggcattcagatgatgaagaggaacaggatcataaatcaggtaatacatttatgagaaccagaatggctcagaaagaagcattcagatacagcagggacccatttagtctttattcccatctttattaccctgttttttctcttctgtcccctccctttcaaacttttctaactctagaatacattttgcttcttttaaatctttctaatccacttattctttcttactcctttcccttccatttgttaatggataggtctgggggaaaacaatttaaagaggacttaaaattgagtcttagagggagggatatggtgtaagaagagctgataatgagttaagttgattccatttctgtggataactgaagagcatgcctcatgtgagagaatagattagcctggggaaaaaaaccataccattgaagtgtccccacagagc

SEQ ID NO: 79407 - DNA, 1045 bp, Homo sapiens
ggtgtaggctgggtgcggtggctcatacctgtaatcccagcactttgggaagctgaggcgggtagatcacatgaggttaggagtttgagaccagcctgaccaacatggtgaaaccccatctctactaaaaatacaaaaattagccgggcctggtggtgcatgcctgtaatcccagctactcaggaggctgaggcaggagaattgcttgaacccgggaggcggaggttgcagtgagccgagatcacaccattgcactccagcctgggcaacaagagtgaaactccatctcaacaaaacaaaaaaagtttcaattctcagcattttttcaaactgcagattatgatccattagtgagtagtgaaatcattttagtggattacaatttgcattttgtcttaatagagcaaaaaactaaataagagagcattgcccagaagaaagggcaaacattgttttctgcaacttttgtcttggttatgtaacatatttcaacagatctaaaaatgtcattcattatgaaacatgccattattttatgtactattaagaaagtgaaaactctatcaaaatacctcattgctacatccttttttttttttttttagaaaatctcactttgttgcccaggctggagtgcagtggtgggatcatggctcactgtagcctcaatctctcgggctcaagcaatcttcttgcctcagatccctgagtagctaggactacaggcatgcaccaccacacctggctaattattttttgtaaagatgaggtctcactatgttgcccaggctggtctccaactcctaagctcaagtgatcctcctgcctcaggcctcccaaagtgctgggattacagggatgagccaccgcacctgggctaaatcctgatttcaggcattaaaatggaggaaatacttaaaattgatgacatatatagtttatatgaatgtgtctattgggtcataatgtaaaatgtatttatatttattgctaattattgttgtgagctatgctattgctaaaagtttgaaagtcactgccatag

SEQ ID NO: 79408 - DNA, 1898 bp, Homo sapiens
tgctcgggctgtcgccttccagccaatccatcttaaggtccacccttcctggagactgaggcctcttcctctcggattgcccagtgccttgcacgtagtaggtgcttagtaaacgctggcactgggtttggtcactttgttcccttaatgccagggcaggtagtagagcaaacggccccagctgtcttcctccctgcccgcccgcaggcaaagcccccaggagacgccggacgagccgcgtgcctttcccaccgcctccgcggcgcgcgcagcccagtcacgggcgctggaaattccggcgcgtgcgggtgcgctgggcagggcgggggcgggagaacccgtggagtgagcctgtgacgtgagggggcgtggcaccgcgaagccccgccccctcttcctcgccctctctcgcgggtcggggttacatggcggcgactgcggcaaagcgagagcctcggagacgccgctgccgccagcacagccggagacctgagccgacactgggggcagtccgcgagccccgcactctctcgatgagtcggagaagtcccgtgagtgtgtgtgtgtacgtgtgcggggtgcgccggcggggcggctcgggagggcgccgcggcgggcccggcggcggcggcggcggcggcgacggcggagccggctccctcctccattgtgtgtgaccctccggcggctgccgctcaacaaaggcgtttttgttcggtctgccgcccgccccctgctcgcccgcctgcccgcccgctcgggcctggccggcgcgtccccgcgcgggcgggcgggcggcgggctggggtccccgcgtggggccggccaggcggccagcgcgcccctcccacccggcacgcccctcgccggtcgccctgccaggccgcgcccgctccctggccccgcacgcctgctgccgtcccgccgcctgcgcctggctccgcgggttcgaaacccagccggaccggaccggagggcgggcgagcgaggggcggcggcccggggaacatgaggtggcgtggagtctcgccttactggcacgctgcctttcgaaatgctcccgcgtctcctcccccatcccacccggtgactcggcctcagctgactccggccgggcaaagtctccagtggcgtagcgcgcagcgctcacccggctcgtctcagagccctgaagtccgcccaagttttgagtcttgccatgaatgaggtactgaaaactcggagacgaaattcctaatttcctccctcggccctacagtctttccttagcttctttcgggaccttaagtggtggtctgtaaaagtgcccaaatgaaagcttgttttgtcggttcaccaaaaagggccttgtcactttgctgtgcattttagtccgccttgtgagttgtgtcgaaaagtaaaggtgttttggcatccttttgtttcttggcgagtgtaggacccaaccggtttaggtgttagggggatctctgtgcagcgggagcttcttgattcctttcctgttttattttttcttttgcttgttcattggaaaaggtccagtgaaagggactggtgagttggaattagaagcctacttgtattaacggcagaattcgtgttcattgctaaagatgcagtctcagtaatgacttttttttttttaacggatacagatgatttgtcaaggggaaaaattaacacgccatacaatgaagagcaagcagcttcagagtaattttctgatggctgattcttctagcctgtctcttacagttccaattgcacatgtcctccctctttaacgctggaaaactgagatggaaagaatgatctgaccagaagaatgtagggtccaaacagggcctggccctgaaatcaggaatttcttcatagaaatatcagattttaatgtttaa

SEQ ID NO: 79409 - DNA, 1114 bp, Homo sapiens
attagaagtagtcgttggctactttctgttattaaaaaatccagagaagagtgatttgaagtcagttaattttgtaataaaaaaatgcacacattctaaagactaatgttagcactaaaagtgttgcagtgctttacataaattcatttaaagcatcgtgagaatcataactgacaaaatagtaaggtttgctgactcagggtactttgctgaaggggatgggggtcgggtaggaggaagcttacaagtgctgctgcaagttttgagttggatgatgactcatgctgcccacggactgctacgtggctttttttttttttttttttaaatacactgtatttttttctaaatgataggctaaaatgttcctgtccacattgaaattctctctcattttttctgaagaggaacagcagtttctctaaaaaagtaatggcttcttaaattgcattttaaaaggatatcatataccctacaggtggaattgtgtaacatttgctgagaggaaaggtaaaaccaatttctggtcaggtgctgaaattaaatgtttgatactagcagttttttggctactgctgagagagatttgttacaggttgtttataaaggacagatagtacttttatggtgtcggtagaaattgaccttatgtttttattggttatgtgaaagttatctttatatttaatatttaatcagatatggctctgaatatgaaagtttcactcagaattattaaaacataattatatattgtgctttgtgatttatgtgaattttctgttttaataaagacaatttgaaataggtattagtcactatttttcatggtttttttttaaagataagctgaatgtacagttctaagttgaaacttggtaataagataaatcttttgactgattttaaaacagccaacgtttagcaaggtggcttaaaataagattgagagggggaaaaagattgagaatggcagtttaagagtggggctgggtgcgttggctcacacctgtaatcccggcactttgggagcctgaggtggaaggatcgcttgaggccaggagttcaagaccagtctgggcaacataacgagaccctgtctcaatttttaaaa

SEQ ID NO: 79410 - DNA, 1016 bp, Homo sapiens
gtatactgtttatttttccaaagggatttgaggagtttgtggacagtaaagtgtttgttgtttttgtgagacagggtcttgctctgtcaccctggctggagtgtagtggtgcgatcactgttcactgcaacctctacttcccgggctcaggtgatcttcctgcctcagcctccggaggagctgggactacagctgtgtgcgaccatgcctggctagtttttcgtattttttgtagagatgaatgttcacagtgttgcccaggctgttcttgaactcctgggctcaagcaatctgcctgcctcagccttccagagtgttgggattacaggtgtgagcccctgctcccagcccataaaatgtattgttaatgtgaattaaatttttggaactattttggaagagtattgcatgatttatacctagaggttttttttttacaaagtttaattcaaacttaaaaaaaatttcctactagaggaaacataaaaatacaaatataaaagtattgaaaattttcagagcatcacattacttagaggtttaacgtattttcggcattgttttcaaatataggtaattagctgtagtgcataattcagagtttaaaaacaaactgaggccgggggcagtggctaacgcttgtaatcccagcactttgggaggctgaggaggcagatcacgaggtcaggaaatcgagaccatcctggccaacatggtgaaaccccgtctctaataaaatacaaaaattagctgggtgtggtggcacgtgcctgtaatcccagctactcaggaggctgaggcaggagaatcgcttgaacccgggaggcagaggttgcagtgagccgagattgtgccagtgcactccagcctgggtgacagagcgagactccgtctcaaaaaaaaaaaaaaaaaaaaaaccgaaaaacaaacaaaataactggatatcttagcctgcttcctgtctccaaggtactgctttatgaaatgctgagccttcttaccactgctatccagtt

SEQ ID NO: 79411 - DNA, 1007 bp, Homo sapiens
gttggcagacctgtgcattcgcatagagtgagggtcctggtggaatgcctggaaaggaaaataccatatctgggaatcttcactgatgttttctagtggtagatcagaatgtgatcagattctgaaaaattcgaggataggacttcccttctccaaagctttctactcacgtagaatatgctatttacattgattcattcagtacatattttagggtacctactaattaccaggtactatgcttaggaaatgtccccaaagctacttagtcccaaaccttttatcatagacaaagccacagaaaaaaggaggggaatggtgccctggaaaatgaagagtagaggttctgaagaatcacattagattaggttgggggaggatggcaaaagaaaagggagtgaaaatgttattagaaagaggagaaagaaaagtgaaatgttagatagggaggaatccactacatgcccctgtgctccaggagtaataatgtgttcctttgagctcaagattgaaaaaaaaaaaaaaattgacctctgctatagcttaatgcctaaaacaatgcctggcacatggtaagcattcagtaaaatgttgaatgaaacgtaatggatggatgggagggttgaatctgtttagtctgtttaaaagatgttttaaaaacatcttggttcattctgcttctgggcccatgttgggattgcatttacccactcccttgggtatacgtatgaccatgtgacctactttagtcagtaaaatgtgagaagtgaatggtgtcacttttggatggaagcttttttgccagtgagatagtcttacttttctctgctacattgcatgtaattggtagagatggtgggtactttagcagcttggctgacagctacgttgaacttgtggcatgagcaagacttagatttttgggggccatctattatcctgactgctttgaaaatttatattttcatctagttagaatcctcaggtgtccaaaggtgcttgaagaa

SEQ ID NO: 79412 - DNA, 1035 bp, Homo sapiens
tgccagttttcttccttgtttacacaagttcaatttgaaaggaaaaggcaatagtaagggtttcaaaatggcagagaaatttgaaagtctcatgaacattcatggttttgatctgggttctaggtatatggacttaaaaccattgggttgtggaggcaatggcttggttttttctgctgtagacaatgactgtgacaaaagagtagccatcaagaaaattgtccttactgatccccagagtgtcaaacatgctctacgtgaaatcaaaattattagaagacttgaccatgataacattgtgaaagtgtttgagattcttggtcccagtggaagccaattaacagacgatgtgggctctcttacggaactgaacagtgtttacattgttcaggagtacatggagacagacttggctaatgtgctggagcagggccctttactggaagagcatgccaggcttttcatgtatcagctgctacgggggctcaagtatattcactctgcaaatgtactgcacagagatctcaaaccagctaatcttttcattaatacggaagacttggtgctgaagataggtgactttggtcttgcacggatcatggatcctcattattcccataaggtatgtatagaaagccagctgagacagatctttaaactgatacacctaatcaggaataggtacttatattttctttgtatattgtggcagaatttttaatcttattaaactttacatagtgccttttttctgaaacaagtctctctgtttgaaatgaaggtggagtgggataattaaatacaaatttctaaaaatacatggttattataatgaaattttaaagtgtatggttatttattataaatgaaattctcccttagttatttaaaagtggaatatactcttctttctttgggacagaattgtggtaagaggggatgctatttcaactttaggtcttttgtttttgagacagagtctcactctgtcacaaagggtagagtgctgtggcgccatctcggctcactgcaacc

SEQ ID NO: 79413 - DNA, 1051 bp, Homo sapiens
acagttaagaccagaatccagatctcttgaatctcagttgctttttttttcactagtttgtgataaccttaatatgagaccaaacttaaagagtcagttccctatggaaacaaagcagcaaaaactaaatacatcagtaagcagaaattgaaatagataagtagattggtgatagtcaaagcaatgaaacctgctgatgatacaattcaaacttttccccccactggtcattataatatttaaattagtttagtatgtttattgtgaaataagtaaacattgaggaatgtgtttttttgtttgttttttaacctcaggtgcacatgaacttgaacagatgcagctgattttagaatctattcctgttgtacatgaggaagatcgtcaggagcttctcagcgtaattccagtttacattagaaatgacatgactgagccacacaaacctttaactcagctgcttccaggaattagtcgagaaggtattgtgactcgagagtaaccctcacgttaatgcctgtgtgtgaggcagaatctgtgtagggaagctggagctttttatccttagatatggggctttctccaaaatagtctttagacacttaaggtgtacgtaaaacttcaactctcattttccctttttttgtcctgttacttgggctacgatctgtttttttggttcctctgaatcactttccagagcaagtagcaagtattttgaatataggcactggggacaaaatcatgatggcattttttccctcagatatacttggaactcctgtaaatgcctggataaaaagaaagctgctgtatttaatttcagccggttttgcaggcttttcagtagttccacattcttaatcagtctttgagtctgtctgcacaaattccattgctagctcccttgctcgtaaccctgtagccactgtcacaacatccctgttcatatctaaatgagtcctctgtgggaacactttatttttattttttattgaaaaatagagacagagtcttccctgggctggtcttgaactcctgagctcaagca

SEQ ID NO: 79414 - DNA, 1047 bp, Homo sapiens
tcatcaagttttagtagcctatccagcactacagtgctagtaattgagttaagccagtgacttgcagagctaggattaaaacctatatattaggccgggattacaggcgtgagccaccacactcagccagaaaatcgtttttaagttgtaaatcaggtaagttttatttctgacaaattaactttttaattgtgtagtccatttttcccttttataagatggggacctattagtacaattaagatgctcatttcctgttgtgtagtatgtagtgctaaggtaatcacttagctagtcattgaaataaatgagatcaacatttactgtttttctaaaggtaagcaattcttttctgaaaaacttttaccttttcctctgcagcactggatttcctggaacaaattttgacatttagccccatggatcggttaacagcagaagaagcactctcccatccttacatgagcatatattcttttccaatggatgagccaatttcaagccatccttttcatattgaagatgaagttgatgatattttgcttatggatgaaactcacagtcacatttataactgggaaaggtaaattgatcctaaattagaaaaataatatttactgaactttcagtggaccatatgtagtgagtttttttaaaattatgtataagacattgtagaagtcttaaaaatttagtaatgtaaagatacaaaaattagtcaggtgtggtggcaggcgcctgtagtcctagctacttggaggctgaggcaggaaaatcacttgaacccaagtggccgaggctgccgagattatgccactgcattccagtctgggcaatagagcaagactccatctcaaagaaaaatttagtaatggtccttaatatttatatctataaatagccgttaattaaaacatttaataaagtaattactggttagatgatatatgggaaaagttaaatgctactttgaaacattttcaaagtcattaaggcatatttataaagtcctttaactgtgattttatgaatgtcaaaaatttaaga

SEQ ID NO: 79415 - DNA, 1284 bp, Homo sapiens
ttttccctcaatgattatacatgtcagtaataggatagcgcattcagcagcacgtatacacagggagatttttgctattcatggtgatgagttttccagcaaacctcctcctcttctagttgcccttactgtagagtaaacatttagcaaacctcctcctcttctagttgcccttactgtagagtaaacatttgtaaggtacctgattgagatttgagatctgcattttgtggctatgaagtcttttgtttgcatggaactggtggacaaaaaacaaattggaaatgaagttacatactgcattggcaattaccaaatatattaacagagctttcctatcaagactaagttctggtagggcaaggcaggcatatttactctcctataattatcccctcatagacctagcacagtgctgtcacatagaaggtactcggtgaatttgaaaatgaaatcatatacgtagaataacgctagtgtattgatttttttcaggtatcatgattgtcagttttcagagcatgattggcctgtacataacaactttgatattgatgaagttcagcttgatccaagagctctgtccgatgtcactgatgaagaagaagtacaagttgatccccgaaaatatttggatggagatcgggaaaagtatctggaggatcctgcttttgataccaattactctactgagccttgttggcaatactcagatcatcatgaaaacaaatattgtgatctggagtgtagccatacttgtaactacaaaacgaggtcatcatcatatttagataacttagtttggagagagagtgaagttaaccattactatgaacccaagcttattatagatctttccaattggaaagaacaaagcaaagaaaaatctgataagaaaggcaaatcaaaatgtgaaaggaatggattggttaaagcccagatagcgctagaggaagcatcacagcaactggctggaaaagaaagggaaaagaatcagggatttgattttgattcctttattgcaggaactattcagcttagttcccagcatgagcctactgatgttgttgataaattaaatgacttgaatagctcagtgtcccaactagaattgaaaagtttgatatcaaagtcagtaagccaagaaaaacaggaaaaaggaatggcaaatctggctcaattagaagccttgtaccagtcttcttgggacagccagtttgtgagtggtggggaggactgttttttcataaatcagttttgtgaggtaaggaaggatgaacaagt

SEQ ID NO: 79416 - DNA, 2027 bp, Homo sapiens
gagaaggaaaacacttacactagttacttggacaagttctttagcaggaaagaagatactgaaatgctagaaactgagccagtagaggatgggaagcttggggagagaggacatgaggaaggatttctgaacaacagtggggagttcctctttaacaagcagctcgagtccataggcatcccacagtttcacagtccagttgggtcaccacttaagtcaatacaggccacattaacaccttctgctatgaaatcttcccctcaaattcctcatcaaacatacagcagcattctgaaacatctgaactaaaacactcagcagacatttatctttgtattcttcatgaaatgtgttttgtctttttttattactagtgtttaagtcattttttacttgaatcagatggtgtcatttagtaaggattttatgagttcttgttttttaaaatccagactttctttttctacatgtgagatagttttcattttaactggcatgtcatttgcacacaaaaataaagactagagcaaaataatgcaacgcaggaggagaaaagaaatgcactaagacaagaacattctctcatagaacattgatctgttttacaggaaacaaaccttgccttgaaatttacacagtgagactgtacataattgcatgaaaatagctatttttttcctaagacatttttcattcatgaatattttcaagtttttcatactgtacacatttcttaaaacacatgataccagcagcaactgaaaatgaatgccgaatttggtacacatgtgttatctacctcaaggtaacaagagtatgtggcaaaacatataccacccatagtgcttcacaaaatgcacttctatttagccagcgtttattgtagtaaactattcttaataaaactcactcactgtttataaatgttctggtatgcattctttatagtgaagtgttaatacatcacatcttatttattttagcaaatcagtatattttctgtatttaattataaaaaattaacttagtttttaaaatttatttgcaaatatactttactttttccatttggcactatggtttgttgcctacctagctgcatctataatgtcagcttatcctaaggctgtccacgtacttaatttacttaagtgttcattttaagtaacgtgctcactgtgtataggaatttgtattttggaggtgcttgatctatctacaaagaaaaattaattaggaattactttattataaaatgctcctagaagtcttaattgtgtttattttttaaaaaaacaaatgttagacttgtgtgcatggaagtaattaaggtacatcattattgtagtttgaaagttgtacatgataagacattttgtttttactgtatgtttttactgaatgatctattccccatcccaaggcaagcatgaataaaattaggttaaacgtagcatgtggcatcgcagtctcttagaatttgtttcatctattttattttattgaatactgtctgtatctttggttatcctgtttgaagaaaaaggacaaataaaacatggccagcaaatacagctcctgtttcactcttgggttaatgaaaattttctgctagaatgaaaattactaccagaatcactttgaattatggccataaattgctagtctgaaaggctgagaaggttcaagtcttttgacttaaaccatcacatattagaatggaataaagctttataatatttcaaaactgttaggtaaaatgtgtagttgaaactttgaactgtgcagtcagaaaacttgagatttgctctgtaatacatctttgcgtaagaacttacccttttacctatccagctacaaaaccatcctcttcacctcacttttctttcatccttgttttgtacaacaccaattctattaatatctgcccacctaccttctcaacaactccatcctcttcacctcacttttctttcatccttgttttgtacaacaccaattctattaatatctgcccacctaccttc

SEQ ID NO: 79417 - DNA, 1113 bp, Homo sapiens
tattttaaaggcacaggtgtttcttctccaggtcttgcctggtgagtcctttccctttctccttgagaatcctgaggtttcaacatgggaggaggtgaaaccctcctacattgcaggtgggaacatttaataacgtggccacacttcactgcctgactgccgccatcatgggtcgcatgcatgctcctgggaagggcccgtcccggttggctttgccctatcgccacagcatccccacttggctgaagttgacatctgatgacgtgaaggagcagatttactaagtggccaagaagggcctgactccttcacaaattggtgtgatcctgagagactgacatagtgttgcacaagtacgttttgtgacaggcaataaaatcttaagaaatcttaagtctaagggacttgctcctgatctccctgaagatctctaccatttaattaagaaagcagttgctgttcaaaagcatcttgagaggaacagaaaggataagaatgctaaattccatctgattctgatagagagctggattcaccacttggctcgatattacaagaccaagcgagtcctccctcccaattggaaatatgaatcatctacagcctctgccctggtagcataaatttgtctatgtactcaagcaataaaatgattgcttaacaacaacaaaaaaacccaataacgtagccactgtgaaaaacaggttagtagtttctcaaaacattaaacagagttaccatgtgactcagcaattccactgctagatggaattaaaaacatgtccacacaaaagcctaaagttcatatcagcattattcataatagccaaaaagtgcaacaacccaaatgttcatcaactgatgaatggataaacaaagtttggtatgttcaaatagcggagtattactcagccataaaaaaagaatcaagtacagacatatgccacaatgtggacaaaccataaaaacactatgttaaatgaaaaaagtcagacacaaaaagccatgtgttgtctgattctattgatatgcaatgtccagaataggcaaatccatagagataaaaagtaggttaatggttgccagaaggtgagggaagggagaaattgggag

SEQ ID NO: 79418 - DNA, 1070 bp, Homo sapiens
acctcatacccattaggagtcactcccaatttctcccttccctcaccttctggcaaccattaacctactttttatctctatggatttgcctattctggacattgcatatcaatagaatcagacaacacatggctttttgtgtctgacttttttcatttaacatagtgtttttatggtttgtccacattgtggcatatgtctgtacttgattctttttttatggctgagtaatactccgctatttgaacataccaaactttgtttatccattcatcagttgatgaacatttgggttgttgcactttttggctattatgaataatgctgatatgaactttaggcttttgtgtggacatgtttttaattccatctagcagtggaattgctgagtcacatggtaactctgtttaatgttttgagaaactactaacctgtttttcacagtggctacgttattgggtttttttgttgttgttaagcaatcattttattgcttgagtacatagacaaatttatgctaccagggcagaggctgtagatgattcatatttccaattgggagggaggactcgcttggtcttgtaatatcgagccaagtggtgaatccagctctctatcagaatcagatggaatttagcattcttatcctttctgttcctctcaagatgcttttgaacagcaactgctttcttaattaaatggtagagatcttcagggagatcaggagcaagtcccttagacttaagatttcttaagattttattgcctgtcacaaaacgtacttgtgcaacactatgtcagtctctcaggatcacaccaatttgtgaaggagtcaggcccttcttggccacttagtaaatctgctccttcacgtcatcagatgtcaacttcagccaagtggggatgctgtggcgatagggcaaagccaaccgggacgggcccttcccaggagcatgcatgcgacccatgatggcggcagtcaggcagtgaagtgtggccacgttattaaatgttcccacctgcaatgtaggagggtttcacctcctcccatgttgaaacctcaggattct

SEQ ID NO: 79419 - DNA, 1053 bp, Homo sapiens
tctgtttgtgtcttcacaggtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttaaaatgtatctgtttttaaggttattctaaattatagtagcctcaactcattctgtcaccagtagaattcagcagttaatatattccatattatttctttgaatcaattcattttcagagcactttaaagtctgatatttctcgatgtgcactgtgatgcctggaaccttcctctggaagtgctgattttatggactgaggactggtgactggtctgtgatagaagcaaattccaattccaaatgtaattagacaaaaatcatttttttagaatgtgtttttattgtaaaagtatctttttcagcttcctgttctattgtcttttttcagatacaacatttttgtctatggtgaactgctgtaaatgacgcagagaaatgcctaaaaaggacaggtggtttgactcatggatgatgatgatgtcactgtgccacttggacagggcgttttctctgaattgaagggaaagccaatggtgtttgtaaacaaatgcttctgagagcaaagaaaagtcttctgtgtgggaacacaagatagtaaacttatttaaaaacctattagtagaattagtggaaacacttaggttaaagtgaatcttgtccatataaattatattcatggccgggcgcggtggctcacgcttgtaatcccagcactttgggaggccgaggcgggcggatcacgaggtcaggagttcgagaccacggtgaaaccctgtctctactaaaaaatacaaaaaattagccgggcgtggtggcgggcgcctgtagtcccag

SEQ ID NO: 79420 - DNA, 1042 bp, Homo sapiens
tgctcataaccactttcttatccctgagctctgggccaagtcttaggaattagatatgtgattgagggaaactatatttatagggggtctactctgtgttctgtgcctgatatcaacacatattatctcactctgcaaggccagtgtcactgtcccccactaacagggaagaaaactagagatcagtgggcctgacataggagcttcctcttccgtcttctgctgcaaatgttccttgagtccctagaaatagagattctgattccaagggcctagcatggttctgatgggcatccagggtcaggagtcacaaccgtagataaagtactttctctctgcaggtactaccccagtggagatgcctttgcttcagggtcagatgacgctacggtatgtttctaagtttttgagagcttttcctagtcaatagagggatctgctaacttattttaagaaaataactatttttctggttacagaagtaacgagtattcaataaagaaaatttaggggaatattaaattaccttgatctccttacccaagaaaaatcatagttggatgaattcctttctgtctttttttctttttaacaaacaaaatgctttataatttggcattttcacttaacagaatgtgaacattttcccaggctggtaaatatttctctccattatattttcttagtgattgagtagtattccatgttatgaacgtgacattcgtcttcaatttttggacatttggcttttctcaaggtttttttttttttctgttaaaaacactactataagtgtttttgtacctctcatcatttccttagcattctcagacataacttgctgagccataaatagacccagttttaaggcttttgatactgattgccaaattattttcaagagaaaaaaatattttcttgttgccttcaaaatatcaaatatcttatgaagtaatggttttcattctaattttctgctaaacaaattacaaaagaatagattgagagttttgaaataatgaaaatttaaaacttctgtata

SEQ ID NO: 79421 - DNA, 1091 bp, Homo sapiens
ttgcaagtggaagtgtttagaaggaaaatgtcatatctgcagtttgcagtcaaatggttcagaatttgctcctgtagatatgacaaaatgttaagtctgtgaatctaagggaagggatctgggtgttcagtatactattttttttttcagttttacagtaggtttgaaaatcttcaaactggccaggcacagtggcttacacctgtaatcctagcactttgggaggccaaaggaggattgcttgaggccacgagttcgaggccaagagttcaagaccaacctggccaacagagcaagaccctgtctctatttaaaaaaaaaaaaagaaagaaagaaaagaaaatcttcaaagtaaaagttggaggaaagggtacaatatatgatactgctaaagagaatatgttgaaaagttcatgtgattggaaaagtagacacatattctgtgactctgcattaatctttggtacttctttctttccatcctagtggtttggataataagtgttctgtgtaccccttgacgtttgacaaaaatgaaaacatggctgccaaaaagaagtctgttgctatgcacaccaactacctgtcggcctgcagcttcaccaactctgacatgcaggtaaataggcagcccccggtgtcaggttgacctgccaaggagcactaaagaggagctgagaggagaggaagctttcggcgtctctctgaacaagatggctgtgctccagtagtttgctctaagaggaagctcctattgtttctcattagttattattattttaataacatgagaaggttggggctagtgattgttggtagtgttgagataaaactgcatggcatattgaaaatcctcctctgattgacttggcgagggtgggagtggagcagggaaccccctggggtgcaggcagttactgtgccctggtctgcgtgctaacgtgtgtaaagcttcactgagctgtcgggcttcagagctgtgcactgcatgcatctcactttacagtcctgttttaaccaatgcaaaaagaaaatgcttcaccatattaaatctttgctctactttaaatacactacagtgaaaacaacac

SEQ ID NO: 79422 - DNA, 1097 bp, Homo sapiens
agaaaaagaaggcaaagaggcattgttttgttcgcccaccaaagactgctgcttaggattgctaccgttgattgaagtttaatcaatactaagcatttcatttattccttcagtaaatattactgggtactcactgtacgccatgctggagaatgtcatagccaacccttatgaagtgttccctttatgccaggcttgaatagttgtccccgcaaccccacaggggaagagaggtggcgagaaagtacatgatttgctcgaggttgtgcagctggtgtgcgacagagccaggctttgacccaagcccccaaatccagagcctggatttttaactgctttgctccagttttgcctctgaagaagatcaaacaagacagcactcctgtcttcctagagctagtggaatttcttaacaggttaccattatattctagcaaattcttattatagaaaccagctggttatattcaccattaaaaaaaaaaattaaatcctggaggaatggtcctccagaaggcaaaggggaaactacatgtgtcctgaaccaagttcacacaaataatacccagcacatattcagctcatttccaggtctttttttttttaacttcctaatgtttaatttttaaaatttgttttaattcagtggatgcaaaatttggcagatagaaacaggatggagtgggttggcagtgatctacatgtgggaagaaaaaatgtagtgagaaaaaataattaatagttgggatctattcaaattcacattatgtaaggagggccctattttggttgggtgaatcatcttttttattaaaagggaaattatcaaaaagctatggctatcctaatgctgaattgggggaagcagcaataatattgatgtaaaatttctaagtaaaatactaaatacaatatgctcacaactctgggccgatagagccttatataaaaggcctatatggctgggcgcggtggctcactcctgtaatcccagcactttgggaggtggaggtgggttgatcacgaggtcagatgatcgagaccatcctggccaacatggtgaaacctgtctttactaaaaatacaaaaattagctg

SEQ ID NO: 79423 - DNA, 1031 bp, Homo sapiens
gtttgaattcttgtgtattgagctgcacaccatatcttttgctttcagttcatgtatgcacagattataaaataaataacaaaagtattccctgaaagttgagagtaagccacatcgtgatgaaaagttaagtttttgccagaattatatttccaaggccctgtgagatactctctaataccctcattttacagagcagggtgcaggctccgaggagatatgcattcacctttaatttgttaactgtgctcttccctcaggccccattttccttttctgagaagcaagggggcttgatgtggctcactggccttcacgcttgctgtttggactccaggggtagatgtgatatttggaacttaggggtagacgtgccttcctgtctggccgtcaccctccctccactgttcaccagctcagctctgccttcatctgttttccgtattggacttctggtaagattttgtccatgagccaaagcagaggcagttgggggagacttctacaggtaaaatgggagcttgaagactaccggtccacatggttatccaactctaagtgccatccagttgggacccgtccatcatgttcagtctggcacgcagcacagggccagcctgcgaaaggtgctcagtccttgcttgttgagtcattcaggtctcttctggctgtaactttccatgattcttccagccaagtggctgccaagccaagacccaggcaggtttcttcactcctgatctaggctctctagctctgtgacccattgatctggctacctcgaagaggtatggctgggcacggtggctcacacctgtaatcccagccctttgggaggctgaggtgggtggaccacttgaggccaggacttcgagaccaacctgggcaacatggtggaaccccatctctactaaaaaaaatacgaaaattagccgggcgtggtagcgcgtgcctgtaatcccagctgcttgagaggctgaggcatgagaattgcttgaacctggaaggtggaggttgcagtgagccaagat

SEQ ID NO: 79424 - DNA, 1359 bp, Homo sapiens
ctcatttaacctcattacctccctaaaggccccatctccaaatacagccacactagggggttagggcttcaatgtatgatttttaggaagacacataaaatccataacacacactttaaaatatttcaactttgtaccctgtaaattataaggttatgaatctcatttattgtatccacttacctcttcatagcagtttgtttccttgaatgctctgcagttttgtttcattttcctatgcgcttccatgggccttctacgagcttttccatttagtctataggttccagggacaatgtttgtagggaagtgggtgggacaatgacagtgtgatagactgtgatcatacaggaaatcagtgcaatttttttcttatagaaggtacatgctaccccaagcatcatgaactcatttgatataaatcagacattaagttttaaggtaaaagagttatagtagctgattattaatttcctacatgtttgtattattctaatattttatgtttaaaattacttttaggaattcatgaagcataatagtccacagcagaataagaattgcttgaacaattttgacctttcagaatacagacagattctcagtgatgtggctatacgaatatatcatcaatttattatcataatggaaaagaatatccaaccgataataggtaagaagagaatggatgaccaaaaaatatttatagtaacattaagactttttaaaacataaacttggtatgtgtaatgtgtgattatgtgtaacattgtttaaaaagccaaggaaatataatcatgtagatatctgccttttaattctttgcttgcttataatgattccataaataatagtacgctgttggtagttttctttatataaggatgatttatcctgaaggaaaaaacttggggaaacttctactactgctatttatgtggtacttctacttcttggcgtagccaagtatttttgaaatcctaaagccccattcgaattcttgtatactttccttaatttcctgaaatttaaatactttaggctttaatgcccaggccatgatttgtcatgctaagcagctttctttcctgtgaagctgaaaaacgtgctgcttcaaacctacaagaggagctgcagccccgctggaaacagccgtccatccctaaccctgacacacaccctggtgtcccaaacccttgattcttttgctttctctatcataagtacatccactgactcttgtagaaaaatgtcccatctcctgaaacaaaccgaagagcgtcgggaacgttccgcgtgtgtctcctggcgtgtcagcacagcctccctgtctctccgcagttccgggaatgctggagt

SEQ ID NO: 79425 - DNA, 1050 bp, Homo sapiens
ttccctattcaaggcagcttcatgtgactgtggacactgtacgccatcctcatcaaagcgcttggagtaggggtgcatggaatggagtttctttcttacaatgggggtctgaaatccagggtttccacaccagggaaaaataaagattctgtctcttattcaaccttttaagaaagagaaagtcctttgtaaacaagaagaggaacaagtgacacctgtgtatcttgtgccaagaaaggagccagatggaattcctcaaagaggaaataaatccatatacattcaggcactgtgtcaagcacagaaaagcaaacaagcccctgcccctagtcacaagttccttaggagaagagctgacctgtcagctgtaatcctcattggctctctctgcttcagacttgaagccccgtggcgtggtggtgaacatgatccccgggctgccggctcatatcctgttcatgtgtgtgcgctacgcagactctctgaatgatgccaacatgctgaagtccctcatgaacagcaccattaatggcatcaagcaggtggttaaggtaggaaatgcctttgacattggcccctggtatcacatctatgggaatgaccagatgcccagtctttgcccatcctgagcctccattgtgtggtgagccacatgattcctcaaacaagtttgaggcccaactagtgaagggagccacactgttagggaaagataaatggatgagcatctgccataggcctcaaagccttaccggcgagactgcaacctggtagccactgccccaccactgctatccccttagggtgtaaagttatcagctgtgaggggtataggttctatctctgtaacaagggtaaatcatgagaaatgaaatggagtgaaaaattattcatctcttcccttggcaattatataattcttcttcctaaaagcacattgtgtatttttattcccagtccacaaatgaagatgaactgtgtattagttaggttagttacttagtaaagttaagctattgtagctatgagacacctgccacctccctttgc

SEQ ID NO: 79426 - DNA, 1035 bp, Homo sapiens
tttttaaaaaatgaaattgtgaacaatttttcaatttactgctttgaaattcaccttctctccctgttacatatgtaggatcagtaagtatccaaatttctattagaaaagtagagagctaagaagcagacatcctgaacatggactgcatggcacacataaagcatcctcgtgagcctctgtgaaagggaccctcctcccttcttccctccttctgcttctgtcactgaacttttctgtgttcagctcctgctcacatttctcactctttcattctttattaccttttccccttcctcccagccttactgccaaggctgtatcttgtttctttttctatattcatctctttgaagagcagctttattcttacttatccaactctcacctcaaatttgaaatgtccacaagcaaactgaggatccctttccttcagtaataaatgacaaatggcagtctgccccatgagagcagggcccaggtctgtgcttcccagcccccgctgcatccccactgctgggatgaatgaatgaaccatcattcaccaccctggctcacctttcagacttctgacctccagagctgtatgattaaacatttgtgttgttttaagcctctatgtttgtgataactttacagcagccacaggaaactaatacagctgtctcagtaaggatcatgcacattggtattttgcacaccaaatgtttcacaagtcttctttcacagtagcattggcatcttgaagacaaggcaacatcttggatttctttcctgttaccatgtgctggatacatatcaggcactcataaggctcttcaaaggataattgggccttttcagcagcagctgtactcactgatgtactcataaagaggaatcactacttggagaaattcttcaggatacaatacagtacagttttaatgtatctgaaagccacagacatttacgtgcaaaccagccagaatggggtaggagagtagtcacattgtgagacctgtgaaagctgcttttgtgtatttagctgattgt

SEQ ID NO: 79427 - DNA, 1026 bp, Homo sapiens
tgtagcctgtaaccgtgagtgcataagtaaacttgatgtacttcgtgcacggctcttgttgtgggtcttcataactgcctcccagcagtccataaaacagaacaaaggccatgtggtttatttcttgacccctcctttaatagtgttttggagagccatttccagtctcagaaggattgctatgaaaaggagattgaagctttgaacttcaaagtggtgcatctcagtcaagaaatcaaccacctgcagaagttattcagagaagaaaatgacatcaatgaaagcatccgtcatgaagttaccaggctaacatcagagaacatggtatggtctcagccaggggccccagtcgtggccatcatactagagttgttctttgtcagtggcgtcaaattcagtttcttggcagtaaaagagtggatataaattactttttccagaagtgaaataacttggtctggtgattaaactataaaatgactgcagaccagagagcactctgatacaagagtgtgtgtgttcaccacaggatggctgcaggcgctgtgattgtctgtgtgtgcgcgtaagtgtgtatgttttaaagcctgtatatttaaatcaagccctaaccccttggaaagtgaccacaaaattgaagggtagctcttgagacaggagtgtgtcagaaggccagtcctgctcatgcctgaaatctcaccttttttttttttttttttgagatgaagtctcactctgttgcccaggctggagtgcaatggcatgatctcagctcactgcaacctccgcctcccaggttcaagcaattctcctgcctcagcctcccgagtagctgggattacaggcgcccaccatcacggtcagctaattttgcatttttagtagagacagggtttcactatgtgggcaaggctagtctcgaactcctgacctcgtgatccgcctgcctcagcctcccaaagtggcataagccaccgtgcccggccttcaaatctcaccttttcaagggcttcctcttccatgacg

SEQ ID NO: 79428 - DNA, 1050 bp, Homo sapiens
gggcaatttaataaaatgctctagagaaaaatgaatgaatggatgaagtaatgatccatgcttggacaatcaaggcttaagtgaattgtttccctaccagaaaagttaaacctgagtgtacctacgttcttaaatgtaagacatttcatcattaagttggaaagcttttaagcttctactaaatatgtgaaatacatattagtagagtatttgtaggattatggaaatagtctctgtaattgtcatgaactagccatgcgtggtttagaagagcttttggaattgcatccgggtggccactgaattccacaactgaagtgtctgtcttttctgggccccgtcccctattgtttaaaagtaggaggtcagaccacatgatcaggaagggtcactttcattcctgtgactgcttcactcttagcagccacatgagcctgatgtcagtcagtctgtgggagtcctgtcatctggctgaggtctgaggtctgtatcttaaatgtaggaacttgtgagactgcgcttgcagagaggtaccagtaggtgtcactcacttcctctttggtagctaagactggttcactctccaatgtgatccattaagattacttggggctgggcacggtggctcaggcctgtaatcccagcactttgggagactgaggtgggcggatcacgaggtcaggagatcaagaccatcctagttaacacggtgaaaccccatctctactagaaaaaaaaaaaaaaattagccgggcgaggtagcacacacctgtagtcccagctactcgggaggctgaggcaggagggtcgcttgaacctgggaggtggaggttgcagtgagccgagattgcaccactgaactccagcctgggtgacagagtgagactccgtctcaacaaaaaaaaaaaaaaaaaaattactctgggtttttgtgttttgttttttgggttttttttgagacagagttttgctcttgtcacccaggctggagtgcaatggcaccatcttggctcactgcaacctgcctcccaggttcaagcgattctcatg

SEQ ID NO: 79429 - DNA, 1050 bp, Homo sapiens
gcgtaggcttcttgaaaaaagttttgaactgaaaacacaagactatgagaagcagattcagtctttgaaagaagaaattaaagctctcaaggatgagaagatgcaactccaacacctggtggagggggagcacgtcacttctgatggcttgaaggcggaagtggcccgcctgagcaagcaggtcaaggtagagcggctctcacgttcagccccgccctctggttacgtcatttgattgcaattccaagttcccacagattagacagctaaaagcatctgtgtaaaggccacaggcaactggagcctgattccttcagtccttccaactgtgcacctccaggctgcctttgatttagcaatcattgtattccatattttaaaagtcaactttctaacttttttgaaattacatttatgtaaagttatttaaatatgtcgatgtagagaatactcccaaattagactgtaaattgaggtgaatccttattatataatccatcactataaatctataaacacctgcattaaagttaagttaccttattatcaaaatctttcatttaaactgttattagaaaatttactaaaacaattatccaatgcacagtgtggtgaatgtagttaataagagcatattgtacattcaaaattgctatgagtaaatcttaaatgttctcaccacaaaaaatgacaagtatttgaggtgataacatgttaatcagcttgaattattccacaatatattcataaattataacatcaataaagctataaattttcaatggtagaaatttttaagtaaatttttataaagctgagaaggaaaaatcacatagaatttttaaaactgcataatgatatataaaaatattgttacctgccgggcacggtggctcaggcctgtaatcccagcactttgggaggccaaggcaggtggatcatgaggtcaggggttctagaccagcctgaccaacatggtgaaaccctgtctctactaaaaatacaaaaattggctgggcgtggtggcaggtgcctgtaatcccagctact

SEQ ID NO: 79430 - DNA, 1069 bp, Homo sapiens
gttaatatctgtagaaaaaagaggttatgtgcagtgctcacacctgtaatcccagcactttgggaggccaaggcgggcagatcacctgaggtcaggagtttgagaccagtctggccaacatggcaaaaccccatctctactaaaaatacaaacattagctgggtgtggtgttgggcaccttataatcccagctactcgggaggctgaggcaggagaatcacttgaacccggggggcggaggttgcagtgagctgagatcatgccactgaagttcactccagcctgggtaaaagagcaaaactccatctcaaaaaaaaaaaaatctataaaaaagaaatcaaacaaatttattaggaatgtggctctctttctcagagtttttccctttgtgctataaaagcaagttttaaaaggaactgaaatgacagctcagcaggtagaatcatttagtaaactcatagagctcctggcactgcttcaagggcccctgtgggctgtgttgggcttgtctaggttatgtatctcttttcaattattttcttagttaatcatcaaatttttaattgagcaaccttctagagcagttggatttacatgcacttttgggcacgtggatttgctgccatttattctagaatttttgaagggctagacccctggacatagcagatagctctattgtttaggatcaaacaaacctccagcaggatccttggaacgaggaaggagccaggacttagcagagcacgccaaggtattcgctgaaggaaactggcccttccaggggactgcatggaacccggggggttgggaatacagtgccccaaaacccagtgtgtcttttaagttcagcctccctagccagtgtgccctgtgcgtgatcactgtaaagccacacctttcaaatcaggaggtgtaagaagttgtctttaacctaagggaagaggaaacagtttgctaaaaataaggccattacctgctggaactgtcacagtaggttctaattaacttgtctcctcttgttgttttcaaaatgatgtattctaattcaaagtaaagactgtagaga

SEQ ID NO: 79431 - DNA, 1001 bp, Homo sapiens
tccataaagcttctgctgggtgggtacagtggaccaccaggaattcttttcttttcttttcttttcctttctttctttctcttctttctttctctccttccttccttctctccttccttccttctctccttccttccttctctccttccttccttctctccttccttccttctctccttccttctttctttcttctttctttcattttctttcttttccttccttccttcctcccttcctcccttcctcccttccttcccttcctttccttcctttccttcctctccttttctttcttttctctttctttcttttcttttttttttactttattgctaagacagtgcaaaattcagagactaccaccaccttcaacttctaccaaatccaagaattaagattcttgcctaggaaataaacctccctcctttccttccccacctattgtccttgttagtttgtcttttatcccaaaagataaggtaagtaatggacctcacagaaattaaggcaggtgcctgaccttgtactgtaccagcccacctttcctatctcaatagcaaaccctttgctaacctccaaggactccaatctgggcttcccttctcttaaggagtcaaaggtttttagatctcaaagttggggtacatggcagggtcccggaaagagatagaacatgcttggcacatctcttttgggggctaggaagctcagggctgcctgtggtggtaggatacaaaacttccccatgcagtgagcaggacagcctgcgtctgggtgaggaagcaggattctaaagagaggagggaatatcacagaatcgctccaggagttaacaaatatatgaagtgtttcatgatcctccatcagtttttaaatatgtctaattaactcatttacctagaaaaatataattgtcgatgagtttttaatgtgaggagaagagctcggctctcggcatctgtccacgtgcagggaccacttgggagtgatcatttcaa

SEQ ID NO: 79432 - DNA, 1069 bp, Homo sapiens
cgattaagaacaaagctttggaggcaccaagcactggggtcgaattgcatttctggcaccacttgctggctgttggtcctcaccatggtcactccttctctgaccctcgtgtgtgacagtggagtcacaggagcccttcacatagggctgtgttagggttataggaggtgacgtgcataaatgctgacaccttaaaagtgctcagcaagctgccttccagcaggagctcatctggccaggtggtaaatttggtgcctctgttttgttcggcccacgttttgcagagtgggattattcacttaaaagtcccagttttctgacttttcttaagaatcaattaatctaacatcctgggccgcattcatccatggctacatccggcaggagctgagtagcagctgcctccccaagggctcctctcagttcttgagcttgcaactccaaggcaactgcagaggcagctgatgaaagtctgaatatggaagccagccatgtctgtctcgtccctgatggggtgtgctgggctgtaggatatgaaatgactttgcccttttcctctaggagctatgaaagcaccccttagggaggcaaaattgtgctgcagttgtgctgctcctcccctcaacagacaaggagagaataggaaaccacattgccttctcattggaggcacaggcatcacagtcaggcagcttcgcagctaagttctgacacaagctgtgtgacctttggcaagtttcttaacctctcgggcttattttctgacctataaagtcagaataataattgccaatatcactgttgttgtgcggactacaccatatggtgacatgcttattttaatgcctggcttgaggtaggtgttttatacctaccagatttcttccgggggacaaccaggaaaagggttatttataaactgactactaggatatcattaaaaccagaagctttgaggggtatttaaaacttgtagaagacatagcaaacgtttaagcttttaagtgtcaaaaaatatctataaacaaatgcatatgtcttgcttcaggttatattttaacttgtttaa

SEQ ID NO: 79433 - DNA, 1055 bp, Homo sapiens
gctggttttctttctttttggctccaggaaatgtgctaatcccctcacggtgactgaatatggtatgtagtcataatttatattctacttactgcaatcaaagtcccaatggggaacatggggcaggctcacaacagaatacaagagggaggggttatttattatttacaactgcagaggtgtgagtggagtctaggggagctattaatacaaggggcagtgggcacctggggggcagcagcagaactgttcactgctctttcccatgtgggcatccaagtgtttctggagcctagaaggagagttgggtaaagtcagccccagaggagcagtgaccttctgtcagtcaggccatgcagccagttggaggcagctttgcagggaagggggctggggaggacgcactcggaaccttctccgctcctctctctgctctcctgctagggctccccatgaatcaaacccaaccaaaggccagagggcatgaaaggccatcgccttggtttataccaagtcccctggggcagagagcagagaatctggaggggcaaacggaatccctccagcaatcccacctaaaaaataattcagggattcagagagcttgtgagcaaaaagaaaaatgaaaaacattcaaaatcaagcacagaatcaaggcaagatgactctccgaggaacctaatgtgaaatgattactgggatattaatttttgtgttgaacttcctagcagccatggcagaggggaaacctgtgtatagacacatgtggtatatgtctacagaggtcgactagaaggaacagtgccccagatgcccctggggtccacttcacgttcctgtcccagagcttggcactgatgctacctgcatatcttgaatgaatccaggtgcccatcttactagtcagagaagagatgcagtattctaatctgggaaaatgtttgtttttaggtttcaaggaggattttcagatggacgtttttaaaatcctggcagccatcctacatctgggcaatgtgcagatcaccgcggtgggcaacgagaggtcctcagtt

SEQ ID NO: 79434 - DNA, 2155 bp, Homo sapiens
tttcttaaatgtacatgatttatgtacatgcttttagaaggtcctactatatttgtattataattagtttaagtaatttttattacatcatgtattgctttattcagtttgaatacatttatttatttatttgcagtatcaaccagaaacactaccaattgcatcaaattctcccagtttttcctggttgtcaatgcggttttcaatgcacaattaagtcatagccatttggttcgtaccaaatgtgtcagaatctaacagcatccgataggctgtaagttggggagttgctaagaaaatgcaacgtggtacaggctgtccgcctcagccctggaaatctcccagacctcccccagcttcatcctgtgtagcacgactcaacgtgcaccctgaatcttctcaggtcttccaggtcatgctgtagctgtcactgccatgcagcccttttttttactccggacagctcatgtactgaagcgtcatgaaagaaaggctgtggtctgagcccttctctcccatctcctgtctttgtcctgtcaagtgctggagccagagctcctacagctgcccttggtggtttctcctgttcagcgatggtggcacaaaggttctgctattccagggctccagcttcctcccaggtctacccagagctccagatgggggtctgaattaacctctcttggtggcctggagatttttagtcattgacaagaataccttgtaaccagggaaccccaaggcccagtaaatgattctgtataccattttcttgaaggtacaagaagattctgccgactatggggatctttgggccagtttgaggattgctttccctctgaggttctttctctctgtcagccacactttctcacccaacttcagacacaccctgccagcctttcccctactcattcactcttccccttccctcaacttaatcgtctatcccgttgcctgctgtttgactgtgcactgaaggcaggtggatggagtcagtcctcagttgcccctgctggccttcctggtgcttaccatcagcccaatctttgcacagtccttgttgttcttacttctctgcatgcattccttcagaagatcagtcatcaactttttcttaattcctctgtgacacacaatgggaattcaaaggaagagatcttaaaagtcacaacagttctttatcttaataatcccctccccattcaccttactacatgcagactcacctcacacccttacaacttgaagctgaaaatttaaaagtaatttccctttttgcagcttttcctcaggttaaggctttgatctgcctgagagtaactctaaaaggagggaagataaatatgggataaaatccacaaagtgtagcttctaattcctttggaagtttaaaaaatttccacatatctgatgcttcttttgtcaggtgcagaagcacaaaaacatattccgaagccaactgatagggaatttggggattattgtcagtttggagaatttgctgtgttatttcttcatttccatggatagctcatagttggctctttctgggtgagtaattatgtgtaatatagatcaaatcttttactaaggttacagctacatgttaggggaggctatgaaaatactatattattataatttcagtgcagtgattgttgtgagaaataactttcatggtaaccctaggaaaatgggcacctgccaccatcctgagaagtcctcacacaatgccctttctctcttacacacacacacacacacatacacacacacacacccccgtcactaattcatagagttccttagcaggcatagtcaaggatcctctgggtaatgtcagctgcttagtgataaaacagagccaaaactagtgcatcctgttgaaagtaatgcagaaacagtacctgggtccagatatgctttcctgcggcgctttcctctgttacctcgtttcatcctcacagcagcatggacggtaggtggggtcgcttctacaatcatttctgatgatagcttgggaatagagataggggcagtgacttgcctgatgtcgcacagccctctggctgtcctgctttcccatatggagcagtggtggtgtgggcacctgtgatgcaggagactttaaaaatgtcgtgaggtcacgtgc

SEQ ID NO: 79435 - DNA, 1841 bp, Homo sapiens
tgtatactccagttaatgagtttgaagaaagagtctctgtgtcgttcattcgtactatacaggtaagagctcccatcttcttctttgattcaccaacacagtcttttgaatggacattttgtaatttattgaaggataatgtgttatcttttattatcttattttacaatgcactaacttttttgataatagttaattgggaaaatgaagtgagtttaaaacaaaagtaaacattcttcattagttgagaatttgagggtagaaattttagtagaaaaaagtcttttagattcaaagaactgatgctctgtttattttttttcctaatcttctcagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctgaaagtgatgtccaggcaaaaattgacaatacatttcttgcccgaaataagaacccattatttccagtgagttactgaaaatacatttttaaagagaaagtactgattatctcccaaatgagaagtcattaactggaaatctccctagaatactttcatcactttggaaacaaagataggctctttcgtgctgtgttatctttatagcaacactcatccttaaccaactaggtaccgtgagtttacatacaggagaatgatggaaggaagggaggaaggaaaggaggagaaaaatgtgtcttcagctggcagcatttattttaaatccttagcactgagtttgaatggtataaaaagtataacttccatagatgagctgttgttaggaaggcaccaaagaacctcctctgcactaaacaggagaatggaaagaaaagtctccattgagtacatatcatgtcagtttagtaatcaattatgttgatattgttaaactggttcaaagaaataaactggcaatatgtaaagtaattcctcatttgtgtcactatgatatagagatattaaaggaatgttggtttgctaaatagtatagatgtccatttgtactatagtttactgagcattttaaattgctgctacatactgtcttcttaaaatgtaagtgatattaggcactacaataagtttctcttgtcaattctgtttacaattcaatcagatcacagttttaactggattatatgcaaatacctacagattcacctgcacaagtagcagacactggaaagtcatgtagtaatatgacaaaatgcttgacatttaggggtaggattagacaaagtggctattgttgatgtcattatttattcaggatgtattacattgatgtgctcattaattttccctgggtggatattgcgtcagggtacagtgttctgtgaagtgacttatttttaactaccagatctgattccttcagtgcatattttcaaccttgacaggttttctctcttcttaatttattaagaattaatctcggctgggcgcggtggctcacgcctgtaatcccagcactttgggaagccaaggtgggcggatcacttcaggttaggagttggagaccagcctggccaacatggcgaaaccctgtctctactaaaaatacaaaaattagccgggcgtggtggcacttgcctgtaatcccagctactcgggaggctgaggcacgagaatcgattaaacctgggaggcggagattgcaatgagatcgaaccactgcactccagcctgggtgacagagagagacactgccttggaaaaaaaaagaatctcactcactatctagagagga

SEQ ID NO: 79436 - DNA, 1050 bp, Homo sapiens
cacaggtatatgtggggcttttggttattcagttacctgatttggagtttgccttaagagagagtgcttcaaggattatcaagtctcaccctgcaacagcaacccagctctgaaattgtaagagaagctacaaagtgttttctggccagctccccaataaagacagagctacattatgttattctattttgtttattagcaagtctaataacttttgccataatgacttcatttccatcttccattaaagagaattacattatcttgtcatttagtcttatataatggtgattataatcctcatgactataataaatttttaagcacagctgatgagatttaagaaaattgaacaaaaatactgcctgtcattttaacataaatcctgacaaggccgcacacaaaaaaattaagacatttttgacaaaattcagcaaatttgcattctctgtatctcttttttttcataggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccaggtagagcaactttccctgttacaaaataatttaacattcatcaaagatgatctttagggaagtaaagaagtcctctacttattgcttgtatctctgagctgacttcatctgtgttcaagaagatatatgcctctaccaatcttaaagcaaggagattttgccagaaattaatacatttcagtgctaattacagtataaatatatttaatattcagcaaatatttattgagtacttacagtgttctatataacattgaaggcactgggatacacccataggcaaaacaaagtctctgctctcatggagtatacagtctatgcagcttatattccataaaatagctttctatcttatttgataattgagtggattatcaaatagtgactttgtttttagagacagat

SEQ ID NO: 79437 - DNA, 1483 bp, Homo sapiens
gaggtaggaattatagtccagttttacagatgaggaagccaaggctcactggggctcattgatttacccaagttctcttggccacaaggagcagagctgggatcctgggtctggcaccgctgagggcccatgaccctagccaactgccctccatgcctcccatccctttgccaggagggcagcagagaaggtgcccagcggcacttcctgagcactgacaggcagatgatgggaaacacagagatgagcaaggcctagtccctgagaagatggggccaacagaccagaatccctcagaggggtcgttgactgcatcctatcagtccccactttcggaccagtcattaagtaggtggtaaggaggcagatgcttggctgtagggagaatcctcagagtaagcacttgcctttatcacgtagcatcaggcaaacaacgtgttaaactgcaaagtgactggaagaagtgccgcccattcagttccattttaacagataccaccaaagattcccttctaacctctgactgaaaaccatggtgtgggtactacgaaatagagtaaagagaactttttgtatgtattcactagtctctgtagaaatcggtctatttcaagattatatatgtcctttgggtgtagtttttaagaataggactataaagaactgaagttaagagataatttagataatttagtgtttgacagtaaacctgctgtttcagaagtgaaacactctattttttttttttttttttttttttagttaagttcctccaatttgcttcattgacattgctattgggaagacttaaatgctaggttgccaagttaaggtattgttcaaaagctagtaagaactggagggggttatgatggaagcaaacaaacacacatcagcatttgagaatgtcagtcctggcattagtggggaagctccttggacagagcagaaaagagcatgaagatgctgatcaaattggagatagttaaactgaagagacaggttacttcatgtgtatcattaactttgccttatgactctagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattggtaaggccagggccccactgggcattgcagcctgcctatcattcatgcccatcgataagtagccaccagtggcacatgtttcagggcaggtattcatttggggagcataaagtagtaagatacagggctaaaattagccgaggaatcccagaaacccagccatagttaactgggatacatcgaaatcactgtttccacaagactgaaacagtagtatatggtttccttccctaatgtttactgtttaaattcagttgaatgcattgaattttaaaaaattgtcttaagt

SEQ ID NO: 79438 - DNA, 1058 bp, Homo sapiens
gcaatccatctgcctcggcctcccaaagtgctgggattacaggtgtgagccaccgcgcccagccgggtgaatttttttctgcttaaaggagcagctaaattcgcatcagtttaattttctatgccaaaaaagtgaatggcaagcaaagcaacaaactgatgaacctggtcgctgacattctgctagcaatgacataagacttcacaactgtaatgtgatttatttttataattgtttataatggtaactgaaagaaatgggtcttttggtatctgttcaattttttttaggttgttatttccctaaggaaaaggcaagtttagacttattctctctttcagaaaagaggtgatgattttgaaaccgtctccttctggctctctaacacatgccgatttttgcactgcttgaaacagtacagtggagaagaggtgagaaaaccttgattacaaaaccagcatgctatactttctctgacctttttaaggaaaaaatgtaaaagcacaaaatgtttaaccatttatttaggaacccaaattcagaggtggcttggaagttcttgctttgtttgatgttcactatctatgaagcagtgatttggagaatgacagtttcttctttacattgtgagaaagcatagagaaaaataaaataagcattggtcagtgaatagttaccagaagtaaaactttttgtcagtatgttttagtgggcatttcaagagctaatatcagaatagtgaactatttaaagaaattaatcaattttggcttgccacaatacattaaaaggtgatcaaaaatcggggggagggatggcattgggagatatacctaatgttaaatgatgagttaatggatgcagcacaccaacatggcacatgtatgcatatgtaactaacctgcacattgtgcacatgtaccctaaaacttaaagtttaaaaaaaaaaaagaaaattttaatattaatactcttggacaataagaggaccttaaaatcctttaactctaaaaaaaaaaagggtgatcaaaaatcatgtctttcgatttgtccaaaaa

SEQ ID NO: 79439 - DNA, 1108 bp, Homo sapiens
agagatgaattagggaggccagttagggagctattgcagcagcccagcaggagatgatggtggcctccatgggacatctgtagctggtagaagcagtgagaagtagctggattttggatgtattttgtagatagagccaacagggtttgttgatggattggatatgtggtatgagaaaagaaaggagtcaaaaatgaggatgaggtttgtaatctaggatactggaagactagacctgctatttatttactaagatggggacaacttccaaaaaagtaggttccttagagaagcaagaatttggtttgggagaggcttagtttcatgtgcctgagcagagttgtcaagaaggtagttgatagtgagactggaattcaagggaaaagtcagcgcaggagatatcagtttgggagttgtcattatatggacatgctccacattccagaatttttctacttaaagagctattaaaatacactttttatattacctacttaccttgaatgattgaactcttacatgacaactgtgtttttatatctcacaatgcatgcctcgtgaaaattttccatgttatataaaattattattttttcttttttagaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaaggtcagttcctgttcaacaaaattctcatcatgaattgttaatgatgacagaatctgcactgattgatcttccttccttagagtttagctaagttgcttgttattaaaactttccaatttttatttacttacctatctattttgagacagggttttgctgtgtcacctaggctgaagtacagtagtgcaatctcagctgactgcagccccagtgcaatcccaggctcaagcaatcctctcagctcagcctcccaagtatctgagcccacagttgcacaccaccatgcccagctaattttttatgttttgtagagacagggtctcactatgttgcccaggctggtctccag

SEQ ID NO: 79440 - DNA, 1050 bp, Homo sapiens
ggatattgattgttcctcctgtgaattaaagtcaaaatatgtttaaccatttctgattagtatcaattaattaacaaatctgttaaaccacttactttttggacatttaatcttattaaaaagtaagccttattacataaaaaaaagttttgagtcatgtaaggttatttgatgttaatttacagttaggcaggagtggctttcagagtaagatgaccatataattttgccatctgttcacccaattttaacagaaaaaaattattttaagagaaggcaattaagtggcaaatatggcaagtttcggttgttgtagaatgcattcaaaattataggaacttggagacctctcatgttttttatatggaaaacattttctcctcctttcttacttctcataaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctgggcaagtattttctgcattggataaaagttccttctggcacatgggttaatggtgggaaaaactagtcactaatttttgagatattcagcgtaggtttcattagtcatcatcagataccatgtattctagtgctgcagtagtgttctgaccacaccaagcactttcagtccaactgcagggacacatgcctcagacccacctacaaggattgctcaagatcaggtcttctcagccctggctgcacattagaatcacctggaagctttgaaccatactgatgtatctctctccctcttgcccagttaaatcaaaatctctagagagaagagcctggcaatgtctagtactttaaaaaaaaaaaaaagaaaaagaaaaaaccctcaaggccagcctcgggaaaatagcaagaccgcatctctccaaaaaaaaaaaaaaaaaaaaaaaaaattacccaggcgaggtggtacatgcctgtagtcctagctgctcaaaaggctgag

SEQ ID NO: 79441 - DNA, 1058 bp, Homo sapiens
attttagaatttcatagggtggctctcatagagacagtgcttcacacatggggagtgtcagttcctacctaagttcaaccattctttccacaaacctttttgtgcattcatcaaaatttatttttgcctagtcagtcctcctttaaaagaaagcattctactggaataccaatacattctacaaagcattcagttgattttcccacatggagtctactggaaagactctgcagtgagcctgctgtccatcacgctgtaaaggagtttactgcgttgtatattttaacatatggcttttattgtagctgcatttcccatgcctgccaattttagccaggtggtggctccaccaatgagctcttatgtaaaactaacgtgttgtttctgtgatattgtgtctattttcctttgatgcattttagaaggcctgtttcgatttttctaatatatttctctttttgatctttaggatttgatggaacaacttgaaaaacaggataagacggtccgtaaactgaaaaaacaactgaaagtatttgccaaaaaaattggcgaactagaaggtatttaaacctttttttcaagacggtcactgagtcttggtttgagtcttggcttaaagactaggctatataagtggcctaatagaggtttgcatgcaaatattagggataataacaaaatatgacttttggcaaacctaacctcttttgagtagaaatttacatttttaaatgaggaaaaatgttcttttcatgggtagtaataatttacagattttactctgtaagcatctaatgaatatcttctatatgccagacaatgtgctaggcagtatagcataggagttaagaatgtggattctggagtcaagcttcttgggttcaaatcttagctcttctacttattaatcatatgatattgggcaagtttctgaacctctgtatgcctgtgctttcccatctgttaaattagaaagataatagcatctatctgacatggtttataaggattgaatgagctattaggttggtccaaaggcaattacttttaatggc

SEQ ID NO: 79442 - DNA, 1682 bp, Homo sapiens
aaaaatccttaaaaagtgataatttcatatttctatataaagtctatattgtagtgctagcccgattttgagaaaaattgtttaggattggtggtgatttgtgtcttttttaaattaacatttttaatgacctataataaaatagtatgaattttctctgaagatttaacaatctgaattatccctccattactccatttgtgataatttacattacaaacagttttctagtgtcatttattcaaccatcttttatatgaattagaagcaaaacgcaaaggtattctttttcacagtctgtctgtatgaggctccaccatgggaatgagggaggagggtgggggcagtgtgtgggctctttccaaagtgattgacatctcactaatttgtggggaaaattttctgaatcatgaaatattttttgaagtgttattttacaaagctcaagtatactgttgcttaaattaaactaacaatgctttgatgactaagtattaccaaatatactgaataatataataagttgattgattggcatacaagttctgtgctttaaattattgttttaaaatacaaggtgaaatcgtgaaataaagatgcttctgggtggcagatttccagggttttttcactaagttggtcagacatttctcttgcaaccttgtttgcaatattaatttttttggcaatttttcatagctaatacaaaaaatagactaagcccctatattctaagctaatagagcccagttaatgaatttgagtttggggaaaaccttttgtaggtcagctgcttctcctgccatcacactgactactaattcaggaggatggattcaaacataagtacaggaaatgatagactttttcaaaatcattgttttctcaatcttaattgtgcatttctataagaaacacttgagtaggatattaaagcccagcaggagacctgggcttagtgctcttgaaactctaccttgcccacctacctaccaccaacacaaaacacaaaaatgatttttctacctcatctagtgaacaggcttcacaggcctcccccgtgctgtctttcagcgaaggaagatgcacagcttcccaccagcctctccagcttcacaagctaacattgctattattctcacttttattatatttacctcccctattcttgccactgctgctggcggcaaaaaaaaaaaaaaaaaagtgcagcaagttgtgagcatcatgtgttggggaggctgggagtaaaaaggcaggaggttggaggagggaaatgacagccttatctgggcctgctaagtgatggcatcctggccacagcctctttcctttgttcacacaagaaacatctgtacatatgtaattagaataatctatactagaaagataaaagggtaatggaaggtgacaaatcagagcctttcaagtatatatagtttcactatttgtattttaaaatattttaaaattgattttgctgaaagatagcatttccctcaaacacacagacaaaaacaaatatccattgtgcctgttttttcagtattttgaggaattatatgcagatgaccctaagaagtatcaatcatatcggatttccctttacaaacggatgattgtatgtaaaaccatagtgcttttctgctgtcttcccttgctacttatagccctctgtaact

SEQ ID NO: 79443 - DNA, 1060 bp, Homo sapiens
tttttttgagacgaagttttgctcttgtttgttgcccaggctggagtgcaatggtgcaatctcagctcactgcaacctttgcctcctgggttcaaccagttctcctgcctcagcctcctgagtagctgggacaaaaggcatgccccaacacgcctgactaattttttgtatttttagtagagatggggtttcgctatgttggccaggctggtcttaaactcctcatctcaggtgatccgcctgcctcagcctcccaaagtgctgagattacaggcgtgagccaccacacccggcctcctatgaacctttcaagagaactaaaactctcctgtttcttagggcctctgagaactttatataatgcagaaagacacaaatgtgagagcacccgtttctatttctgcttcttgttttagtttcttgactttaatcaagtcagaagataacacagatactaaagaatatctgcttttcctactcttgcaagtgaacacgatgccttacacccgttaggcagcaactcggggtgtcgtctccccttccgacccatgtgtcctctccgcaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggtaaggagagctgccgggtccacatgcttcttaacctagcctgcccgacagtctagtttctttttgatcaaacacgggtttttcttgctgggaaaaactcacccctctgtacttgttacccctcttactccagcagagacagagtaaggaaaatacaaatattttggtaggaaggaagaaggcacaggttctctttatcacggagggctgcgtgctcttagacctgccctggaggcagacaaccacctgggtgcaggctgggcttttgatggcaggtgatctgcttcctccatttc

SEQ ID NO: 79444 - DNA, 1007 bp, Homo sapiens
atgctgtctaaaagcaagatgaaatgcatgatttggcactctgtgtggttattatgaaattcacatttgtgaaacagcaaatcaggagagttttctgcattgctatagctcagaataattacccaaattcaacccgttaaatatgttcagaggagagaaaataaaattgaaacagcagcacctttctaacacagacattcatctgctctagtgatatttgtctttaaaatctcattaaaattctattttagtgattaaatttttaaaacactcaaatgtttgttcaaggggcttctgcttattctgctttgttctcatcattaacgcttgtcattaactttggggtgttattgctgcagatctttttgaaatgttttaatcactaaatatttttagtccactgttaacagtttgcttgcaatggcatcattaagttttacccagcagttggcaaccaagggactggaataaaagaatgtcttttctttcttcacattagttagttcttaaccataactttgcatttggaagagagtgactgtagaagcaggggtgcgtggcaaagggaggatgctctgactctggtgttctcactgccaatgcctggtctgctctgtgggcacagctggctgtatgtttgcttggaaaagcaataaccacttttttggtcctattaatatttgtgttctaaaaccacatcttgttaggattctgtttctgatatgtaagtttatgcggagagagaagatgacagatctaaaatatatataggaaatttcagaactatttgtgtggattcgggtaaatctgtatatataaggctggagtggtgttccagcctttctgtctttcagaataggagtagaatataattccctctgcctggaattagtaactgtagttctgaaggcacatttagttaatttggaagtttataatgttggcctttatagtgcagagttgttttgtggcaaaggtgtactgtctttgccaatttaaatgctaat

SEQ ID NO: 79445 - DNA, 2444 bp, Homo sapiens
ggagaatgcttataaaagtatttggttatacttaaattttaatttatcagtttaaattataaacatatgttatatctaagaatgtgttaatatagaaagaactgtattgtatcacaatgttcttccatccacttagctattctatcaccagtgtgcctacttcatgccaggccttgtgccacatactgggaatacagtaataagcaagataaatgcggttcctactctcactgagattataggctgctggggagacagctgagagggtttggactttattccaaagataatggaatcctctgaaaggtgttaagtaggagaatggtgtgatgagatttgatttttggaaagctagccctggctgttatgttagagaatagactgcagtagaacaaaattggaagcataaaggccagagagtattcctgtaacccagtgattatggtgacttgggcttggctggtggcagttaggattgacagaaatgggacgttttgaaagatacataagaagacgaagtcagaaagctgtttggtttattgaatgtgtgggcgagggatggagaagcctgaaggtgactccgtggtttctgctatcttggttaggtgtggtgataccgttttgtgatcgtgggactggagtgtggggaaatgcacagtgaagatgatcagtagatttatacatatggatttaaggagccaggaaaacatccagagaaagaaatctattaggcagttgagtatataaatctgtagacaggagagatgtgtgtactgagatagaaattttgaagtcatcagagtataataatacaatggaaaccgtgtaaataggtgaattctctagagagatatgaactctctagatgtaaagtagaagacaatgcctggaatttgggttatgtaaacataacaacaatatagcaggagtaagaacctggactccagagtcagtgctgggatccactacttaccagctgtgtaacctctatgggtatcttacttccaagcctctgcgtcttcctctgcaatgtggcaaatgacttgttgggttactggggaaactgaattagtacatgtggaaagaatgtagaacagcatctgacactgagcaaacactcaaaaaatattatttttatattctaagtggaaaataaatgattactaacattatcattactaattatacgtttttaataagatgtgatacatctctaatatagcagtttttccaggcatacaattaatttttgacacaaaaaagcttttaaaaatcatgtcataaaagctgagaaccttggacatgttctgatttatgttactgctataagaatttttaaaactggttttttaatgtgggaaattaggttttattaagctaaaaacgttcctacctagaggacttaaaaattcatcttgaaaaatattatgaagtttgccacacaaagacagtagctgaagtttttgttctatatgtgtcataacctctaatacaatatgtgatgtattagatcactttgctagctgaataaaacatcaaaaacagaacctctttctcaccttccagtcatttcttattttgcaggtaaagtagctctacatccttgattattttgctttaatttctatccatttacatgtgatgctacatgttactcatttttaaaaattaaccaaaaataatttttgtggtaatgtcttaaagttgtcataatgaataaaaacaaacttataaaatgttgaaatactgcatgctgctgttgaccatcgtcacctcatcagcatcctgtatccttttgtgttttgcattgttgttccttttgcatggaagatcatctgctctggattaccatgagttgaatgaggatggagagctgtggctggtttatgaagggttaaaacaagccaacaggttatatttgtctcctcaaaatggaatgttattaatttgttgtttttcttactaacagtgacctcctgactttcacccctgtatttcttgtgcattgattgtcttcttgggtaaattagtgttagtaattgtgttatttgttcaaagcttttcagtaaaactgagaacattcagccaaacaccttttttttttttcttttttagacggagtctcactctgttgcctaggctggagtgcagtggtgcgatctcagctcactgcaacctctgcctcctgggttcaagcaattgtcctgcctcagcctcctgagtagctgggattacaggcgtgcaccaacatgcctgactaattttctgtatttttagtagagacggggtttcaccatgttggccaggctggtctcgaactcctgacctcaggtgatgcgcccacctgagcctctcaaagtattgggattacaggcgtcagccaccacacccggtccaaacaccttctttaaaaaccttcactacaagatactattaaagctaaa

SEQ ID NO: 79446 - DNA, 1391 bp, Homo sapiens
tcatgaagtagtagaaagaatggctttgtacattccattaaataggtgcctggttatttttctaatgctgtatatactatattatatactttataaaatatatatatattttttttcacataatgtaaaacacatatatggcccatcagtgattttatttacagggccgtgacattgtagaatcttcccacctttgtagcagagtgctagtgtttctcaggagaaaaactgaaggtacctcttctcaactacctgggccaaactcccctctgcagttacatgaggttggggctgatgctttggtgggtcacaggtatggtggagcacataaccactgccccccagttataccaaataaatgtgttttatgtccaaagcttttgagttgaatcttaatgcgtaaatgtgttatttccctctcagaatacaatgacagattccacaatacttttggaagatgtacaaaaaatgaaagataaaggtgaaatagcacaagcatacattggtttgaaagaaacaaataggtaagttgatccttcttttattcattttggtttaattatattgatctttagccttcaagccagcctcttgtacagtaaaagtgttcatacattcctttatattagacattaactggccttcaaagggaatccaaggtttccagtgtatttctagttaagatcttcattataatataaggtaatagtattgacaaaaggtgtcagggaaaatgtgctttaaatcaaagcaagattttaaaaatatttaatgtcttagctttaaggggctgccttgagaagaaaactacctgctcaggtcatacaatcttaggtagtcactttcatttgttattcaggatggttatttgtgaaggtttgtaggggcaactgcagttttcaatatttgaaacttaagagtgaaaagaagtgatgaggtatctggaatcactcagtgttggccatgtaactctaaaagggcaccatgacttctaggatagaagaatgaaggctcatatctggaattccccttggccttactaccaccctccttcccagcaaagtctattggtctggggctcttgatggatagtttcaggattggtaaacatacatactttataaactgaagaatattgccatacaaaaagaaaggtgcagtcagccctcaatatccattggatccctatctgtggagtcaaccaatggaggatggaaaatattttttaaattacatttgtactgaacatgtacagacttttttcttatttcttttctttatctttcttttttttttttttgaaatggagtttccctctttcgcctaggctggagtgaagtggagcaatctcagctcactgcaacctccgccccccaggttcaagcgattct

SEQ ID NO: 79447 - DNA, 2747 bp, Homo sapiens
acaagatgtttgactaatttgggggaataaaattcctgtaatagtggagttatatagagaaatgggctttcttactttaaaataaatcacaggccaggtgtggtggctcacgcctgtaatctcaacactttgggaggccgaggcgggcagatcacgaggtcaggagatcgagaccatcctggctaacacagtgaaaccccatctctactaaaaatacaaaaaatcaaccgggtgtggtggcaggcgcctgtagtcccagctacttgggaggctgaggcaggagaatggcgtgaacctgggaggcggagcttgcagtgagccgagatcgtgccactgcgctcccgcctgggcgatagagtgagactccgtctcaaactaatcataatcataatcataatcataatcataaaccccttaagccagaaatgagaagaacccccattttggcttgccgtataggttgcaccttaccccagggctgtcacagttggttcccttggctaccactgtggctgggcctcaagaaacaaggcttgcaatctagcttgagcagagtccaaaatcaagattcctttctctagttttcttgagacaaattagtattctttcttaaaaaaatgttaattgacaaataataattgtatatatttatggggttgcaatgtggtaatctcacaagaaattttagtaaaaatcaagagaaaggaaaagaaaaatgaagcaaaggacataaaaacagtccagctaacagagcacatagttctgctatcacacattctcccttgcccggctcacgtaccccatgtgacagctgctctcctgaccctaatgggctgacccggtccaactgaggtacctaagttcctcagctcccagcctaaacatggtagcactcgtgtcccatcctaggagaaatgcccttgacactaattaagatcttccagactccccagggctgtttgtctcactcagtttctagtctgagagacacatcatgtcaccactccattgcagggcagtggtgagcaacaccctgtgagctagggaatgatccagcccaggcaggtcttgtgtattggctccacctctagagtattctgggaatcttcccttggacaaacgacttctgtgagagacataactttaactccacagacctacgataagaatttcacccacaaataacaggagggtcattctctcacatactcaaagatattttataaccagaaaaatcaaaacaattttaaaagaatttcaagcatttgttcctggaaatagaagttgtcaacatataaatatatattagtctctgttttatgacagttccaggaatgttaatgtatatatagagttaattttagagaaacaactcatggctgtttttaaattagcttttatctgttataataggaactcattgatgaaatttatttatggaactaagggtttattgttttctctgttttttgtgcttgctgacttgtgattctcaggatgacaaggtaattatacctttttttttttttagtaaatacttctatttaatcctaactttagtttacaagtatcccccaataaaggcaattgatgctttctgaccaagtctattttgatattttgaatttgtaagtgaatttccgatttgactccttctgatttgggaagtcagtagggaaacagtggttatagtaggctccagtctagattatagaggggactccatgacttctaattcataggcagctctatgactcactgccgtagttctggtaggctgtccacaggctggggagggaagcccttaacttggagtacactcaaaagcacaggctctcctgagctctcatatctaccagtggcgggcttgttggttaagggtgaaggggagcctgaggagctgagcacactgttctttgctgccattttcatctccctgagtgtagagtccacagctagaatgaaatgtggctcgttgacgaggttgcaaagtcaaatttctctaccatatccctgtttctctatgtactgagtgacagatattgctggaattttcctatatagcacaacccttttagaacttctggtcacaggcttaagagagacaaagtttgagcagtgaatcaggaacttcctgaatgctggtggcccaaatctgatcccattccccaagtgccactttttagctaaggtagtcagaatgagggaagaactggtgacttaccacccaggagagaagcatactaagaagcctttcttctcttggattagttaatttgatcaagttacctcatttgctaaaagttcacaaccataccatgtaagtcctgagataccagagcacacagatagcattatttgatgtaaacacttgggtctttgaaagttattacttatgggttttaaaaatctgagtatggccctttataaaacagaaagattttattcctttcagagaaagagaaaaaagaacctctttgtaaaacaggtactaaaatatttacaaaacatagctaaaaaaaatactctgtggttttaatgggaaagatttttaaaattcaataaaatgtaaactatttattagtatatttcatgagattatagttggtcttctcagaggaagcatttataaacttacaaaaggatagcattaagagaaaagtggtattttttttaaggatttttaaaatacacattgaaattcagaaacaagcatttgtaagtctctgattggcattaaagttatc

SEQ ID NO: 79448 - DNA, 1573 bp, Homo sapiens
attagaagttaaaagcctaacatttcaatagtctttccattctgctttataaaggaagtaagaggagactactaaagacttcagggatccacccatctgaatcattcattggaaatatcctggccagctggaccctcagatttcccatatatttatctgcaaacaaaagctaggctccatagcactggctaaactcaccccttgggactcagcaatctctccatgccagtgaacacaccctgggcaggccagaatactacatttgactctggaatttgggctgatgaagcaaacttccattgaccttgctcaattctacttgatgtcagacttccttaatttgcaaagcagggctcctggcagaacctaggaagccattcactagggtaactctgatgaactttttcagcagaattcttctaccagcttgggagaagtttgagcatccaacgtaaagttgaggatgacagcaatgaacttttctttgtcttttcatacagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggtaagcgcaagcacacaattaaactgggtgttcggggactggcctcaatatcttcttatcccttccctccagtttataatgcagcaaacacttaagagcatttttaatctaattgaggattcattatttttttaaaaaaatcccagtgttgtttaaaactattgtaagtataaattggaatgagcaaaaagccaggggaatcccaaatgatcacaaagtttcatctctcatgagttttaaaattaatctttttgtagtaatctggccacaataaattttaatctaaaataaaattttattaaatacaaaaatctctaaattttcttactgcgggaaggcattaaatacaactttaaaatcatttgtcaaaaatagctggtttaattggagaagtaacagatgaaccggttagaagtgacatcagtgagtggaagttacatggagatgatttctgctcactttaggcagttctgtttagtagcggggtgatgtcccagtgggaggggctgtttaaggattcaacagagaggactcctgcactgaggatatagatggccctttgaagtccttccctgccttcatttgagacccagtgctgccgtatgctgaagagagatgggcctttctgtcatttgccaccagagggaatctgagtgatcaccttgaaaacctggcctgcctccctgcccttgtgcacacagcagagcatcacaggactcaaggcagtcaagcatcccaactgtgtggtgtgtcatataaaaaaatccatgatatataatgagctggatgcctgaaaatctgagagtactcctcttagaaatgatatttctgcatgcagtttagat

SEQ ID NO: 79449 - DNA, 1010 bp, Homo sapiens
gtatttcttattctgtaagtttgcctatttttccattgagctgtttgtcattttctcattggcttttatgtcttctggcttgtcttgaccatctttgtgattcctggggtttaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggtgcgcagcacagcccatccgcagagctgaagctgggctttatgtccatttcagcagtctcttccttagtggagactcagcccagcctatccaagcaccacttggttaaagtagtgagggctaaactctcttcactgttttcggtagagcaagtaaatattttaagagtaaaaatgtgacaattaaaatataaaactttaacttttccctaggaagaagaaagaccacaaattagaggtgcagaactggaatatgagtcactcaaggtaatggggagtttctgctcaagactttgaatattttgttttggcaagaggcccattcagagcctctctttttctcagagaacatccttaagggttggagattgcaccagaggtcctagcttcagccttattcagcattacttcttgtgttgtttctttttataaattccatttcatataagctagactttagtcttaacaggaacaggagaagtagctgctgttcgaggctgtggtagtaaaggacgtggactctagcatctgccactataaaaatccaattgggtatgatggggcagaccagacataggagtaggaatctgctctccagacttctcctgcttcacacaataatgaatgaataaaaacattctctgtagtgtgaatgaagcctggattcacaaagtattagattagtggctctcaaaatatggtccctggaccagcaggatcaatgtcacctggtagcttgttggaagtgcaaat

SEQ ID NO: 79450 - DNA, 1011 bp, Homo sapiens
atgattgtgcatgccatttcaatatattttatgaggtttttgtaagttttatttgattatggcactaaaagtcagtgcttggaagcttcacccagtgcttcactgagcactgcttcacccagtgtgactgaccgctcaaagctttcaacacccaaaggggactcgactaataatcagaagtggttttcatttgggcatttggttttgcaactgttcttgtcctgtcatgccagtgtacctttttctttgaagcggtgacctttttgtaattatttggtcaaaacaatatggaacaaatcacttgggcaccaatacaagtcaggaagtagggataagaaccaagtcaaggtggatgctgtcttaactatgcctagactaattatgttgcattaattatacctgggttatttgccttgcagcatgtgcctaagcctggacacaagagaacagactccacccacagcagcaacgagtctgaatatatctttagctctgaaattgcagaaatggaagacattccatcaaggacagaggtacagtttagacatctgtcactgaaagtaggatatgagcatgctgttgttaacaaggaacatttccattgcaaagcagactccaattggccataaacatagtatttgtttgaatcatttattcttcataagtgacttgtagatacaaacttatttacatttttgtatacttaagtgctgtgtacatacatacctattgcatttttttgtcaatacaaattttaattttaatttttaatgcaattttgatggtgagattttatttttataattctctttacccctaacatgatatgtttacaggaatttatttcagactgaggtaaattattttatttttacttattatttatttactttatatctgtggaccaccgctgtagacagaggtaaattatttttaaagtaagccctttgtccttgaatattataaacaccagtgccccagagtttagcaaaactgatgcctctattttat

SEQ ID NO: 79451 - DNA, 1052 bp, Homo sapiens
caccgcatcgtgcagcaggctaaggagatgacaggtaaagcttatatgcgtactacacgccaaccaacctcacaccaaagttatgtaagttacaatgtcatttgatgagttacacaacattatttagaatttaaatatttttaaaagttgaggctgtcatcagcaaatttataaagttccaagaggcaacagatcagatattttggttgaattcgttgcttgataaacttgtaaatctggtatctctaggtacaaatgtgaactccggttcagtcagtgtcatatgtaatttttttttaaaattaatttgttctgcatgtgtgatttactagttaaggcttataggattcctaatgatttagtaagaatttttgagctgatatgtgtatatttctgtgtgtgtgtgtattgtcttttttttttttttttttttttgctaaatcaatggatgttattctaagattcaccactctttgctagtctaaaaaaacactaatttttaaaatagagaactaactagatatggacatttattctattttctgtttgtggggtaggttagaatggtgataagtttataaggaatccacatatatataaatatggggtaagaagatacagatctatacagtaattagtggtggaaatggaagagaaaagatggtttggaatggggatatattatatgaaaataatacattttcatatacattctgttgattacactggtattcaaaaaaggcaaaaatgttctaagattttacaatgagataacaaaacaataaagatatgttattagtaatacggatattgagaaaaaagtatacatttatgaggcaaattaatgaggccagttgttggagtgttaagtttgatatgtcagctaggacctcaacatggaggtattcagaaagcaaatccagattaaagagtagagaaaaaataagaagggagcctaaagatacccattaaaactgtggtggtaagagagactgcctcacctctcctagctgaaggggctaatactgaggaaagagaagaaaacctggaat

SEQ ID NO: 79452 - DNA, 1056 bp, Homo sapiens
cctcctgccttggcctcccaaagtgttgagactataggtgtgagccactacacctggccaacttgggattttgaggctgttttaatcattcgtacgcatcactaagctagtaaatggtttttagcaacattttgatctgttttcaaaaacaagtatagatcctcctatttctgaattaagaatcaggaaattaagaatttactatgtaactcaccctgtgactatgagaaaatcacatccatcttgcttaccacatcaaacagaattgaattaattgtgcctgttttcttctctgtttgtgtcacctagaaggtattggttgtgctattgcaaatgttgtagtattttggttggatactatatcaatgttatgatgatatagcatgaatatgatgaataaacatggttttcttactaaatacatttgatgatatgtgtatttacttattgttacttatgtgtatgtttaaagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcaggtaggaataatgtccatatccccatctactccgtacacaaaagagaggtgctgtcatcatgacttggtccgtgtgactcactgttggttttattagaaatgcagtacaaattttagttgaattactgttcattattactgtttcccaagcatttatttctcattatcaatgagtaggctgtaggtcttttagtagaactttctactctaataagaacagaggcaaagctgtatttttaggagagaatggccaagtacctactaacacttgtatattaaaaaaaaaaaaaaaaaaaaaaagtcagtctggggcatagactccttttaaaaaaaaag

SEQ ID NO: 79453 - DNA, 1145 bp, Homo sapiens
gtggtggggatatctcttattttagtagcacatagtttacaggatgcctggttctgttaattttatagaggatcatctgttgccaacagaaatcatatactaataagaaacctaatgtattttttctttctttttatagttgtttttcttttggtaatctggtgctttttatttagacagcttccaactctatattctgcttagaattatacacataatatgtgcatatgacacatttttatgtatgtttctgaaatcaccttctaaagtctacttttcaaatcacttttaaaaataattttgtagcctccatatatctgtgataagtataatctacatagtacattgtcaattcaacttttatgtcttttcctctaggtaatgtgtggattttcagcccgacatagattgataatcatgagtgtagtccagggtcttgacattgcttgcccttatccttttctgcagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcaggtgtgtttcacaaaggggccctgagagtggagtatgcctgaagaaatccaccaggattattttcaatattgtttttctttgactttacccttcggtcttagtaaaaagtaaaattatgaccgtatttatttccataatgggcatggaagtacttatgaactcataaggtggatcacaattgcaaaaactaaggcaggaagttattattattattattattattattattattattattattattactattatttgagacagggtctcactctgtcgcccaggctagagttcagtggcatggtcacagctcactgcagcctcaacctgctgggctcaagtgatcttcccaccacagccttctgagtatatgggactacaggcacgtactaccacacccagctaatttttttattttgtagaaacagggtctcatgttg

SEQ ID NO: 79454 - DNA, 1080 bp, Homo sapiens
taggaactgtatggggacaaccagctattgaaatgcatatttatttattttaaaaaattcttttttagaaataggatctcgctctgtcaccctggctggggtgcagtggtgcagtcatagtacactgcagcctcaaactcctggcctcaagcagtcttcccactgtggcttcccaaagtgctgagattataggtatgagccattgtgcacatgcccagcctgaaatgcattttaaaatactaaataatcacatacagttattaacaaaacaatgggaaaaaaacttttacctccttctttctctttgtttatataatttgaaaaaaaaagtatgttagtttactgtggctgctataataaattatcacaaacttgttaccttaaaacagccaaaattaattctctcagagttctggagaccagaagtccaaaatcattatcaatgggacaaaatcaagttgtcagcaggctgctctccttccagaagctccaggggagaatccattccttgcctcttgcagcttctggtggctgccagcattcctgtgcttgtagccacatcagtccagtctcagcctctgttttcacagcattttctcttctgtgtatctgacttgacttctcctatctgcctcttataagaataattatgatagcatttggttccacccatgtgatccaggataatcctcccatctgaagacccttaacctaatcacatctgcaaaggccctttttctgaataaatagcatttgcaggttccagggattagcacctaatttccttggggccccctattcagatgactacagagaactttgaatagatagaatatatgacaaacaggttaaaggttattccaagaatgagacaaccttggaagaatttaccatggtgaagaggaggcaaattataacattaatgtggttaaaattgtattgacagatacaatgctccaaaagtttttgacaaataatcttacatctagcaataattaatggggtcaccagagtagtcttaattatcacctgtgaccattgatgaacgatttttatctctttcattttggcaaggtttgg

SEQ ID NO: 79455 - DNA, 1029 bp, Homo sapiens
gactaacagctttgatttttatttgtaggtttgatgagaagagggcagtgcagcagctgagagcatgtggtgtcctggaaaccatccgaatcagtgcggccggtttcccctcacggtgagcctggcatttttcagatgtaagggatcctaatgggagaagatcctagttctttaagtaaactcagatggttttcttttaataggtggacttaccaagaatttttcagccgctaccgtgtcctaatgaagcagaaagatgtgctgagtgacagaaagcaaacatgcaagaatgtgttagagaaactgatactggtgagaatgatttcgcttaccgtcatctgagcagaaggccttgtggttctgaccttggaaagccccgggaacttttgtataacattttactagtccagatcatttcggggtgggatcagagaggggcacactactgtgtttaggatgctggaactagcgaggatgatagtccaccgtcaggaggcagagctgtgaggcctggacccacatttgaaacacattcttcttagacagcttgattattattgataaaagtgtacctagtacttacatctagaagacaccaggccaaatgctgtgtgattaagaaaaaataaagcttgttctcaggtaatatagtcttacttggaaagtaatactttttaaagacgagtataatatttaactgtagtgtctatatcaaatgctgaatgaatggaacaagaaatcaggggatgacaaagcgacgtccagctatgggaaggagagatttcatcaaagaggtgtgttttgagtcaggccctgagaatgggtaaggttatgcaaaaatggaaggagactattataagagggagtaagagcagggtaagcatagggtttgctcagaaaacagttttttgcagtgtgagatttgtgtatgggacagtagagaaatggttaggaaatgtaggttggtgttacagagagtcttgcagaccaggctaaagagttctccaactttactgtgacctggaatgc

SEQ ID NO: 79456 - DNA, 1035 bp, Homo sapiens
cgctgccacgctccttcctttctggctcatctgaaacctcagatcttccctcttcagcctcccaggtgggatcctcaggtgaggagagcctagagctttcactgtgagatcatacgacaccatccactaaaactcttctccacccagttttagacctgtgactctgcataagcctttcccgaaataattttctctacagcttaattctctcgtgcatatcgtctctcagaccaccccatctttgcttagttttctgtttgttttgtctctatatttgtacagtgcctcggtcagctccttcagaacagggccctcgcctttctttgatgtcttatgttctctgagagtgggaaatgttacatacatgcttagtgcctgaacagggagtagggctttgaatggaggctgagcgctcctcagcttgctgtcctgtgcatgggaccctgtgcctggtgtagacagaaacagggcctgacccaggtccacagcctccagtcctgatcctaggtccctaattttaactcctctctgcctatcctttgtcattctctcattcattacctatactcttttaagtcatctgctacgttttccagtatcttccatcaaaattcccactttatgtgattaaatagccttaaagcaaggttatattgttagttacatatgactaagctcataacaggtttctgtagcttcctgtggggaaaaggagtgggagtataggaatctatatttagcagagtaagcatgaaaatggtagaatttaggcaaattttaaccaaaagccctagcattcttgttttgtggcagctcctcttctgaagatgggtcaagtttataagtggcaaagttttctccattagtgtcataggaagggaatttcccattgttttacctcacctttgactttggacaaagccttgataccctcttctgccctttttcatgcagttcagaaactccctgcacctgcttatggagacactcaatgccactacccctcactatgtgcgctgtatcaagcctaatgac

SEQ ID NO: 79457 - DNA, 1050 bp, Homo sapiens
gattcttgctgttgttgttgttgttgttgttgttttgagacagtgtctcactgtcacccaggctagagtgcagtgatgtgatgatcatagggctcactgcagcctcgacctccctggctcaggtgatccttccacatcagcctcccaagtagctgggactacagatgcatgccaccatgcctgtctaattttttgttgagatggggtttcaccatgttgtccaggctggtcttgaactcctggtctcaagggatccacccacctcggcctcccaaagtgctgggattacaggtgtgagccaccacacctggccaggttctcattcttgaggcatctttgatcagttatctttattctgatttagttttctaattggcttttgagtccttagtcatcataaggtgggtatgcattctgacaaatcatttgcagtgactgccagtctgtgtaacattgtttccattgaagtggggacagtgtgtgatttacctaacatagcttggaggcttcctctgctgctggtctttgctgaaacccaatctaggagtatcaacttcataatttcactgcatctgatagaagccagtatcacatagtgtaaatgtgttctcttggaagtactaattttagaagattaatatctgtgttatgtgttttgagtagaattatttttgtagtaatacagtgtggagtatgtttgtgtatttatgtgttttgtctttttttttcctgcagcctctagcttacaatttgaaaaggagtttaaaaaaatatatatatatatggaattataaacttatcagaaggtgctttatttgatatttttccaccataaagaaatcttctgtggccacatctaatatcaggaagcatataaataaattgcaacttgactaaataccactgaatttcagttctaccaaataccattaaaatgagttttaaccctctactttctgtatagctgattaataaggggaagcacagttcatctactgagtttatgcctcagatctctcatctataaaatagaatcatgatagcatctaa

SEQ ID NO: 79458 - DNA, 1988 bp, Homo sapiens
ctcaaaaaaaaaaagaaaagaaaaaaaaaacactgcaaatgagccaagagtggcattacaataagtacagaatacagtgggaaagttccagacacatgaggagagtatgcattggaaatcttgtggcacgtaagtttcacagggcatggggtcctagaaaatatgggtcatttgatcatcaccacgaaagtcttttcttcccacaaaaatagcaagatttgtgaaagaaccaaaggagacaaaagagataagtaaaggaaggcagaaactccccaagaatgagtagcagtcattagcatctgtagagactagaagtggtggtgtcagctgcattggctgggcagtggctgggcagcaccctgaaacaggagctgtggcagtgattggattgcccttcccacccggactagcttggctgccattcatctttagagactaaatcacacagccctcctcagggaagcctcccctgaccagcctgtgtccaaactagatgaggactcttgctcttatagttcacgttattttcctttgtaatactactacagcttgtgattatattccttatggttatttggtttctgtccgcttcttccacttgtctccaagctccatgagggcaacatccacatcggtgttgttgcccatgtgcagtgactggcacatggtagacagttaatacatatttttatgtgaatggagatgagaagcaatggtgaggacagtggctgaaggcttcatcggaaatagcaatggactagcagttgcagttgctaacagaatttaatgtggaaaccagaaaagtgagtcgtagactccatgactatcacagataatcagggcagtcaggagaaagaccagtcattaactaattctgagccacgtgaacttcagcaccacagtcccttaggagaagtactttgttatgctgaaagcattgcccagcatgattcagtagcctggagggcatcaacatagttgttaaatgccagctaaggcattcctgtgtcccatgttgttagcagcactctacgataacttaagaagccaaaagtacatagtgcagttttgaaaatatacataatcaaaagatcacaaagattgctacattgatcagctatttaaaatatttatatacctagatttacttgtttaccaagaatcctacgtagctgaggttttcctgttgttttatttgctttctctgtgtgtaaatcatgcttctcccgtgaggttgttgttgttgaaagccacagattatctcaaattatgttggtatcatcttgactacattctttgttacaatgatccagtaatgactgctttttttctttttcatttcagcatgtcttcaaattggagcaagaagaatatatgaaggaacaaattccatggacactcatagatttttatgataatcagccttgtattaatcttatagaatcaaaactaggcattctagatttactggatgaggaatgcaaggtaagtatgatttcctggggtacttggtttatcaaaatagatgtatcaaggtcagaagataagtgggttcaaggagagattcattagtatatcatggaatgccgtcgtggtgacaagtaggggttatgctttcattccaaagggacactagaccccaagggttctaattacaagtgaaactaggagaatttccctcctcttttcagctgattctaaattacatgaaaaattgacgttagatactaacaattttagccacttttgttattaatttgtttagtactttttggtcagcgatagaatttaaagaaatgcaagaaactgtgcagaagatattttgaataacagttctaaatagttataattgtaaaactaactagttgttccttattactgacatatttgagagggatggagttgtatctttaatatttaaagatgcaccatgttggaaaaaagcattagatccccagctttaccactgagtgatcgtaggcaaacct

SEQ ID NO: 79459 - DNA, 2729 bp, Homo sapiens
gccacaaatgcccgcgatgctttggccaagcacatctatgccaagctctttaactggattgtagataatgtcaatcaggctctccattctgctgtcaaacagcactcttttattggtgtgctagacatttacgggtgagtatatttggctaattggtctgccagagaacatttctttctagaacttatctagtaactctaagtgggcatttgattctgtttcctactggtaaagagaagggaaactttgcctatgacaattcaagaataccttgatgatggtgatgcaattgcgtgttgcttaaaatttaactaaaacaaaaaaaaatagttcacatctagagctaatttacttagctagtgcatagacttaattggttttcagatgctcatgtggtaaattatcactgaaattctaaaaatctaattttatttgctagtttgccttatttgggtacctgtctttagctgttaaaatccttccttcatatttgtgcctgtttcatacttaatttttcattctctggttctctttttcaaaagaacctgtaggatctctgttcctatttccctcctatatgtgtgtaacaccgtgagtcagtatattgacaagagcaatggctttattataattctgatgttccccacttgggggtgaatgagccctcaaaaactcatagtgttgaacacctctgcatgctggggcctttggaaaaaaaaaacaaaaaaaacctctctgctgcatggctgatgctcatctgctgggtacatattccttgttactgacttagaaatctttattttcactgatatggaaagaaagttttacaatgttggggaatgtcccacttctttcttcctaatgtgtatattttgaatatttttaaaaagctttttgttccttttctccccttttcatattatttttgtggttacagatttgaaacatttgagataaatagttttgaacagttttgcataaattatgcaaatgaaaaactacagcaacaattcaatatggtaagaatgttcttccttgaataatactctgctataaattattctcttgaattcctagtctttgtttaaaagcttatccctggaatgaagttgtgaattaaaattattatatggaacttagaactgacgattaatgaatggtacaacattagaaaaatgttttatgggccaggtggtattcaaggttatccttggattgcagtctgataataacgaaaatttgggacaaatagattgagagaagcaggcagtgtgttaggtaattgcttgggagtatgaagctttaagcccaaggatatctttcagtttgttattttgaagtttattgtatgtggaatcatgaccatcttaatgcttacttgctatattagcaagatgtcagaactaaaaagcagaattttacatattctcttttcagcagtctgggacattcactgggacaatggcaatgtgaatattttgagtggctcttgtgaagtagtaatattaaatatcttagaggagtattgtggttttgggagattcagagatgcttaaaaatcaggggcagcagattgtaatagtgaaggacacagagcccagaggtgaactgtgtgagttggaatcctaccctgtgtcagttatctaggagaccttgggcaagttagttgacctccctgggccttagcttcctcatctgtaaaatggagataataatagtaccttctgtgtgtggttttatggattaaatgagttggaatatgtaaagggtccataatgtgccaggcacagttctaagtgcaagagtgggagtgattcttagtgttgatgaaagaggatattaaaatgagatgcccataggaattagaagatagagctcaagggcaggaaagacacccttaataaatcctcatcttgtaaagagagaggtcaagtggtatggtttgtagttgatgcacacaaaccagatgtttaaagacactgcaagttacaaatttggttaaaaaacaaaagaggatctaaaaatagtaatatagggagaatagtggaagagcgggaaggaggtgttgtatgtgaatttagccttgtttgtgtcataacgaaatcactaggtgtttcatagtgataaatcagaaggtagttgataagcatactctttagaaatatgtaggtaaatatcagaagaaatacctaagggaattaaaaatggttgcctccagggagcgagattggggttggggagagatgggacaaggaattgctacttgtcattataaaaccttttagactgtttgattaaatattccatatactttgaaaaaacttgaaccatctttatttagcaaattaagcttcttaccacagtgaaataatgtagaagtgatcttaaaactttaggcttatgactatttccataataagatgactactaatatgatttgcatctctgcataaagaacattaataaaaacttatcagaaactaaactgagcattattgtttctcaaggtgttcctgagtttcttaatactttagttaatgccacagcctttcactctttcccattgtgtttccacacagagtgactggaatgtaaggaagcaatgccagcctctttaggaactggctagtttgtctgtttttcaagggcctcctgtctgcatgtgtgttttggtctcttgcgtctcttcctctttcctgctgtctgtctctatccacctgtttctcctt

SEQ ID NO: 79460 - DNA, 1309 bp, Homo sapiens
tctgtcacccaggctggagtgcagtggcactatctcagctcactgcaacctccacctcccaggttcaagcaattctcttgcctcagcctccccagtagctgggattacaggtgtctgccactacaagcagctaatttttgtatttttggtagagacagggtttcaccatgttggccaggctggtctcaaactcctaacctcaggtgatcctcctgccttagcctcccgaagtgctgggattacaggcgtgagccaccacgcccagcctgacccacttttaaatgatgccgaattctaaatacatacatatatatggctgcttatttaagggagttgagcaggcagtggtgctgatttgtatctaaagtgattacttgggagaaagggggatgaaagaaggaaggggtgcttgagtgtgaagagtctagagatgaaggtgtcaaggagacccaggttctaatgccaactctgacatcaattgccagctgatttttgacaagctatttgttctcttgggtcctatttcctcagttatccaccagagacaatgttcaccctccctatgccccaggaatgtcagatttgactgatacatgtgattgaagatgttgaaaaatataatgtactaacatggattaaattagacaagtatttatcaaacatctactcatgcaagtctcatggaagatattctagggggtacagggatatgtaaatcatggaagtcattctaatataaaaagtcacacaaataactatcaagttacctgcttacaatccttcagtggcctaccattgcttcaaggataaagaccagctaggatatagcctctgtctgtttctgtgatttcaactcacattttctccctcattcagcttcaatccttcctattgatgatttccttcccaccacagaatgtttttgccagctgtttccttggcttggaaaatccttttctcctcctttcacccagttagcaccttccttttctcaaggcaactgtctcctccttccaaaatagaacatattcctctcacatggactcagcatagtgtccttggtctttgtggtatttttcattttagggagcaatcatttgattaatacccatttccccaagtgactataagttctaggagggcagggaccatgtttgtttttgttttctggtgcatagtagcactcagtaaataattgttgactagctgactgattttttgactgaatgaatgaagatgctttaagagagatacaaacaaatactatgaagagtcaaaggaagagggaatttttgaagtgagccccaga

SEQ ID NO: 79461 - DNA, 1311 bp, Homo sapiens
ccgatactttatgttgaatttgagcaacacacacatactcatacatatgcatatagactataaatcataagatttaataatcagaaataagtattaggaaatataggaaagtataatttatttaaccaactgagataattaaatattaaaatcttattttatgatagaattccctgaattttagattaaaatgctgtaattgaaaactcttcttatttcgaaggcagaagaggagagaaactatcatatcttctatcagctttgtgcctcagcaaagttacctgaatttaaaatgctacgattaggtatgaatatggcattaaatttattgttctggtattgttttctgttaatttccaagttcctaaatttacttgttaaaaaggagcttatctcatgttggaatacttatggataatatgataaaaagtcagcccttggcttcaaaataacccataggggtagaggaggagtaagtggctgtataaatggaacaggattggcctggaggtgattttagatggctgtttaagatgagtaatgagtacctaggggctcattctattagtctctctacttttgtatgtgtttgatatttgctttgattaaaggaaaaaaaaaattaaaggagttgatttgttagaagccagtagggtttcttatgaggggagtaaaggatttgaggaaattattctagtgtgtagattggaataaaacctttaggaaaggactatttattttaccaattaacataaataaactataaatattttaccccatttatttaattaaattttatttaatttttaattttttattaaaatacaattgaaaacacaggcagtcaaactctagatgctgtacactcaactgtgctatcaccacctctgattcagagtggacataaggttagaaggcaaggctttttcataaaccagaaaatttttatttttcttcattacaggaaatgcagataactttaattacacaaaacaaggaggcagtcctgtgattgaaggagtggatgatgcaaaggagatggcacatactaggcaggcctgcactttgctaggtaatgtcactttattcttgagctcttaagaggaatagcttttttactcaagcaacctttgtttagaatattggcttgactttttattaagtggcaagtattgctagaagatttaatattccacatagaacacatttagacagcaaatgggcaggagatttctttttgggatgatggaactgttctagaattagattgtggtaatggttgtgcaactttgtaaatttactaaaaatcat

SEQ ID NO: 79462 - DNA, 1860 bp, Homo sapiens
ctccatttagtaaagaagagtgactcatgcatcattacattaaaacagtaaaaccaagattaccaagatcacaaaatttattttttcctttagtggcttcttgctgattaaagtgaatatagtattagggagtctcttgtgaatacagtgcttatatggcagaggcaacaattgagggagtggacaaaagatactgtttatgtatagaaatttctttccctatcagtttcagaacttagaatcaaataattttattttttaaaaagaaccctagagctccactatcctagtcaatttacatttgaggatactaatgctcctcaaagagattaaataatgacaagttgataatagggcctggtctgataggtcttcgggcttctaattcatttgttctttttaccattgtttgtctatgtttaaatacattttatttgaaaacaaaaggatctgcttcaattctagccaatccctgcctcttctcacagtgtggtggtgtttcggcaggtgggccactctgacgcccagtctgagtaggtggggagagatgatatgtggaaggtggggtaagagttgaggaaggaggagaagctgtggcccacccttcctccacttgcttagttactggcaggaaagtgcttaggacagttactaatatttattgagtgtttattgagtagctgctgctacttctactacatgtaatctttcatttgctcttcggaagaatatattgtgttgagagaaaagtctgcatttataattaatctgcttttctaaataaaatagtgagaccatatacagactttttgctgtggtgttttgtaatatcaagaggggtaacatctgagtaaatgaatagataaattatctgaggctacattagatccttctgtaattttgccaggaagatattcttatttttctagaaaagcatttaaaatgttaatctaaaatatagcagtgtcctcactgccaaaacaaaataggatgtctacactctatttcagaaagtgaaaatatattttctttgattgatcaaagaatctaatgtgttgacttgtatggctgtgttactattgttttcattacttacatttgtatcactcttaaaactacattgtattttcacatctttctgtctgctgtggtttcaatttactaatcctgacataggctttacacaagtgaaagatattaatttttttgaaatttgcttattaaacatttaatatatgcattatgtaaacacttggttttctaactacatcttttttttttttgctttgccttaaaaaaatttatagaagcgagttacctaaatcagaaagacatatgtcattaaaatttttaaggttatataaaacatttagcagcaagttatattctctgtattctgtagcagatattttgtaagctagatttaactatcaaaatccaaagccaaattttactttttctggttctgaaaatggcctttaaattgagtgggtaatactaatactctactaataaatagtctaactggacctttgttgccacaggataaggtgatagaaacatcaggctaaagagaccctgaacaccagagcagcatttccaggaaatattcattggtcttaaccatcttatttatgtaaagcaggtgaagttttttggaaaaaaataaaaacctgaagcttacctaacaaagcctatgccttggcagctcccatcctcgtttgttctctttctttgctggcatgaatgttcagataacccaaaaggttttatgaaaatattctaacctctgagttcaggtctgctgtttctgaaaatcatttttgtgagaataacaagacaaataaaaacaattagtat

SEQ ID NO: 79463 - DNA, 1009 bp, Homo sapiens
tgtctattaataagatttttggaaagttatagttttatatgaagacttattaaatggagaaaaattacttttgttaaatggagagaaattaatttggacatgcagaagcaaaccttccttgttaaaaattcaaatcggcatttttttattcctgtctttttcctttgtcaagctttatttgtcacccaaacacagatggagttaaaatcggcctggtgcacctgtggtacaagtggtttttgcgataatctatgtagaggtaattgtgcttggtttgcggtgctgcgtgtgacacttcagaacagaatgccgtgacctcttatctgtagggctgctctctagagcagcaggacttctactttttgggattgaaaaacaagatatgatggggaagttcagaggcttcatgggctggatgtgctatggaaaaaaatactgggaatactttctgaaataggatgaacaggaagaaacagatgtttgcaccgaaagagagtagtgaaaattttaagcaaatgttaagattttgaaagaatgtaagctacagatacactgctggatgtcactagtgttaatactggggaaatagaatctgtggagccagtttttggtttggggtcagaaaacaacagggcttcttttcttgctgttgttgttttgactggttttggtcatgacaaattcttggtatttgacaacagttccagccattttagtccctagcattagaatatcccaaagtcttgaatgtgatggcattaggtaatcccatttcttccgggcctggaccatataatactaggatttgaagttgtctgtgaagataacttaagtctagaatgaaccttctagaatttttcatgagttgagtgtactattttatgacctctttcaaaaaaaaccagctttattggtttttctgcaacacagatttgaattgtattagtaggaatatattaaaaatttggaatagctactgtcttagtccatttagtgttgctataactat

SEQ ID NO: 79464 - DNA, 1185 bp, Homo sapiens
aggctggtctcgaactcctgacctcaggtgatccacccacctcggcctcccaaagtgttgggattacaggcatgagccaccatgcctggccaatttttgtatttttaataaagacggagtcttgccatgttggccaggctggtctcgaactcctgacctcaggtaatccgcccgccttggcttcccaaagtactgggattacaggtgtgagccactgtgtccggcctaaatctgatgaatgaataagcatatgcacagaaaaaaacaaaaagcaaacaaaacaaaaatctcatgaaaactatgaattgtcttgcctcaaaaaaagtacacatatgtgcacatacacacagagttgttgcacgtaatttcaggggattcttgggtatctagtggtttaaggattcctaagtacttaccacatgccggacttgcctcatttacttttttaccacaaccctgttagcccattttacaaatgaaggatttgggtgaaatactgtaactcaagaccacataaaaagtaagtattagtatcaggatttgaatcctgggcaatctgatcctagagccaagctctcgaccactcttttatattgtccgccacttttttataggtaaaaggggttggaggagagaaacatatttaaaagtttaaaacttctgattcagtacgtgggtgaaaaaggtctaggctatggctttcaaagtatattagcaaaaattgttaatacaggttggtatgtctaatgaaaacgcacttcatattgtttccatctccaccagtttctgtgatattggaaggtgctaggaaaataatgcatttaatagctgagaagcaaatcaggaataggaagtaagcaaaatgcatgggcctctttcacagtccttgccataattcatccagatgctgtgccttgtgcattttcaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtaagtatgctttgctttccgaatagactgtggactctttcctctaatggacatagccatagaaatattgtacatggggaaagca

SEQ ID NO: 79465 - DNA, 1018 bp, Homo sapiens
tcagaattgctaatccataccctattataagaagcagatttgccaaccagagtacagtgtctatgtttaattttattaatccttagtattttttaaaaatctagaaatagaatgatacatacctttaataaaagcaagactagggacaggggtcaaacaagaagaacagacattataaaattcctgaactattcaagaatcattctctttttagaaactatagtcacttagggtcctagaataaaatagagaaagcatggcttttgtaatagtagaagagtatatttatttaatgatgtccagtgattccagaggagcagtttatgtccatttaaagcctaactccaagaaggaaatttctgtgaagatgttacagatcttctctacctttcaaattagtgtcttctctaatatttcaatttcagcttctccccacactagccacaaacaaccccaccctgtaatgaagactgaggaaagagctctgggttgcccttctgccattctggagtctcctggctaataccagaacagacaattgtgtatttacagggccaatgcaaggaccagtcagccccaggcaagggtgatattctctgataaacaggcagcaagaaatgctgagtggtaaattgttaatttttctctcctttagcataattcgttcaaatatgatttgaatatttgacctctgtatatatttttagtattaccataactggctttttacaaaaccttgtccctccctacaactaaattgaatttttattcctattcacttgtcctatgttatttgcccctttatatagttaagtgacaatattcatggttggctgtgccatgaagccgtattcccgtgactttaaagtgaatagtggctagtaatggtcactcacacctgtaatcccagcatttgggaggccaatgcaggaggatcccttgaggccaggagttcgagatcagcctgggcaacatagtgagacccccatctctattaaaaattaactgaatagtactt

SEQ ID NO: 79466 - DNA, 1569 bp, Homo sapiens
cagccatgattgattgtgtcatgtctttcccttgctggctgaatctaggattcctgttttcatatgtgatttgttcatgaaaatgggcatttaggtttagtgtatgtgtgttttaaagggaaatttcttcccagagagtccaagcacataaaaacacttcttcaatgtggtattcgaaagatttgtgcatgttagtatattttgttctttttcttcaaaattgaccacataatcttctggcttatgtccagggagtatctagttgaggcaaaatatttgctgctttgggaatccctgatgattaccatgcctttttcatgatgttgaggctacaggagctaagcttattagtgactggctgtgccatttttaccatttcccactcatctttataaaataatgaaggcaaaatgctgaacaaccgtgtttcttcagttttaaaaaatctgttatttttattctcctcttctccctactgtgatggctcctgaaggatgtctgagaaatcactaaggctttgcagagcacaggatgcaaaccaccataaaaaaatccaaattgtgggccgggcacggtggctcatgactgtaatcccagcactttgggaggctgaggcaggtgggtcacgaggtcaggggttcgagaccagcctggccaacatggtgaaaccccgtctctactaaaaatacaaaaattagctgggcacagtggcacatgcctgtagtcccagctactcgtgaggctgaggcaggagaatcacttgaacccgggaggcagaggtggcagtgagccgaaatcgtgccactgcactccagcctgggcaacagagcgagactgtatctcaaaaaaaaaaaaaaaaaagaaaaagaaagaacaaaaaaatccaaattgtaaacccagccataaaaagatggcagtgctgttgaaactggcagaaccacaacaccatagcttcaaaaatagatcttatgtgtacattttaacctaaaattatactttcaggtggcatttactgtgtaaagcaaagtcaagctttgatcataactgttttttcagagcacactttttatataatttgggaatggtggtgctatgagagctaaaatattttttgtttactaatttaaaaagtaaatttcagctggacgtggtggctcacacctgtaatcccagcactttgggaggctgaggcgggtggatcacctgaggtcaggagtttggagaccagcttggccaatatggcgaaactccatctttattaaaaacaaaaaaattagctgagtgtggtggcaggcgcctgtaattccagctactcaggaggctgaggcaggagaattgcttgaacccaggaggcagaggttgctgtgagctgagatcatgccactgtactccagcctgggcaacaagagcttaactctgtctcaaaaaaaaaaaaaaaaaaaaaaaagtgaatttcatgttggccaagatttcttttttcataaattgtttaattataaatagttatcatatgtttatatatgattgtaaaataattgatttgctagtttaaatttttttctttttgtc

SEQ ID NO: 79467 - DNA, 1042 bp, Homo sapiens
gtttctctcagtcatactgagaacccgaccacccaatttggatgattttctctatcagttcaatcataccacttaacatcttagggctgtcagatttaagggaagcaaagtgtactcttgatctctctagatgtttggaaattactgaatgagaatttcataaccttttttttttttttccaagacggattctcgctgtcgcccaggatggagtgcagtggcacaatcttggctcacagcaacctccacctccagggttcaagagattatcctgcctcagcctccagagtagctgggactacaggtgtgtgccaccgtgcccggccaatttttgtatttttagtagagatggggtttcaccatgttggccaggctggtctggaactcttgacctcaggcaatctgcccaccttggcctccgaaagtgctgggattataggcgtgagccactgtgcctggccgataaccttaatatctaattatttgtgctgcttcgttctctagtaattgtcttatcatgatcaaggtgcaagcatggccagcagctggcttgggtctaatgccacttctgtgttcttttcttccttgaggatttctctcggtgatctttttggtacttagtatgcatacagttgtgctttcaagatatcagatgaacactgcagccttgtattattcgcctaacctgtagtatatatttaaaaatattaatgccacaaagtagaaattgtgggttttgatcaaaccttttttttttttttgagacagagtctcgctctgtcgcccaggctggagtgcagtggcacaatctcggctcactgcaagctctgcctcctgggttcacgccattctcctgcctcagcctcctgagtagctgggactacaggcgcctgccaccatgcctggctaatttttttgtatttttttagtagagacggggtttcagtgtgttagttgggatggtctccatctcctgacctcgtgatccgcccacctcggcctcccaaagtgctgggattacaggcatgagccactgcgcctg

SEQ ID NO: 79468 - DNA, 1077 bp, Homo sapiens
accaaaacaatctatagagtagtcagggtggactttttctgagaaaaacgcatatataaactgagaccagaagagtgagaaggaactagtcctaagaagagatgggaaatgaggggaaggtgttctaggcagtgggtacagcaatggcattgaacttgtagtttgggtgttctaggaacaacagaaggctggcacagccagagctcaggggaagggagaagaccccagtgagttgctgttaaacctgtgggtaggggccagatcacatagtacatcgtagagtatagtaaaggaattcagatgcagcacaatgaggtacctgaatcggggtttggcctggggttgggctggcgacaaaactgtgtagtggttttaagccttatctaatttatctgcatcacaactctctgaggcaggtattactaataaccagttttatggatgagaatcctgaggaagaaagttgggtaattgttcaaggtcacacagttggaaagtattggagcttctggatctgtctaactccagagcccatgttctcaaatgtaattgtatatacagtctaattggtttattttgtaagtaagggaattgagattcagaaaaattaaaaataaactagaatgattaagaggatgtgaggcactgtttaaaaaatttatgctcttcttccatctggaaagatgaagaatgaacttttgatctggtggaagcttctaacactatgaggcacctgaagagggcaatgctgacttattcactacaaaaatagcttaggcatcttttgaagcttcagataagtaattcacaggtcaaataaaaggaagtgcttttgatacagttggtagctgattatttcagatacagattaacaatgtttccagtagcttttaggaaatctgtagaacaagttagcaaaacagaaaacctcttctgtataaagcatactaaaatactgatgaaaatgtctgtaagagaagtttaaataactaagaaaatgaggaaaaaatgagtacagggaaaatgaaattttataataataaaaaaagaaagcaattttagttgtaagttttataa

SEQ ID NO: 79469 - DNA, 1045 bp, Homo sapiens
tggggagtgggacatgtttttccaaattatggattggaatggatggggaaggaaaactgagtgctgagaatgggttttttagaaatttctaggcgtgtccttgcacccatagttttttgttgttgttgttgtttttaaatatattgctgagtctctactgcctcccagatgtcactttttctcttccctactcctgaaatttctaaggcattgctaccatcagtgtatcataaattaattcacagtgcttgccatactcacggtcccttcaaagggtaactgtacccctcactctccctgttgacctggggcccctgctaagaaaccaaatgatccagccaagctgattggacaaggggaggccctgacctgaaaatggctcactcgtaagggccttttgatgtggcctggtctcaaaagggcagtctaaacagaagtagcaatgtttaagtgagccatttaggtgtcctgttttggggatttctgtaacaagtatggaaaagataaaccagaggagtggtgtagacacattgacagttctgaccccattagcagtggtgtaccagaaaagccaccaattcctactcatgggcttccagggcctgccttggaaccaacactttgcttcggttttttcctctatgtgacttagctcttctctggttccttatcctgttgtttcctctgtattcatatgtgtgccctgctcatccttcacctgagtgagcttgagtatcagtccattgcaatgatagaagcctaatcacaggagaccttagaaacctggaagagccacgggcaggttggtagtccaggggcatcaggggatagagtcactatttagggccaagaaattaggaatctgggcctcaggctccttgccttgagctgccgcaactcctctactaatggaccggattcacttaaaaaaatttttttaaagccattttaggttcacagcaaaattaagcagattgccctcctccacagtcttaccttttattaaaaaaaaaaattatgaacaggaaattaatgttagggatat

SEQ ID NO: 79470 - DNA, 1012 bp, Homo sapiens
atacaaactcctaagagtttaacctacctgtcagacttttcttttttcttttttttttttgagatggagtctcgctgtgtcgcccgggctggagtgcagtggtgcgatctcagctccctgcaacctctgcctgctgggtccaagcaattctctgcctcaacctcctgagtagctgggattacaggtgcccgccaccatgcccggctaatttttgtatttttagtagagacagggtttcaccatctggtcttgaactcctgacctcgcgatccacccgccttggtctcccaaaatgctgggattaccgacgtgagccacctcgcccagcgttctgtcagacttttctgttccttgtagctgaaagcattcctaatgtaagatgtggcagcttcaatgtgaataaagttaatataaaattggagaatttgtctatatggtgttatttaggcacagaaatacaggtaatatgggaatatgacagcattcgggggtgaaagatcaattctagtcatgctttggacattgcaaaacatgggtattaatgccaaagaatccagtcctagtcataatttctaggttttctggctacctcctcagtcctttcccactgtacttacggcattttaaagtgttatcttccccaggcttagaaacctgaacatgacagaggcaaggattgaagtttcaataatatgggagaagctagctgggtatgagtaagagtgagtgggtggaggacatcaattaaaggatgagtgtgtagaaacatatcagttttctaaccatggttgtttctaggatatcccaagtttatggtatctgcaaattcttgaatttcagtgggggaaagaagagaacaagatatttaaaaaggcaaaaaaaaaaaaaaaaaaagaaggagaaacagcagcaacagcctttgaaggtctagaaaattttcatgcaagcgttaaaagctccttcaacttagggtttcacttccgcctggtttctgaacacttatgtgaagttg

SEQ ID NO: 79471 - DNA, 1066 bp, Homo sapiens
tccagtattttggaagccatataaggatgagttgtattataacctacacattctcatgttagctgaggagactacccctgagtaattaaaggcactcaagatttgtcaagctcttgcatgcatatttaatggaatgatagcctcattgctcagaagctgttggctttagaaatggaaaggttgacttaggctaaaggaaggagaaatatagcagaggcagttattcaagaaaaaaacacatgtactgaatcaggagaagtaatgtgggaaataatctctgagacagactgcgatctggaaagatctgaaaaggagttatttagttaatgtatttcaaataagctcccctggtttgcagattccgtaattaaatgtttctcataatgagtttacaactgaaatgtgtctgggaaactggccaggggttttaaggagcctggttcttcagaaggcattcacttcccttgggtcagaggtggcatctcctagggttgaagagttttctgagtctgtgtaaggagcagtgcctttgtctcaggaaaatgagaatagtctgtggaccatgcagaagttgcctcctcagtcactgcctgtgggagtcattgaggtccaatttgtcttttggagctggggcctccactagggtgtgtttaaggaggatctagacaaaacctgtatagtacagcttagctggttagattgaggattaggatgtctcatttgagttcacaaaaaatcaaagtgatgggtacaattaaatgaaagtcagtgactgtttcacaaatctgtaagactcatttgtaatctgtgccattctatacattagacttaggtcagcggtccccaacctttttggccccagggaccagtttcatggaagacagtttttccacagacctggggagcaggtgtggcgatggtgatggttggttttggggtgaaactgtttcaccttagataatcaggcattagttagattctcatgagaagcatgcaacctagatccttcgcctgtgcagttcataatagggttcatgctcctatgagaatctaatgccactgctga

SEQ ID NO: 79472 - DNA, 1082 bp, Homo sapiens
aactggaacaactgcctcacttatattaaaacataattgagagtcttctatggcaaaagaagttccattacctttgctaataataggtgtgaaatagtataggaaatcactcacaaaattacttgggaactcttttcctttaaaataaactatttaaaaaggtataaaaataataaatgcccagggtagaattttggaacattttgaaatgcaaaagaaaaattgtatgtaatctcactgtcctcagatactcttaatgttttgatgtatgtccttcttgtctttttccctatatatatatatattttttagcgaaatgatttactttatgaatactattttctctaagaagtatattgtgaaggttttcccatgccaatacgtgttattctacagtgtgtttttttcatgacctcagagtattatattgcattaatcagtcatatgttactgaacgagacccctgcgataaggacttctaattttttgacagtttacatttaaactgaagataaccaaagcctttgtgtgtttgtttacaaagaaataaattgtagtcattaattaatttaactgtaattgcaaaatatcccatttttctactataacaatattggaacacaaacttggtgaattatgatatcaattttttttttttttttttgagacagtcttgctctgtcgcctaggctggagtgcagtggcgcaatctcggctcactgcaagctccacctcccgggttcacgccattctcctgcctcagcctcacgaacggctgggactacaggcgcctgccaccacgcccggctaattttttgtatttttagtagaggcggggtttcaccgtgttagccaggatggtctcgatctcctgacctcatgatctgcccacctctgtctcccaaagtgctgggattacaggcgtgagccactgcgcccagccgatatcaatgttaagattaatctagttagatcttagaagaccaaaaaacaaacagaaatatcaaagaactcaggaataaatccttaaaaataattatatatttgggatctcagagtatgccaggcacaacagcttacta

SEQ ID NO: 79473 - DNA, 1065 bp, Homo sapiens
tagagaaatttcagaataggagaagtaaaatgatcagggcagtgaagaggctagacagattaaaggtgtcgaactctctagtttagaaagatgaaggtgagctgggaatacagtagaggttttttttttttttttttgagacagagtctcgctctgtcacccaggctggagtgcagtggcgtgatctcagctcactgcaacctctgcctcctgtgttcaatcgattcttctgcctcagcctcccgagtagctgggactacaggcatgtgccaccacccctggctaatttttgtatttttagtagcgatggggtttcacagtactggccaggcgggtctcgaactcctgaccatgtgatacgcctgcctcggcctcccaaagtgctgagattactggcgtgaaccactgtgcccagccctatagtagactctttgacatccagaatagtggaagtttgtaacatcaaatctcagtttagtagggatatgttttagatcttgaaacaaatcaatatatgccattttaaatgaatttctactttaaacatttacattttacatttctgaaactcatcacttcaagttatggtattagctgaggtacaggatgtaaatagagagggtctgggtaatttatggatgagaggtttggcacattgacttaccaaacctctctttaacagtgttagtcagtttaccagccacagctgttttagttggaagaaacagaaacccaaactcaaagccaaagaggagtttatttgctcatgtgacttaaaaatctaggcatggctggaatcaaggctcagacatggtcattggggctctcttcactgactctcacatgctgtctgacattggtttcatcctgagggcagctttttttaggggtgaaaagatggtcagtggcacctgcagatcacatgatcttacagcactgggcctggaggaagagagcctgatagaggaattctggtcatgtgccttctcctttcattgggcctctaggcagtaggtgaggagcaccatgagtggtcaagtctgtgctcaccccagagaccagggg

SEQ ID NO: 79474 - DNA, 4025 bp, Homo sapiens
aggagttcgagaccatcttgaccaacatggcaaaaccccgtctctactaaaaatagaaaattagctgggcgtggtggcgcatgcctgtaatcccagctactcaggaggctgaggcaggagaatcacttgaacctggaaggcggaggttgcagtgaaccaagatcgcgagcctgggcaacaagagcgaaactctgtctcaaaaaataaataaataaataaataaaaattagctgggcgagttagtcacgcctgcggtcccagctactcgagagctgaggcaggatgatcagctgaggcaggaagattgcttgagcctgggaggttgaggctgcagtgagccatgactgtgccactgcactccatcctgggcaaaacagcaagaccgtgtgttgaaaaaaaattttttttaacctctttgtcattataaagacagactggcttagagatcaagactgaagttggggcttacactgccttcttctaaatatacttatgcctaattaatagtctggttacttggttatttgttggcaaattctttttgtgaatgggccttagcttaatggcaagcagaaatacttatcaggcatcctgtgtgccaggtactttgcttaatgtttagaggatttaacaatgaacaagatacagtcctttccctcaacacgctcatagtctgcttcttacattcttgacccactttgaatctataggggcataaataacctgctgttacctcaacagcaggcagacagctggtatgatatttattagtagaagttagggaatgggttgggacatggggaaggttgggctgattccagagataaaaactactattgtaattactagaggaataggaaaatcattagaagtattatcagtggataagcacaaggatcttccccttgcagaggattataggaaggaagttctaggatagattacaaggaaagatgtattagtgatatgccataattatggtatttaacattgtggttaaatctgaaaagtgctctttaaaaaaatgtcattcagatcttaagggcagattttaatgtgtgatacagatcagttcctattacagtgaaggacaagagactgttcaatttcttctttttagccagaatggtaatggttttgtcacagcaatttaacaaggcttccattttgtaagtttttccagcagtataaacattttaaggacaatagctaggttcttgggatacttgtctggaaacgaatattttggttaaaacatgttttgttgatttttaaaaataacagctttattgagatatgtgtcttataccatataattcaccatttaaagtgtactattcaatggtttttggtttattcacagagtagtatgttgatgtgtttgtggtcaacctgccttgctcccaaaagaattaaaggaaactatgatatctcattgcttctgattttgaaaatatttgctagtcttgacttgccagtggatatctatatcatacatcatccataggtgcttttggtaactagaagcaattctacatttgtggagtagggtttatcaattagacctagaaggattatcgggaacattataatgaatggcatgctattcctcctgtcatcatgttcccagacaccatggatagcaccatggtatccatgctataggatggtcaagattacttgaagctgggtttttttttttttaattttttattttttttgagacagggtctcactgtgtcacccaggctggagtgcagtgaaatgaacatggctcactgtagcctttaactcctgggctcaagctgtcctcccacctcagcctcgtgagtagctgggaccacagctatgcacccagctaatttttaaatttcttctagagatagtctcagtatgttgcccaggctggtcttaaactcctggactcaagtgatcctcctgcttccacctcccatagtgtgggattacaggcatgagccaccacacccagcctattttatttatttatttatttatttatttatttatttatttaggttcagggtctcactctgttgtccaggctgaggtgtagtggtgtgaacatggctcattgcagtatcgacctcccaggtgcaagccatcctcccacctcaccttcctgggtagctgaatctacaggcatgtgctaccaaacccagctaatttttgtactttttacagagacaggatcttgctgtgttgcccaggctgatctctaactcctcaggtcaaatgattctcctgcctcggccactcaaagtgttgagattacagacatgagccaccatgcctggcttatttttaattttaaaaaagttttaatttttttgtttacttttgtgttttgttttgtttttacctgaagctgtttgattaggaggttcccatgtgtgctgagatgctgagtattgtaacagtgcaaagacaatctaaaattccacatttgcaaagcatgttaacttgcctagatgaaacagctcttaaggtcagtagattgtatatgtgtaactttccattcccaacatatcctctcatatatacaggagccacatggcctagattttttctgggatagatccacttttatattctatggcactgtctcttcaaactactgatcttggaaattctaatattttcatgtcgagactgtatttctcagactgcttccaacatcttaaagaggaacagaaatctcatctctgatcatgtgccctgacttggagtttggcaaggatgttagctgtcctcaagtctcctgtcatgccctttccatttgaatttcctcctggtgttcctaggcctgttaacgacttgctgttctcctagttccgcagcttggaaacctccgtatcttttttcttgtctttcacattcgacttcttctatatcaattctaatttcagttgacatccagctgatagctcagatttggaactcccactagtactctttttctctgtcttaatgtcccaaacatgtttctgtcttattacggttactgtatttgtgtatatgtttaccactcccacgatactctaagccccctgacatgctgttttgtttacctcctgtagagcctagcccagtgttacacagaatagctgctcattgaatatttgttgaatgaatacttaagcaggggagggatggaatgaaaataatggtttggcatgatcagtccacttgtagggacgaagcagggtataaagatgtggttaaacaagtaaacacattttcaggcatgttgaacaggatgagtaatagaactgggaaccagggagaccaggaaactttcaggaaacaaaatgtgaagtggtgaaggtctggtggactgaggcaggggcagaaggtgtgggaaagaagaggataaatccgagagacaggtctctccgagatggattacatataggatgggaaggagcaggagtagtatgaaataatgccagtagctccagacttggaaactgaaaattaattcctgtttcatcacaaattttgactgcctctgtggaacttgaatgctactaagaaatacttctttacatagcttgacaaagcaaaatgcccattatttcctcttgaaatttgttactgtttcttgaagtgtgaaagttttgtgtattgtccagaaaagattacagagagattctgattctaatgagaattgctgctgccacatattttagatcttcctggtacttttagctttttttttttttttttaaataatgaaagagaactggaggaagctttatgaatgggcttccagggatttaactgtaacctcaggggaggggtgacagggaatgctaactcgtgtatgggagaatgtgggagaggagagatgatccgccttacttcttacctcagaaggtaatttagtttctctgtttttcattttatgatgaattttgcctccattgggagaattcaggagtacgtggtccactagaggatagacttggatgtatttgtctccacttcaggcaattcccagtgaa

SEQ ID NO: 79475 - DNA, 1044 bp, Homo sapiens
tcggagtggaaagggggcccatgtggatttagcagggcgggcgtgcctcccctcctgcttggctttggaaaattcccggcgggtgggagatgcttgctccagtagatcggatgggttctctcgtggggacacgcgcttaaaataacgtcttgtgttggtatgcagtgccgcttctaccgccagctagcctttctgtgaggttattttgaatcctgcaaacggtggccgtatcacctttagctccccagtttagctgcgctgggggtggcgagccccggggaaagatgctgccggatgaacgcgagctgattcaccggctgggagggtcggtactcatttatcgctgggagtttgcaacctgcgtgtaatcccgcagagccttgttaggctccatgtctttaccatcctctggggcaagcctttcccttctgggtttggtttaagggaagtggcagtcttttcttagactgacatcaatatactcagggtctggcgatctctgaatgacatattatggagaactgtcacttgagtgctgcgcagatttgtgatgacctttgtgaatatatgtaatcatggcattttatactgtacactcatgtgtaggtagatattttgccagatattgattacttctacatgcagttaatagagttgccttttcacattagcttttgcaacagaactttcatttagggtcctgtaatcactggaatcattgtttccaaatgtcactgaagtccagggcccaagttgcagtgtgttttgtagaggaaagaagactgggcatcaagagacctggattcaagccgggacttactaactgtgaccttggacaagtcacttaacatctctggttcgatttcctaatgagtaaatgcagttaattatacttgccttgcatcccttacaagctgttgtgagaatcaaacttaataatcgttgtgaaagctttttgtaacctatgaatttctctgcaaatatgagatatatgattaatttcttcaaccatgaaatgagcttgcatgaaacattgtctgagac

SEQ ID NO: 79476 - DNA, 4039 bp, Homo sapiens
cctcaacctctggagtagctggagttacagatgtgcaccaccacacccagctaatgtttgttttttgttttttttgtttttttttagtagagacagggtttcgccatattggccaggctggcctggaactcctgaccttaagtgtttcgcctgccttggcctcccaaagtgttgggatttcaagagtgagccactgtgcccagtctgaaggggggcttctcggctgttgacttatgctggaactcagtacagagactatttcatctaattaatattcctgtttaaattcttttagaccaaccttatacggacagtatggggttgcatcgacatcttaaatcagtaattgctaagctctaatctgaattttttttgtttttacttatagcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgctactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctgga

SEQ ID NO: 79477 - DNA, 1631 bp, Homo sapiens
taaatcaagactgttgttcaaagtgaatagatggaagaattgatagttctgtcaggaaacaggtttttgatatattaaagaataggatgtttgacatgaacagagtttgtcattttaaacatgggggagagttaggcaatgatatacatagatgtgaggattgacaaaaatgatgtttctcttctttaaaaataacaggatgggccaggcatggtgggtcatgcctgtaatcctatgactttgggaggtcgaggcaggattgtttgagcccaggagttcaagaccagcctaggcaatatagcaagaccccatctctattatttaaaataataaaaatattaaaaatttattataaaaaaacaaatatcaggatcatctgtattcaagaaaaatgtactgataagtaggctgctgttaatttctagtaaagaatctaacttcaaatcatacataattttagataaatagaaaaaattctgtatattttaacagtattaggatgattctctaaatataggcaaagaactgaagagttccatagaaggtgactaactataaatgtattatacatgactggaaaagtaatggcaagcaagacttcagagctgagctatcttgatatttttatccagtgtgtggggtgttacacatgcatcacagctataatagagctatcacatggatcttttgaaaaacaagatagagatgttttaaaggcttctgggtttgatttcttagtcagatgctgtggtacttggcatttaacaactagaattcagaatccagatttttaaaggtgaattattttaaataactgagttgtaatagagaagtaatttatttgaaattattttaggaaatggaagataaagtgactagtccagagaaagcagaagaagcaaaattaaaagcaagatatcctcatctgggacaaaagcctggaggttcagatttcttaaggaaacggttgcagaaaggggtaagttctcatgggtaatttccaaatacttaagccctacaaactcagtatgctgacagattgtgaaacggatatctgtgcgtatagcattgtactttatcaggtatgtacatatgtgtatatgtatctgtaatgggtttttccaatattttgcagtttataaataagcattgtgagaatctacaactcttcagcatttttaataataaactatttaaagcatgtagaaatagtgcagatataacagaacccatataccccttcccagatttaatgtttatattttgccatgttggtttcagttttatctttcttaagaaagaaaatgttgtagatactgttgaaacccaccctatatgtaaatatgagccctttcccttatctctccaaaagcagccactatccagaagctggtgtttatccttctgcccatattttgaaacttccatattttttgcaggtgattcccacacaacattcaaaagcttaaaatacttatttggatgaaatgatcacttaataaatgcacagctatctcctttatgtaatatgtttcacagtcagatttactctaatacaatttaaacattttcattttcatagttcaaattactgaagatattattttcaaattcttgccatgttttgcgag

SEQ ID NO: 79478 - DNA, 1540 bp, Homo sapiens
atgcctgtgatccagcactttgggaggccgaggcgggcagatgacctggggtcaggagttcgagaccagcctggccaacatggcaaaaaaaaaagaaaaagaaaataagggaatgcccggattgtgtacaaggtattttcctttatatatcaaatggaggaaacctgcagaaacactggaaaccagagtaagttgctacctacatacaattttcctttaaaaatttttaaggaattcggggaactattagacttggagaactatttcaaatcaaaggaagaagtggagagctctcacttcctaggctcaagaaagctgaatttttattggaaatgtaggactccagtaacacccttaatttgaaggtgcagggactaaagggtgacaattagcttgggatccttttcagccaaaattatttgaagccagctgtgcagggaaacccaagagtaggcctctcctcccacatccacttctaaactgcagcactgagaacacccttgggctgcagtagatatctgcagtgagggctgagccacatcgaagctgtgcagtgactcagcccgccttcctacattaaacttggtaatcttacatttatgtttatttctctggctttggtgatgaatatggtatagtcatatcttacatggggttaggttctaatgttagtaagggaaaaaaatcacatatagctaaaatcacccttgacaaaattctagagaaggcataatcatattggagactgccccatcaattctcagtagagcaggtagtcacttttatgtccagcgtttgaacagatggctagatggctagggtgattcttaagttgagtgctagctaaggtaataggcttgtattgtacgggctgagattttaaacactgcaatgataaacagcatgttgatgtacttatgctctgcaagatacccaacgagagactaacgtgggaatggcaggtttgcatcacatacctcacacttacctctctggagcatacccttcttgaatggaatgactggtagactcaccactatttaaattctctatttctggctaagtgcacataattgaatgtcgtgcatgtcaagtgagtgaatgacgtggccactgtaaagagataacataaatggatgaatctgcaacataaaaagaggctccacagaaaacagtatttgacagaagcagcttttttctcaaaattctccgagactgaaaatgagaagatctaacaacaaatgaagaagcagttcaggatgaaatactgataatatataaagtgaatgaagctgattataaaacatgtatgagagctggatgtggtggtgcatgcctataatcccagcacattgggaggctgaggtgagaggatagctttgaggccaggagttcaagaccagtttgggcaatatggcctgacctgtaattttttcccccccgtgggtacaaagggaagggaaacaggatcttcatcttttttttttttttttaatgtatgaatataattttgagtgaaatatatgccaaaattttatga

SEQ ID NO: 79479 - DNA, 1066 bp, Homo sapiens
acttaaactaaaaatatggtactgttatagtattcttttcttttttaactccacatgataaagatattaaaattacaatattgacttgttatcagtatatgtgtatgtatataccaattttctttgtttagtaatagtcattcctgtcctttatcccttacatcctaacctatttaacccaaagcttgattagtttatgatttaatctttctgtgattctttttggaaaaaataaacaaataaataactattggcttatctcccctttgttttcattctagcttaagtaaatgtttaggaattcccttgaggtccagaaacgtggagtcacatcaaattgtgttctattttgcatttttgaacatgactgtggataaatcgcttattttacctgcttttatcagtgtcctgttgggagacaggagcagaaaccactttgcatgtttttaaaaaggaaggaatatgatttttagggaataaggttacaaattattagaaggaatagaggaacaaaagggaggaagatggtgtttccagaggtaaggattacagaaagcctttgaccctgcaaggatgagtactgttcagagtccaccatcgtctgcctcccttgtcgtgtagctgctactagagcccctgtttatctgccatatgtccctctgtaggagctcacaggggcgactgctgtctgctgttggtggtggcatcaccaggagcagaatggattctttctctcatgccttttaatctggcatagatgccgttgacagaacctaataagaactcagtaactgtcagaatattaatgcatgtccaagcacttgaactaacttatcattaaggtcctagaactgcctagctctgtagaatgtttctgtaggattcatgaaaacttttgtggaagtcttaatggtgtttaccacatttaaaaatctagattaggtcatcttttcccccctgttaaatccaactgaaattctgaatccagttaggaagttgcagctagcaggggctttcagttgtgctatgtatttggcaagaaagttcaagaatcggcttgtttttt

SEQ ID NO: 79480 - DNA, 1213 bp, Homo sapiens
atatcaaccataaagagatataaattgttttcccatgcttccagtattttaaaaataggagttcatattggtattttcaggagctcttttgacaactacttttggttacctaaaggctgaagaatgtttttgttatgtttgagacagggtcttactctgtcgcccaggctggggtgcaatggcacaatgatagcatattgccgccttgaactcctgggttcacctagcctcccacctcagcctccaagtagctgggactgcaggtgtgagcaaccgcctcatccatgttttctatttctattcagagtgaacacaacatgctcccttggtctctgcaaccatcgattcctaacagcctagaggtaaacctcagaaaagtttttaaatgtttctcttagccgtcttagcagtttgcgatacaacagtttgttagggttgcttcttttgtttgtgcaagacttgaatacttaacttctaatccagaagctgtgtttactataacataaaatattaaagatgagctgatggtgaaatcctcaagtgtgaagaaagtttcttagctttatagctttatggaaacaagtacattgtattttttcattcagatgaatgaacttttattgaacattcattaaatgctaggcactaggcaaacaaagacttaatagaatgacaacagtaattttccatagagcttgatacagtattggtaccttcctggcagtatcccaaaggatttgttggctttcattaatcctttctagttattcgtcaatcagtgcatcagtcaacatgttgctgagcagatagaggagaatttgcttagagtggtcagatttttattgctgacgttgctgtataaccctcctctgccgaaggctgaaaagtggtatcagtcattgagacataattctgctcagtgtataatagactacaaaataatccttagttatttgagtgtcctttttacgtgtatatatttataacttataccccacctattcacagaaaggatttctgatgtatttcagtggtacaattcacaaaaatgcacatgccgagacaataactattattaaaaatactgttcttaagatttttgtttttgttttttggatacatacatcgtatacatgtatctgtgtgtaaacatgtatctgtgttaccatatcctggggttcctttcccagcttgtagccaatagccaaaagtt

SEQ ID NO: 79481 - DNA, 2364 bp, Homo sapiens
cgtcataaggcggcggccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaaggtgagcgcgcggggcgtgagccctgggccctgcccaaggccgggtctggcgggcggcctgctcccgccaggcggagggccgcgcccgagatgcggggccgaggcgcatgaggccgaggctcctgcgccccacctttggcttcccgccgtcgctggctggtgcgccgacgaattgggagttccaacgtgccccgcgtttactccgaatcgtgccttttgtaacacctccgtgggtcgcggtgttcctcagtcacttatatttacgcgagagcccaggacgcaggctttgggcgtagagcctaagtttttctgtaagcctcaatttggttaggaagttttattttttcctttgaagaactctccaactacttgtattgtgagcgtgcggttcactccaaaagcagtgcctcgtgtgcgggccgcgatgtgggccaggattggcatttcagggccaacccttgtaaccatggtcagtgagtaaagtccggccttcagtgtcttcacctgtaaaggccgaatactggtgcttgcctcccacggcggggtgaggcctagaggaggtgagtcaggtgtagtgtgcagcgcagtctgtgctcaaaaaggtttcagtcgatgggactcaaatatggtacttgactaaaaatcgaaagggtggaattttaaaattttactcacgaaattaatcagggttttattggaaacaggaatattttgtaaacgcccttgtgtcttcctgatgtaggggaataggccgggagtgtcactgtggttcaaattatgaatatcaagcctttgtatttatctaggctggtgtttgtctctcccactgtaattatttccaccgccctgccctcctaggcaggtgtgactggccgagaagtgagaaagggccgaggtatcttgtctcctaaattgtttatcaacaatttttcttacaaatcaggttgtgttgccgttaaatacgattttggtctactgcttgaccttcgtgcgggtttctgcttaatgttgcacttatgtcctaattaagttgggaattggattagtgttctaagcccattccatatgttcttaaaaccgtgttaacttttcttaagttgggtgcttctgttaggatgttaaagtaattgaaaaacaagaaaacatatagcataggtaaaagtccaagttaccacattatttgagaatatcccgtgaaaatagatatatttacgcattaccaaaaaaatggattttgggggcaaaaatacaaatattaaagtttgcaatcttaacagtattattaagtatcacctgcttattgtaaaatgcgtattgtgttcattattgcttgaaatttaggagcccccaaaaataacaagtccctgtctgtggtggtttgccttaaacacttacatcaaacttagcattaacttctggtgcacagtagtgtgctatgtaattttctttgataagttctgttagtatgttgccaaagtatgcagtattgacttctagagtgtaaatacttttacttggaaaagcctaatgtatcttttaacaatattaaggatagcttgaacgttttctcttattgattgtctacattaaacatttaaggtgctttggttttagctgctgtcattaaaatcaaccaaagtgtgttaggaatataatgttccttcttaaattgaggattggctgtaaatgctaagtgcctgtggcgtggatggtgtccctaaccatgaagaaaatgtgcacagtcacttctgtgttcctgtgggccaaatcacctgtttcttctatttggaagatcagttcgatgacctaaaaaattaagttattgtctgtgtacccaattgaccttccacttaaagccaaagtattcagctaaaaatacctttatagtttactggtaggttgcctgttgccgctaaagaattaaggtagatagctgggccttgcatggagtaaaagctaagtcactttctctatcttgagtggtgtgtgcacccttggtaagagaagaaaaccagatagattcctgtcttgtattaggaaacaatatgtacaaacataaaaaataagtataaactcttatctcttaacttgtataccactctaagactaaaacagccaggcgtggtggctcttgcctataattctggcactttgggaggctgaggcaggaggattgcttga

SEQ ID NO: 79482 - DNA, 1049 bp, Homo sapiens
ttttgtactgttgaaaccacttcattggacatgttgcaatagcaaaacccccagttagattagtgtttacacattttctcagttatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagtaacacactatgcaagcatgtgtactttttatatctctcatgtttagtttttataacaccatatccaggttgctatctcacatagtagtcctttaacatattgtattagcagtgcaatgtggactaagctgcttcactttccctttgcaagttcagatcatcatgcccattcatagccaggattccttatccccaaaacagttctatttttccttaatcactactatagagtctttacattaaattactgtcgtatgctagataattttctcaaattgttaaaagaatatgtactttggaaacaaattagtatttatattgtaaatatattcaaaaaaaactaagaaacgtgtacttggcttttatttgtagatgagacatttatgtgattgagtgaattagccattagacattttcattctagctctacagctgcaaagagggagggggaagatgtcttgagtcttgttcccaatttatcactaagtgcatcagaaatctgtcttccaacacccttggaaagaacagggtggtttttagatgtttgtgctcagacagcgggcaacagcagattaaataacaaggcaaaaatactaggaatgctggtagaaatctatgaccgcaggttaaaaaaaaagaccactcaagtaggccagacccaggagacctgggaatctagaacctggtaagcagtctggaattgggaaaggagaaaatctacttttggacccaggcattagaccgcttaagagaa

SEQ ID NO: 79483 - DNA, 1025 bp, Homo sapiens
aggatttgatctaatccaacaagcctttgtatgacctttgacctcagtgtgttcagtactttgtcagatcacttttactcatcatcattgttccaatactgcaaggaatctgtatatttgtttatttcatatcacacaggaatgaaacagaagtatgtaacatgtgtacgtgtgtgtatatatatatatacacacatatatagtaatatttatataagtttgaggaggaattaccacaagaataccacaagtaaaccgatttcttgaagtaaaggagtgacagtgttctcttgccttcggctatgcagctcatgagaaagtgtgggtcagtggaaagctagctgtcagttgtgataataatgaatcataaactcggaggtaacacattcacctcttgtttggagactgccagctttagtggttaattatatgtcttctattctgtatacagtttaactgtgtataaacatgatttgaactcctggcttatgaggtgtggttgttgaatgtattagccttaatcttaagactcactagatttcaaaaactggattatgatattgatatatttctcattttgattcagtgagtgatgtccagtgccacggatgagcttctgaaagcatgggtaccaagttacctattgatgtgttggtaatttggttaaagtcagatcagcagcttggggttttgtttcaaaacgagtactttaaaaataatattccttcaattattcataaccaagcaacaattgaatttaattcagtctttaccaggatacatattttggtctataataatattgagaattttttaagggctagtgttgctacaaattttgaaatgattccatgtatgagtaaatgaagtattagcctactttagatctaattaattaataatagtgagctttgttttctaaacttggggaaatgttcagataggaaaaagtctcttctttgagcacctattttaaattttataataatcatatgtacctaagacatcaaacatgctaattttac

SEQ ID NO: 79484 - DNA, 1117 bp, Homo sapiens
gaagaaatatttaattttaggaaagtgagattttatagctttactatagaacattccacagccttaaagttactgatttaactttcatttttcactttttgtcttaaacatctcttatcccataaagtagtaccaggcaggaactacagacttccaaattgcttttctattttttttcctgtctttattcagaaatccagatatgtaacttaactcccagactgaagaattgactttatttttggccaaggcttactttcctacacttgtgactttttacatgcccgaagaccaataaattacttgcttcttcatttcccctctccctcaagatacatgggaagggtcctattaccttcctttatttcctttttagttaggaacttctttcttttattcctatatcttaatagtaattttgagtgctgtggccattgatgttatatattctttatagcgacatcaccaggaggaacagtaaaatgtttccttaggggtagaaacatagaatgtatctctattaattcaatatgaatgtttttccatagaaatagaattctgaaattttaataaattacatgagttattcttattttagtcttttatgtacatatgcatcagtttgtactcaatttgtcttcttttatttcaagggtgtgattactttagagtcccttggtaaaaggggttatcgagtacctccttcaggaacaatacaagtggtatgtgttttatagcctacaattgcaataatcattctctcacatacatatagaacttagccctttctcctgctactgctgctgcaacaactttggtaagtaacagtggggctgcagctttgtttggagttcccctgctctgccccaggaatgaccatttggggacctccataaaaggaaagcattaataagctaatcaaggtgaatacttaagaaaaatagcatatgacagtttgcataacttcaataggactcttcaatacatatttagaacctaatattactggtgccttctttttaataaaccaaattgagacgaacctgtttaaaaggagaccccaaatattagaattgctttcacaggaaaacttgggaaacaaaattattttatttct

SEQ ID NO: 79485 - DNA, 1030 bp, Homo sapiens
gaatgtgttagcttttttaattgagtttttaaaattattttgtcttccaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatggcaagtattttttatattgtatgttttcctgccaaatcaaccaacttaatgacaaatttaagtgctttgatgcagtacttgaaaatataaatcatttcctaacagctgaatacaaactaatatgccaaaatattacctcacaacttctttctaagctagttcaaacaacagataacctcttttgcatttaaggatggtactaaaaatgtacttatttctctttgtcttgaaaaaatgataaaaattgattagtgacactgtaattccatcttgctgagttcacacacattctcaaatgcttagtgtgcactgtgtcctctagtcctacaaggctttggtgacataaggcttctgtatggcccttttactcccttttcggtttggtttgtctttgggcctatttttttctaatcctagggttcttttttttttttgacagcatctcactctcttgcctaggctggaatgcagtggtgcagtcatagcccactgtagcctcaaacttctggcctcaaaccatcctcttgccttggagctcctaaatagctgggtctacagatatgcgccaccatgcctagctaatttttatgttttgtagaggcagggcctccctatattgcccaggctggtcttgaactcctggcctcaagcagacctcccactttggccttccaagtgttgggattacaggcatgagccaccacaactggcctaatcctagagttctttaggatactagctacttcagactcacgctaatgtcttaatggagagtgaaataactaagaggagttacagcaagcttgtccggcctacagccc

SEQ ID NO: 79486 - DNA, 1060 bp, Homo sapiens
tttctcacacaaaatgttccttgttaggagacatcagtgatgggaaaaacttagtacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattggtaagtaacatctaatatgtcaaatgtaagtctcaaatatttgttatggtttaaattttgttcacaggagatctggttataaaggcccaaggttccattatctataggacacacagtctgatagaataataaacctacagaactagtattaacatccttgcaaataacccactctcctaagaacaaatgctaagtaaatggaggaaataaagatcatgctgtttaaaaaataggaagtggtacctttttaaaaaactgttaataggacagtaattgttttcatgacatgttaggtctattatttaggtcttttagctctgttctccccctgctccccc

SEQ ID NO: 79487 - DNA, 1041 bp, Homo sapiens
ccattacttgcttgctctctaatcttcatcacataatctctgagagtctcagtttccttgtctgtaaaatgggaataattccaacttctcacagttagaatgaaatatgaccgtgcttggcacatagcagatattaaataaataatatcgtttattatgttaaataaacattacaaatgcttatatattggttatataagcttatatataagcattacaaatgcttatatactggttatataagcttatatataagcattacaaatgcttatatattggtcaattacaagatatactcaacaaaggtaaataaataatgaaatgtttaataacctaatgctattttgttctgttttgcattgatagtgttcaaactgctaaggctcgagcagattaataattttttaatatatagttatctgagaaaatataaaagctacagaaggatacttgcagtatatgtataatgtatttatattgtcatttgctattacaattatggcttctatatgtagaggatgacatgggtggactaagctttctggaataattagatttttaagtgatgttaacagctgactagagctgggcagctggaaaatttaatgttattccacctttgactcaaggatgtacaagtttggacctggttctagacctgtgtgtatattgaatacctggtgtttcaagagaagtctaaggtgtggtccacggcctgttgcggtggctcatgcctgtgatcccagcactttgggagcccgaggagggttgattgcttagagcttagaagttcgagaccaccctgggcaacataacaagaccctatctctatttaaaaataaataaaatgtggtcttagtgtagaggtaattaaaaacatattaggttatgttctaaatgtatttctaattttgtatttttaatatctgagcttaatcaaaactgctatgaaagattaagacctataaaataaatcataaattagtaatttaaatctactgttttaattcatatttaaaaacattgtaggctgttgatctt

SEQ ID NO: 79488 - DNA, 1033 bp, Homo sapiens
tatcagtcttctgattaatggcaagaaccaattttagaagatgttaatatagtagtggttagtagtgagagcttttcagtcagatatgagtttgattccaaggaacattgtgaagtggggattattttatttggtagggggctggactagatgacagatttccttccaaatccaagtctttaggattggaaatgttaatttatcctacgaattagatgcttattttaaaatttatatatattaaactggttgtttttccatatattttttcaaagtgattagacaaattttctgggtaaaataggtctattgaaatgcaccagaaggaattggagaaaaccatacttaatttagtgatttaaattagttttaggtgttggctattacatacaatcaggcagcagctatgtatgtatcaagtattagtaagtgtattgctcctgagcaggttccttgtgtagaatgccaagtttagatttttagattacatcaatcactttggaaaaatggcaccaaggttagtaattgattctcagaataaacaagcaaataaaatcaaagtcactatttattttgaattgttgtgaaaagttgctttacagtcataagcagttttaaaaatagtatttgcagccaaaactagtgttaaacacaataaaatgtttagttacgtactgatatagatttttaggggaaacaaatttattcatcaagatttccaaagaagttttcaccttaaaaattgtagctttctttagcattctcaggtaaagatgatgggattgtgagtttagtattgtgattatattccataataataacataaacctttagacccatggctttttttttcttttactaaaaccagtgtaagtaatcttttacttagcaaactagtacagaaatattgaaataagcttttcacaaacgtacttacccttactgtgcgcaatgtaatgttgtattttctattctatttcacgttttgaaaaattgctgtcaccacccattgaattgatttcttcaccaatta

SEQ ID NO: 79489 - DNA, 1098 bp, Homo sapiens
catgctgaagtttgttgctgccacaggagacactccaattgctggctgcttcactcctggaactttcactaaccagatccaggcaaccttctgggagccacgggttcttgtggttactgatcccagggctgaccaccagcctctcatggaggcatcttatgttaacctacctaccattgctctgtgtaacacagattctcctttgcgctatgtggacattgccatcccatgcaacaacaagggagctcactcagtgggtttgatgtggtggatgctggcttgcaaagttctgcacatgtgtggcaccatttcctgtgaacacctgtgggaggtaatgcctgatctctacttctacagagatcctgaagagactgaaaaagaaaagcaggctgctgttgaaaaggctgtgaccaaggaggaatttcagggtgaatggactgctctagctcctgagttcactgctactcagcctaaggttgcaggctggtctgaaggagtgcaggcaccctctgtgcctattcagaggttccctacggaagactggagtgctcagcctgccacggaagactggtctgcagctcccactgctcaggccactgaatgggtaggagcaaccactgaatggtcttaagctgttcttgcacgggctcttaagcaacatggaaataaggttgatggaaaataaacatcagtttctaaacaaaaatacttaatttttagagaagttttaggttcacagcaaaattgagttaaagatactgaaatgtttccattttacacccctctcgcttcccatgcacagcctctaccattataaacctctttcaccagagcggtacatttgttacaattgcttaacatacactgatgcattataattacccaaaatctatagtttaaattagagctcactcttggtgttgaacattctctgggctttggcaaatgaataatgtgatgtgtccaccactaccgtgtaatacagaattgtttcactgccctacaaatcttttgtgccctgcctactcatctctccctccccacaatccctggcaaccactgatcttattactgttaccatagttttgccttttacag

SEQ ID NO: 79490 - DNA, 1048 bp, Homo sapiens
gattataatgattgcaaatgttaatattttctgaaattgttctaaaactctttaggtcccagcatgtataaacttacacataggtaaaccatagtttggtgtcacatcttgaagaagttttgagcatataccttgtcctaagataaaggcttcattgtcttacgtgttaccataaagaggggcttctattttaatatgttgtaaatttctagaaacataaactgctgaaaattgaataacagataatattatgagaggtttactgtttacagaatgctaaaaatataagatgtctacttgtattttgaattttagctatcaagtttgaggattataatttgcttttaatatctgtagttcttttgctagtgagtacacaattaactgcttaaatttggttagacttcagttgaggataaagacgcttgacttccagcacatctagtgatttacatgtttatctgatttatgtaccatctgttaccttaaagaagacatgtaacctctctggcctcaaactcatttgtaaagtgagatttgataatgctacctgttgatagagttgctatgatgattcagtaggatgtttgtagagctcattgaacagtgcttggcacatagtaagcactacataaattgttcaataaatcagcgagatgagcttcattataacaccaactataatacaccttaattgacttcttataacatgtcatgctttacctgcgtacagcagaggaaagttacttgacttaagttgcacctacagccggtggtagagctggattcacgttaggctacctgaatctgaagtattctccccctcgctctcagcttttcactttcctaagaagaagaaacagtttaacatgcttcttcaacttccctcctctccacctcaaactatttctttcatgccactctcctttctacctccaagtgccttctctcttttctcagaggtgctgtatccccttcactttccaaagtgaattttttcacgttgtaggtaactccttcctctgggctttgccccatctatatcctt

SEQ ID NO: 79491 - DNA, 1028 bp, Homo sapiens
ttttaaaaaactttatattttactttgttagaatataaaacttctgtgagtaaagttgaatcattaaatggggtcaatcccattctatggggataggggatttattccattctctctctctctctctctctctctctgtatatatatgtatatgtatttaatatatatatgtatataatatattttataatatatgtgaagcccttcttacatgcagtgatttgagaaactggtaggcttgacatagttggggaaaaacttatgtctatttttctgtttatactttgtttttctctcctagttcctacctcattaagctctagaaatagttcaaatttagatatcagctaaggcctctttgaaaaaattttgcaccccattctttctctttttaagtgttgtaagaaaatatactttcaactggcataaagaaagctatgacatcttaagaatttttctataagattctatgaaaacacttatttgaggatgatttcggttctgtcctttctgtgggggaatgtaaaacaaaaggaatagcaggtcattttcacaccttgaattcaatttgtgtctattttataatctatttttatggctgtcatccaattttgtccctctagtttaggttgtatctaatagtatcttggctttgagttaggcaggataggaagagatttgctattaacctggactaacacagactcctgtgacacttaagaggttgtatgaaagggatagaaatggatgtctcactttgatgttgaatatgtggggacatacacacacacactctacacacattctctctctcagaggaaattttaactcagttggagccctggggacatgtaaacaggcacaaggagatttcccataggcttacagggtaagggagagctatccctctcccgtggattagcagaaatggcagatggcatctttctcccctaataatcaccagatggcataaagctatgccctgtggtgcaggaaggaggaaactgggttgatcatgtattttctac

SEQ ID NO: 79492 - DNA, 2732 bp, Homo sapiens
tgcctcttaaagcagtgttagtaactgaaattttggctttaatatgttttgttgtagattgaagaaaaataaagagctacagaaagttcaggatatcaaagaagtcaagcaaaacatccatcttatccgagcccctcttgcaggtgagtactacattgcacatctagatttttgtggtctgtgtatttgggtaccaactaactttgggtattttttcctataaatattatctttcatagtaaatttatgatatgatttggcctataaaaatgtaatttattcagtgtatttcccaattgcagtcagtctatttatatggtgtttcttttttgccttcattgaattctatgttccatatccccccaagttatgcaaaatgatttgcgtaataattttgtagatgatttttgtcttgcacttgtattgattaaaggactatattttttattagtggttctcaaactttggttggtatcagaattaccaacttggggaacttagtataaatacataggcccaggctctttgagtctgggccactgttcagtaacatcccagatgattctgatactaaaattgggactactgtttcttttgctcagctaacaccagtacagtcttttatgcaatttacttatgtagatcacttaaagggaaagaaatcttagtaaaggtcaaattctgtaatcacatattgagtacatttgtgtagatctacttgtattatttttgtaccaaattttattaaaacaaaataggcaaaattctggagcatttgtttcacatatacatgataacaaactgatagtcaaaaagcaccagaaatgaaccattgttatctaagtttttaggtaatcctctttgaggtagatagaacagtgttaagagcaggcaccttggatccagatggctggggttcacatgccagcactttgacttaaatggctttctagttgagtgaccttcagcaagttaatctgtctttgagcctcagttttctcatatttaaaatgggggttgttatgagggtgaaatgagcaaataaatgtatgtagaatgtttatttgatgcatggcatatcataagacctatgttagtttagctactattaaatttcttaggagtggctaatattacttgaaaacatgcaagatcctttataaagtgttggtgtgaattctgtaaggtcacatttaattaagttgtttattttttacttatttttattaaaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaatgctgatatttattctttaaaggcactaaacaaagatatgaaatattgatgacctggaagaagaaatcttcctccacacatcccatttaagtaggagatacatttaattaaagagaaatagatacttaatacttaatgttttgtgtttttacattgtttacagttttaagtatgttaaatacattaagtaacgatcagtttgcataatggtttttttagggtagagtttaaaatcagtaattcttagccttacataattataaagtaatggctcattttttgtttcagtattagatagtaaaactaaggctgtagaccagtccctggaccaagtgttaggagacctgagttccaatgtggttttgcctgggtattcttatttgtaaataatattattgattgaagattaggggaaatgatacatgtgaggaaagacatttgtaaaatttcttgggtttttactacataccgtattcattttttaaagaaataaacattttgaaagttacgttttattaggaaacaagtgtcctaccttgccagcgaaggagcaagctgcccttgctttgcgaccatcagtttggggga

SEQ ID NO: 79493 - DNA, 1008 bp, Homo sapiens
cattttacatttactttatccttgtctcaatgtattgaagacataatgctttttccttctaagtatacttaagtgtgtgtaacctaaaaataagaacattctcttaaataaacacagtatggttatctatcagtcaggaaattaacattgatgtaatactattatataatctataaaccttatttagacctcaccagttattctgattacgtccatagcaacacaaagtccttcatatttcttcaggctcctttaatctggacagtttctcatctttcttttacgtgacattgatagttttgaagactataggtcaagttattgtatagaacgttcttcaatttgggtttgtctgataccttcctcattagattttggctaggcacctttggcagggatgtctcagaaatgatggcgtatccttctcatgcatcatatcgggaagcacatgatgtcaccttgctggtgatgttaactttgatcacttgattaaggtgatgtctgtcaggtttctccactggaagattactattttgttttccttataatcagtacgtattttgggggagatacatagagattcagtaaaaagcctattactcctcaaacttgtacctactggttttggttttcattagagtcttgcctgaatcagttactactattgttgtgattgttgccaaatggtggtttttctaattccatcatttcttctacattttttagttgattttctcatgtaagaaagagctttcccttttccatcaatttcaagatttattcctttattcatattacatctgtgtgtattcatggattcttatggtatacattgggttataattctttattgtcattatttattttgaagttctaagtggcccatatttggcctgtgggagttccttcaggcagactgtcatgtcattttgacaattctcctcattctttgagtgcattcatgttttatagctaacaagatgtttcctcttccccagcttggaatca

SEQ ID NO: 79494 - DNA, 1489 bp, Homo sapiens
aggaaacactgccggtcacagtcatttactgattaccatttacctcgtggctgaggttattatgatctgaataaagctgtgtatatataaaagaaatagtagccaaatccagaggtagtgctgttttatatgcctgtcagatagatttgaaaaccaagaaatacctgtagcttttccaaaattgttttgtgtgttttaagattaaaaggatcattaactgtaaaaataccagccactagcaacggtaaccgtgtttggaggggatctgaagaaatgtagggcctgacttttattctgcagagtagcacctcatttatttgaagatatatatagttttcatacctttttgctataacatagatatttaggttgaaccatatgaagttttctctctctttttttttttctgtctcctacaggaagaacatggaattcttgatgttgactttttttgatctgtaaaaaatggcagtttcatatggttcaacataattcaaagttttctggctttgaatcttatctgggaatgggacattgggaaggtttttcagtttgtaatcctgataattgttatatgcccttctgagggatgggggtgttactgtctcctcctttctctttgagaatcactagtatatggagagatgtcttcaatagggaggtgtgtaaaggagaaaaaatttgaaaacctatattctctgagataccctgaggggtgaatctaggtgtatgttcatttagaacacttaggaaaaggaagacgttttaagaaatgtttcctttctacctttcttaaaaccttatttttatctcctctgttccctcttacaggataattcatttgaatttgaaaaacgtagaaatgaacctatcaaataccagcgagagctatggaataaaactagtaagtcacaaagaaataccagtaattttgaggagagactggtttgggataatactataactttaagtgtcagtttgttgtttaaatattgaattttccatttatcattccttggcttttattattttatcctcattttaatggttctgttgtagtcagatctttcatcattttttttttacaattggctggtgtgttcattttaaaataatgtaattattaactttgatactacttgaagtgcccacacagagatgtaaaaacataaaaatggctgaaaaaaatagagacggaaaatactgttttagggtgagtgtgggatggttaaaatacacatgaaacctaacacactttacatgtttagaccatatagtttaggatataaacttgtattctgtataccttataaaattcagtgcttctttaaaattaaaaagtgtagtgcttaaggtcatcattacaaatgttctgagagaatttctaagtgtttgacttaggtaaaaaatgaagttataatcttctgaaattaaaagcaataatatctagttcttgttttttttgttttgttttgttttgttttttttc

SEQ ID NO: 79495 - DNA, 1035 bp, Homo sapiens
gtaacaaaataatactgttagatttataaaatgagtcctaataagacatttcagggacatgttgaagcatcatcagttgtaagttagcactattaaaggattaaatcttgtaggatgaaggtggagagttaaagtagtaaagaatcttgctagcagatctgtgagtaagtcgaaaacgaatctgttatatcaccagttttacttgcttttgaaattattttgtgctttcaacaaggaagatggaaagacccaaaggagatttcagaatggttgtttgaaacttttatccccattgaggtataaagacagtgaattttgaaaattatcctgaattaagaaaggacttaaataaatgactttacttaaaactgttccctttatttgaaataattttactgttattctatataaatgattagtaatttaaaataatattttcagggcccttagcctttggttgggatgatgtttgatagtcaaaaaatagttgtttccatttaatctgatatatcttacacatttctaaatggcagtttaagtagaagggaaagtattttttgtctagcaggggtaacgtcttgtgatagaaaagtttttaatgttgacttctcaatattttaacttttcttgtaggtgttcagattttgcaaatctaaatgtcataaaaactttaaaaagaagcgcaatcctcgcaaagttaggtggaccaaagcattccggaaagcagctggtaaagagcttacagtggtgagtacggttagctatcaatatagtttttacacgtttcacagttttagtatttgaagggtatatgtcatctaatcaatcataacaaggcctcctataacatgattaataagtaccttatttgtatttggctgtggaaataatctcattctcacatgatccttaaaactgtaattctgtggagctactatttttagctcttgcagaccaagaggaaaatcacttaaatggcttgggatgaagttgggaattgctactgaaagattttgagatgaagttaagagataa

SEQ ID NO: 79496 - DNA, 1082 bp, Homo sapiens
cagtacttagcacttggaggatacagagaaagtaaaaaacacattactgccttgaagaagttaagagtttagttggccaattgaatttttaatgcaaatatccagtataaaatgctgttttaagactgccacaaaataaaatattgttttataaatggaaatgaaaatagattttgccaggtgaagtggtgtgcacctgtagaggcaggaccacttgagcccaagtttgagaccagcctgggcaagagagtgagaccccatcttaaaaaaaaaaaaaacacggaaataggtttcaatattattggacatttactccttaatgttactaattatggttatttgacttgggaatggacagagagactgaggagttacacttatcccttaatctttgcaagcatttacaagattcttcatcttttagggaaagatagtgttcagttgctggtaagtttaaataaaagtaactaaatgatattggggccatggaatttgtttttaaaaggctactgttgctgaagtccagccatatctgggaagcccatgatactacagacatactgtgatgtgtaactctttagtttgtgctgaaatacaagactgagcatgaaaatatcctgctatgaggaatcctgttatgatgtgcagattttcaaaatgactatattatgtattatttggacattagaagtatacttctttcttttttttttttttttttttttttgggacggagtttgctcttgttgcctaggctggagtgcaatggcgtgatcttggctcaccacaacctccacctcccgggttcaagcgattctcctgcctcagcctcccgagtagctgggataacaggcatgcaccaccatgcccggctaattttgtatttttagtagagatggggtttctctgtgttggtcaggctggtctcgaactcccgacctgaggtgatctgcccgtgcggtggctcacacctgtaatcccagcactttgggaggccgaggcgggcggatcacctgaggttgggagttcgagaccagcctgaccaacacagagaaaccgcgtctctactaaaaatacaaaat

SEQ ID NO: 79497 - DNA, 1021 bp, Homo sapiens
gcaaaagtcatgatggctttgaagtccttcctccaaagatacagcactagggccgggcatggtggctcacccctataatcccagcactttgggaggctgaggtgggcggatcacaaggtccggagttcgagaccagcctggccaacacggtgaaaccctgtctctactaaaaatacaaaaattatccaggcgtggtggcagacacctgtaatcccagctactcgggaggctaaggcaggagaattgcttgaacccaggaggcagagattgtgccactgcactctaacctgggtgacagagcaagagcaagactccttctcgaagaaaaaaaaaggatacagcactaggttcttctagtttagggaaaacctttactttcatgaaaattgggaacattttttaaaggctatatttggtgagatgggaagctagtgccacatgcttaacaattgcctcaactaacaagtttcttttaacacatttgttttgtagacttaatggtgctctgtgtgcatgttcttccaaaaactgattcattaatttagtcaatctccaaattaaaatttaataatgtctcctgacttttttttcctctttcctcttttgtcttaatttttcatcagcgttccaaaacagggagacattccaaacaagtgcaacattccaaacaaggtcaacaaaaaaacagtcataatacttgtgtcagtactataagacagtttgagaaatattgattggaagaatctagttatgaatttcaatcatctgtaaactctaccatcaaagaatctgttttttatgtgtttcattaatggaaagtgggattttaaatcaaatgaagtgccataaaaatgcacctgaaagtataaacttcttaacatgaacaaatatagatctgctattatcataaacctgtgtttcatgtaactttctaaaaacgacgtttgggcatgcctacttactttaacatcatctaccttttgatgtccttttcacaatatttagacttgcttgctattta

SEQ ID NO: 79498 - DNA, 1054 bp, Homo sapiens
atcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgcttatttcctagaagcaaataaatgtttaagtaaataaaggctacattttgctgagtactgtttcagtcaattttagaatt

SEQ ID NO: 79499 - DNA, 1656 bp, Homo sapiens
tctgcgttttcttgcatatgaaccttgtatttcccaatgtttatactattgaaaatactacccggggggttgtatctgtagaagtaaagacacaaaagcttatggggtattatatcttgaagatttaaattcagcttttaaagcatttgacattttatttcttctctttcaaaaaaaaatgtagtcattgaaagaaaatcttgcaaggtgttggacacttactgaagcagagaagatgtcctttgaaactcagaaaacgaaccttgctacagaaaatcagtatttaagagtatccttggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccaggtcggtttacataaaaccgtgtcattacagtagtttgtaacatttgtagattggatagcattttta

SEQ ID NO: 79500 - DNA, 1017 bp, Homo sapiens
aaaaaggctcatggactcttgttgagcacaatcaaatacaccagaacaagcctttctgaaagaatgagaattttctctacaatcatgcccaggactgcatttctttgaatttgtattttttctgaattctttaaagtgaactggcttttctttccttccatcattttgcatagtagggcctctattatgatggttttctgtaggtgccttatactgtggatgtaaatagtcactaaaaactgttcttggtttttcagctgcttcttttgtagcaccaaatcttttattacccttttcatcaaagatattcttggtggtatctttaaagtgtctgaaagtggatttaactgaatctgagaattttttcagattttccttcacagcttctttagcctgcttaattttctctttatgatgccttacaaactccttggtagaattcttcatggcatcaaatgtttccttaactgaacccaaaaatgtttcctttgacttatttttagccctgtggcttcctctgccccctttcttttttccatctgttccttgttttccattttgatcttttgcctcaacatacaatctttcccacaaatcagaacgctgctgttcgaaggttagcttccgttccagctcagtgagtctttcccgtaagattgctatttcctttttttcagtatatacattgggagaatctgacttgccatgtaactgactaccacttaactgctggagttccccccttaaagccgtagttactagtcgttctctctccagttctctctttagcatctttgcttctgtcaacagagtctccctttgactaagaaagctgtgttttttctgcttttcctcttccaaatgctgcttaagtttctgattttctttaactaattcagtacttgtccctttatcttccaatattctaatctgttctcttagtttgtttaactcttcctgtaatgaggataaggctttttcttccttctccaaggatactcttaaatactgattttc

SEQ ID NO: 79501 - DNA, 1030 bp, Homo sapiens
tggttttttccccccatacatgacgcatgtgaatagcatgtctgagtaaagtaacattttgatttttaggatgaaaatatgaagaatcctagttggtttaagattctttttttgagacggagtttcgctcttgttgcccaggctggagtgcagtggcgcgatcttggctcaccacaacctccacctcccgggtttaagcgattctcctgccgcagcctcccgagtagctgggattacaggcacatgccaccactccctggctaatattgtatttttagtagagacagggtttctccatgttggtcaggctggtctcgaactcctgacctcaggtgatccatctgctttggcctcccaaagtgctgggattacaggcgtgagctactgtgcctgtccaattcttttatcactgttgggataaggacagtgctactccagtacagatttaaccattgcagaattcttaacaaatttggccttgagaatggtgcacaatcaccattagccaattattttctgtgctgtactttttgggctttgttgtatccttaaggcaaaatattaaaaaaaaaaaaaattttcatttttccttattgacttacgacctgtgaaaaaataccagggtttgttcatttctctgtataagggaggctgaaacactttttgtacttaaaagataaccccaaaacaacaaagctgagtgccttcaatatagtaagataagaacattacataaattgttctcttggttagagccatatgggctggcctgtgtgttttaatacaaaagatagtgaactgcttaaatgttcctgggtgtatgtaaataaatgtttttaagaactagcctacttggccttacttatattacgttaacgttcaccaccatttgatgaatgattgatcatgggctttcatttacttttctttttttattttattttatttttatttttagtagagacagggtttcaccatgttggccaggctggtcttgaactcctgacctcaaatgatctacctgccttgg

SEQ ID NO: 79502 - DNA, 1030 bp, Homo sapiens; identical to SEQ ID NO: 79501

SEQ ID NO: 79503 - DNA, 1030 bp, Homo sapiens; identical to SEQ ID NO: 79501

SEQ ID NO: 79504 - DNA, 1047 bp, Homo sapiens
agtttatgatagactcaagggaaggtggaacattccagcgacagagaatctgataacctgaggaagacgtaatcttgggtttgggagcagtgaaaagactgcttggactacagcagagtgtaggtatttagaaataatggaataggtggggtgctattatagtcatcccttgatatacatgagggatgggttccaggatgcacccccataccaaaatccatacgtactaaagtcccttgactgcggacctcacatatatgaaaagtcacctctccatatacctggattttgcatcctgccatgtagttcaaactcatgttgctcaagggtcaactgtgtattgtaaaacgtcttggaatctagataggaaagtttgatttattgagtaacctgctatcaggttagagaaaaaagtgccggaactttttgctggtgtggaaaaggtggtatggaaaaatgtagaatagtcagtcagttaagagttctgtaatctggatatttggtgaggaggaccttgacaattggaataacagtgggaatggaataagggacattgaaggaataatggaaaataatggcaatttattaaattgtagaaaatgtgctagctgcttcacttttggagttggggttactggggaagttttgccagatgataaatagatggtaagcacagtttggtttggttttacccaaatttgttctagacaaatttggtttggggcaggtgttgaggtttgattttttttttttttccaccctacaaacaggccccctacacagctggatgtgttggctagaagctctgatgagaagttaggacaagatctgtagcttggaattcttaataggagtgatagcaaaatctgacagcgctgcaacatggtaaaataggcagcatttgtagacatgactaggccaaagattgtatcttgaggataagactttaggtagctgaaggtgcaggaaaaacccccaagtgattagtcagtaatattgtaaaaggccacattaagacagtaatcaagcatatgctatattatacta

SEQ ID NO: 79505 - DNA, 1047 bp, Homo sapiens; identical to SEQ ID NO: 79504

SEQ ID NO: 79506 - DNA, 1047 bp, Homo sapiens; identical to SEQ ID NO: 79504

SEQ ID NO: 79507 - DNA, 1011 bp, Homo sapiens
cttctgtaaaattatttttctacaaaatattcaaaggtcatgtaaatggtgaagttttaatgcaatttggattaacactttaaatcactatccaattttttttgaagtaagaaaaaaagattaagataagatcttctccattgttaccctcatgtttacttgtggagggaaaatcatactcaaatacttattgattgtttcagctagatagtctataaaggtaaatatatatttcaaatcaaatcttattacaacaaatttcaagaaaggatacaaataatagtatctcagtattaaattcaagcaggtatccatcagaaatctaaatacatatttttattaatataaatacaagaaacatcttgcaagctctgactttaaacaggtattgtcttcattaagtttattctaacattacgctatgttgaataatataccttttccacaaatccacatagggtacatgtaattcttcaatctttgcataagaaatacatttttcgaatgaactagcaaaacgaaaagttaagactgtggattatgcaggcaaaaaaatctaaaagtagttaatgtaaagcaagctaaaatttgggaagttgacaagatctaagacatttccttttaaagtgtctctaccccaaattccaatatagcaaagagagtcaaagttcaggtttcaaatactccagtcattgtacaaacacataccttaaataagagactcaggccaggcacggtggctcatgcctataatcccagcactctgggaggctgagtggggtggatcaccttaggtcaagagttcaagactggctgggtgcggtggctcacgcctgtaatcccaacactttgggaggccgaggcgggtggatcacaaggtcaggagattgagaccagcctggccaagatggtgaaaccccgtctctactaaaaatacaaaaaaattagctgggcgtggtggcaggcgcctgtagtcccagctactcaggaggctgaggcaggagaatcact

SEQ ID NO: 79508 - DNA, 1039 bp, Homo sapiens
cgaggaggattaaataaaaaaacagagataggctctcaaagcaccaaatagtatgattaacagattcttgtgtatcacatttgaaatgctttatgttttggctttatgttgatgagttgaaaacccgtgtttttgtttatgttgtttggtttttgtttttggctatcttatgtagaaaggcatgtaagggatggcattgattattctaaataatttttactgggaaagcttttccaagattttgaatagctaaatgtcaacttttttcttaatagtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggtaagtactcaaaaatgtgttatacataacctgatgggatagtgtagaggaacttaagagtgaggactcttgggatctgttttcagtgccattattaaatgtgtggccttgaaaacttgaagcctgtttgagcctcagttttctcattcgggaagtgggtgctgcctatctcacaaagctttttatttaaataaggtagtagttattaagaaatgtaaggataataaccatatatgtttgtgactcttttaaagttaaaagattggaagattaaaaatctgaaatgctcaccatgaggcaaatcatttacatttagaatcacacttaaactaagttgaagtgtgactttattaggaagattatttaaatcccagttgaaatagttacatttgaaatgtgtaaataataagtgttcattatttctactttgaggtttcatgtaagtatcatactttgtaactttcattgttgcttctgtgattcacatgaattgagagtttgtcatctttgtt

SEQ ID NO: 79509 - DNA, 1105 bp, Homo sapiens
aagcattagataaggacatgaatatattaatgtgggttaggctgttttgttagaatatataatgaaggtaatgttaatgtagaattgaacaattatttaaataagttttacaaatggtttgtttttacatttacctatcttaattttatgtcagaaagcctgacttaaatactctaaccatgatcatgaatgcctttgtattatgtaatgctttgtttaagtcttcctttctttctctttgtccaagaaatataatctcacacctgaggcgacggcatctttgaaaaactagtgatcaagaataaccagataaacatgatgggcataagggtcatgaccaaaaagatctctcagtggcatctgtatcactaaatattaggaatattcattcatttcagtagtgccttctgtctttgtgtttattgttgtaagtgtgaaagtgaactgaatactccatgatccatctctgaaaaatattgcctaacctaaatcaccagctttcctgtggcatggatatcctgtcttctgaagaactgtttttgcttttctggagcatgaatgtttgttgttttagagctctttgtattcgagttcatattttatccttatttttagtgcttttcctctaagtagcttgtggaaattatttctgagtaattgaagcttctgtgtcaacataatagtttgttgacataagaaacagtgttaagaaattatgcatttggaaaaaactgaaggtgattttttccagggaatttgtttcctggacttgggatttcttgtgcaaattttccccactagtttgtttttctctactattattttcataaaggagcagcaccagaatagtccttaatatcggagatagctgttgtgtcacttcctcatgctgacatatttactagagggtaaaattaataaccttctagtaagagtggcagtcgaagggaagggctcatctgacttctggaaacctatgttaaaatacagtgctttgaaccttgatcatgggctaattaggttggaaatgaaactagagaccagatacacccaaggaaacttttggtagttattttactttataagtcacaggaaatgcttgtgt

SEQ ID NO: 79510 - DNA, 1038 bp, Homo sapiens
gaaatttgtggggacaccttcagatacattcagtacaagatacagctgttgaagtttattacgtacataacctaaaaagttcagtgagtcttttttgggcttccacactacagagttgtgctcgaatagaaccatggaactcgtgagagaagtgagctcttttttctgtggttattgagggggcaaagatgggcttctcagcttctgcagcccactaggagaatgcagtggtctgatctaattctgagagttgtcaagggatctgatggtgttctcaagctatatgatgagcctgctattgcataattctttactaatagtaggaatcatatcttttattttaactcagatgactataatacttactactgttgtattctaagaaaatgtaagacccttaaatgattgttgaacttaccatctctaaaattatgattcttcaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactggtaagaatacactgataagagacttaaagacatgtacgaccacattttatataaaggcttgttttctacccctaataatttagtctctagttttgaatatgtttgggtaaaactcaagacaagactatttttgtgtgtgaaatctattaatacctagtgtttcgctagactgttctggagcatagcaatcttttactgtaacagtaaccatcttttgccattaaatagaagacaaaattgcttcagtgagatttgttaaaatcacaaatgctccaaaattcttttggtgctttttagatctttaagagtgggagattggggatgttaatatttttgcttgcagtagtgtacattttgtaatatagaaatagtgaaaaaaattgttattaaagt

SEQ ID NO: 79511 - DNA, 1088 bp, Homo sapiens
tcattttttttttttttttttgagacggaattttgctttttttgtgatccaccggcctcagcctcccaaagtgctgggattacaggcgtgagccaccgtgcccagccagatttgaattttttatatcccacagcatctagcgaagtgccttgtctagagtagttccataaatgttaagtagaaacaaattattatagaaataaccaaatttagacccttattctctggaattcaaatttattgcttgagctcataaaatagagcattccacttttgggctgacctgacttagaatttaaacctgagactccattgtgccattttcctgccataggcctttgtggactaaattgaacaaaagcttgtctaattagatactgttcctttggagtatggcagcatctgagacttttaataatggaagaagcatttacatgtagtcaaatctagctttgaggagctaataggcaaataactgaaagattatcacttttccttaggggtcagatatagaaatgttgaattctgtgacccccactgacagctgtgagcccgccccagaatgttcatctttagagcaagaggagcttcaagcattgcagatagagcaaggaggtaagttgttcacaaattctaattttttttttaatatgatatatgagtgatattatgagtcttgccttctttccaggtgggtggcctttctggctaatctaaggggtcgttggaggattagaacttcagtgtaggttgggcacagtagctcacacctgtaatcccagcattctgggaggctgaggtgggcggatcatttgaggtcaggagttcaagagcagtctggccaacatggtgaaaccctgtctctactaaaaatacaaaaaattagccgggtgtattggcaggtgcctgtaatcccagctactcagaaggctgaggcaggagaatcgcttgaacctgggaggcggagtttgcagtgagccgagattgtgccattgcactccagcctgggcaacagagtgagactccatttaaaacaaacaaacaaagaaaaacttcagtgtggatttggtgaaggcccacagaaccca

SEQ ID NO: 79512 - DNA, 1027 bp, Homo sapiens
gttgccaacatacagacttcattttcttggcataggagcttttcagtttccctgtgcttctcagtttctgcagtcatgtttttcacaccttactgttcattgaaaatagagtcctttactgttgctgcctgctccccattcacgattatccttttccttcacctctgtctggccaaatgctacattttcttttagacataactttctccttcattccaacaatataactgttgagactgttctagtccaggagggtctccttatcttagaagtttgcttctatctgttcatacaggtatgcagtcctgtcatgttctgtatggtaaatctatgggtggcttgtctctgtttcacctggaagacagtaaaccacttttcaaacttagtgtcacatatagtgcttcctatagaattaaaaaaaatgtgtctcatgagtcaatatgtttttgtatttgtagacctgaaagatgtctgaaaattccagtgacagtgattcatcttgtggttggactgtcatcagtcatgaggtatgatatttaatactttttataaggtaatttgtaatattaatgttaccagtgatgtaaactgtgttctttgaagatcagtctttttctacctttaagcaaaaagttccaatggacattttccctctcatattaaacttcactgctgaaaacgcttcatgagccagcatcttctacattattgtacatagctttgagacattaggcaaatatttattgaaggtttgttattgttcaggccctgtgctttactttcattttcatataattttgtctttttttttttttttttttttgagacagagtctcactctgttgcccaggctggagtgcagtggcgtgatctcagctcactgcaacctccgccccactggactgaaatgattctcctgcctcagcctcctgagtagctggaattacaggtgcctgctaccatgcccagctaatttttgtattttcagtagagacgagtttcaccatcttggccaggctgatcgtaa

SEQ ID NO: 79513 - DNA, 1031 bp, Homo sapiens
ttctttaggaaaccaatcaatcagtgtaggagggagaaagaagcagaggtcttgtctttttcctgatgtgattaggaggttaagttctttggtgtgggtttctttgcatttgcccccttaccatgctaaactctggtgaaatgtataagcagccttggcttttcctctcctgggtgctctgtgcttcaacattttatatctttcctcccatcagaaatcctgtgtctttgtgtggcagtagtagttggctagactttaagagaaaagcattttctactaaggtatgaatgaagatagtgggaaaagtgtcattaaatttcttttttaaaaaagtatgtttattaagaatgaatctttaatatctaacatttcagacaatatgaccgcatttcagataccatgggaagcagtacatttagtgaattagctggtactgtctgagggtacttccagtttcctttaggctgttgtgacttttcacagcttcctctcctctaattctgaacttagagattttcttctcatttctaatttttagtagcttattgttccatccagtagagcattataaaagtcacatctgcatcttccaacttatggtacagtgatgggaatttggaagcacccctggagcaaagaggctagggatagcattaacatctcccaagacaagtggtataggggaaatgaaggaaagactgtggccatgtatatgccaggcgttaatacatcagagctgcctgtatttaatttaaaacttttgatgaaactcagtggataagcatctttgtcatattttgtcaataatacattacttgcaattatattaaaacttattctaaatacctgtacctttcttgttctgtagatgtgtagatgatgttgcttgtttgtcaaaatattatcttttataaaagaaagtcctgcttcttatcatgatgtatgtgacttaaatgattgtttcatattaaaactatttcttccttatgtactgtttacatatacctctttttgggatattagttcagtac

SEQ ID NO: 79514 - DNA, 1009 bp, Homo sapiens
ttctgttggaagaaaactattcatgctcctgatgcatattttgattgaataaaacttatttttttaaatacattgttttaattttgacctacaaaaacagcaatttcatatggtacaaggtaatacaaggttttctccatttacccttgactagttagaggtgagtacaaaatattttcagtagttgtaaaatatttatctttacaattttaggaaacaaaatgatataaactatacttctaggtactcctttgtgtgaaaactttaccagttgaagcaggttaaaatgcagtattttgggctgacaggcatttgatggtgttcagtagtgtacttgaagatctcattttacttggattttttattatacatatttctctaaatgtttaaggacctagttatgttgctcctgaaagtttaatgagtgctgatttttaataaatgatgcactgtatgctgtatgcctagttgtagcatcagatcatgatttattattaccctgaatagagctagatgatagatattttgagtagaactttccagtgttctcaggagttaacactttacatggtagtacttgagttgtgatcattactaaaatcaattatgcagtttcttaaaccctttatctctttaagtttcagtagttagctgtttttgtgaaaatgaaataacttctcccaagctagtctaaaggtatgtgttatgcaatataattcattttctatttccacatagttgtttttaaaaacctacaaacaggtgaatttttattcaggtgtttaggtcttcaaagcaccttacttaaataagaatctgtaaatattcaaaagaaaaactcacggttcattctgatagtgaatcatagccaaactgtaatcatagctgatgaatagcgttcatgtgtttgaattaattttcctgctagttctacatttgtctctacataatgctaagtcaaaagttatatagatgcttttggatggaataagtgatgaactgtaagaat

SEQ ID NO: 79515 - DNA, 1482 bp, Homo sapiens
ataatgcactaagtcagaatgtcaacatgcctaatcaacattttagacaaaatcctgctgaaaatttcagtcaaattcctccacagaatgctagccaagtttctaaccccgatttggcatctaattttgttcctggaaataattcaaattttacttctccgttagaatctaatcattcttttattcctcccccaaacacttttggtcaagcaaaagcaccacccccaaaacaagactttactcaaggagcaaccaaaaacactaatcaaaattcctctgctcatccacctcacttgaatatggatgacacagtgaatcagagtaatattgaattaaaaaatgttaatcgaaacaatgcagtaaatcaggagaacagccgttcaagtagcactgaagccacaaacaataaccctgcaaatgggacgcagaataagccacgacaaccaagaggtgcagcagatgcctgcaccacagaaaaaagcaataaatcctctcttcacccaaaccgtcatggccattcgtcttctgacccagtgtatccttgtggaatttgtacaaacgaggtgaacgatgatcaggatgccatcttatgtgaggcctcttgtcagaaatggtttcatcggatctgtactggaatgactgaaacagcttatggcctcttaactgcagaagcatctgcagtatggggctgtgatacctgtatggctgacaaagatgtccagttaatgcgtactagagaaacttttggtccatctgcagtgggcagtgatgcttaatcaaaggcattaactaaagtgggtttattttcctgtgcattgcagaagttcattgacacaggattttaatgttttacattatttttttaaatgcatacacaaaaacattatttacttagtttttattaatcacttcatcactagagcaaattttttattgtctttgcttgctgtcttaaatgagaataatgtatatgggggtgctttagaaacataaataaatgttagttgttgttatttatcacaaacataaaagcctcttgaaacttcaaaataatatataacaaatgtaggcaagttttaacttttaaaagttagaatcattgaaaaacgtgtatttcagtgctgaactttggttgtaccatattaaagatttagttcaaaaagtttatcaaggatccacttaacacgtcttcacaacataatatatgtaactgtaacatgggggaaagcatacatttttatggattaaaaaaataatagtatgacaccagattcctcctccactagggtctttggaatcaatgaatttcatatttcaagtgagttttcaggatatctgtttgtacagatacgagacagatcttagcatatagtaaattctcagtaagtattgttgattaacttgtggatggtaccacatgaaattgctaatattagatcagttgaaaattgactgcaattagtaaagttggtataacgtacg

SEQ ID NO: 79516 - DNA, 1041 bp, Homo sapiens
cggtgtcagctcaagaatattctgagagttaagtaccagaataaaagacaaaacactttttaaaataaaaagtcagtatttttatgttatggggagaattttcttaatgtcattttgtaataattagaacattcattaaaaaattttttggaatattttatgattagctcttctgaagcaccattctgctgaacttcattgccctggagctttttgttatttaatgtaatttatatcatcagactgcatgcaggatgtggtgtttgcagggcataaactctggagcagtgcttttcaaactgtttcccatctgctgatgtgatagagacagacctttttaatggttgtgtatttattttatatgtattaaaagagtcaccaaataccttgcttaggataaggctaagatacatatgtgtataaatacacacatatagcaatttaaatgaattattaacacacatatagcaattacatgaattattaagaaagtaatattataggtagaactcagatatggcaaaactaaaacatgaatgactgaggactttacagtagcatgctctgcagaccaaaagcatcataatcacttgtgatgcttattaaaatatagattcgtggatctacggaatcaggacttctgggatccacagagttgggacttctgcatctttaacaagatccccaggtgctccttatgcatactgaagtttgagaaatgccactaatagacctagattataaaggtgtgagtagaccagaagcagctggctgtggtcttccaaactgtccttatattttaacaatagatttagaattactctttagtgacacagtatcttactcctattttctaccagttcttaacactccacccccaaaccttcaccttttgattataagacagatctatgaggacaggtactatgtcttgattatcttatttgccttgcccatagtaaatgtcaaatgaatgaatgagtgaatacatgaattatgctgctttctgatagtccatttcccctcatactacttttactt

SEQ ID NO: 79517 - DNA, 1013 bp, Homo sapiens
atgattggcttctttttttagaggaaatattttcccttttttcttatccatatactattctgaacagctttgcagatttccttaagttcatagcttgtaagtagttcatggtatatagacatagtcttgacttacaactgaaaaaaaatttatgttacagaagtttattttttctatggaactgtctttaaaaacaaaaatattacaaatcttgaccttgaaatattctgtttcctgttatcacattctggatatctattttgtttgcaaatgaaaattattactgatgattagcaacttgagcctgttaataggaaattgcaaagcctgaatacacacacattgccttagcctatcagtagagtagaggacatatgttaagaaaatgtgtctgcttgttgctgttgttggacaaaattttatgtctgtgtgtatgatttttttttttctattttcttcaaagatgtgaattaaatgaaagtgtgggagccagttaaattattttgtattatgggtgttctggatcctttcactccgtataccattttcttgtaagggcagcatttgtagacttgctaatggactgtagagctgagctatattaattttatacttgactcaggggatcagttctgtgaatgccattgcacgaagaaagcaaatgtttgccttgattttgaatgtatctttttaatgtcttcttaaaacatatttgtttaataatgtagatttgtttttttttttctagtatcatagtaaatattgcttagtacttgcccccaccccactgggtagtttatatactaccctataggtcatgccaaaaatgaataaaagtttaaatgccaaaatgtttatgaaactgctgtctaaatactgattgattgcacaatttaaataaaagctttccttagttaaaaaagacaaacccatgttttcttttattcttcagttttcttttgggggaatagagaatgaaaattttccatttataggaggttggctttcacatc

SEQ ID NO: 79518 - DNA, 1074 bp, Homo sapiens
agatcgtgtcacaagaatttggaattgaaaatatcatttattttttaatgcaagaatacccagatgtggtttcacttcagcagtagctatagtggttcacttatatacatttctgtttcactgaatgtaaattttgaatactgaatgtaaaaaaaaaactccagttatattgaaacagtcactaagactgcacatgtgttttgcagactttcttcctgaccatttgccacatgggtctctgataagattctgttggtttaatagtcaaaataatctttgcagtttgtgagcactgagtagcaggttctggagactaccatatacaaccagttgtctaattgtgatttttttattgatgtttagaagaatgtaaccgtagagttctgtgttaagttgatttatgctcaggacataagatcacaggctaatgcaatgtgtatgtttcaggctttaatcttctcaatttccctttttaagccgttgatggtgtttaagattaacatgacagtcttgtatttttaccagatactgtattatttttcctattgctgctgtaacacattaccatgaaggtggtggcttaaaataacacaaatttttcttaagttctgcagatcagaagtctaacacaggtctccctgggacaaaatcaaggcgcttgcagggctgtttctttttgaggctttagggaaaaatctatttccttttctagttttttaaggctgggaacccctccttccatcttcaaagccagccatgtagcatctctctgaagctccttccgttatcatttctctttgtccaaccccagctgatacaggttatctaggtttaaggattccagtgatcacattgagcccacctaaataatccaggataatctccccaactgaagttcctcaacttaatcacatctacagagttccttttgctatgtttggtaacatattcactggttccagggatttgggcatggacttctgtaggtggccagtattttgcccacaacaggtacattctttctgtggaattctgatccctgtaaaatgtctgtagcattaaagagattggaaa

SEQ ID NO: 79519 - DNA, 1746 bp, Homo sapiens
attttgtttgtttggtttttgatgaataggcttatagttacaatagaactttaggctataactatttgataattatttaacagtacattttttaccttttcattttgttcttatacggactttttcataataattctgttaccaaagaattttcagtagaaaataaaattttgattataattccccccaaattgaattaactagaagcatttatagatatgaaacttacacaagtagttactaacccaaaacaatagggtttatattgattgttgtagttaaatagattagtaatgttaactaccttattgttaccagagcatttaaaataagttgtaatactttctttaccagcagatcgttccaaagaatttcaggtatagttttttcttcagcaagtaaatcttcaactatacagtattaaagtatttttatattgttgaaactacttgttggagagaaaattttttttttttaccaaaaataaatactttggtctcattgaataagatatttagtaatacagcaaagacttctttttacttgaccaaatcaagcttctttgaagtcttaagtatgaaattgtaattaaaatgtgaagattttcactcatttttcatagtggtattacttcatggtattgtacttcaaaggggctaatatgcaaatggtaactattttcttttccaaagatgtatttgctgtaagtactgatacctgcatgtcatttttatgccaaatattacaagatactgctcatcagtattttcataccaaagaccattaagatgtataggttagcctgtaagtaagtaaagatgagcagatttgaaataaatttatttagaggccgatagagaatctagctttagtagcaaaaaatatcaaagggctaagtttacataattaaaagcaatacaattatattggtatttatcagtgtttttattcaagtactttttatcagcaaattaaaaagaaaaaaaccaaagatatttaaggttacctccgcatataggcaaatatagttgtacattaaactgttgtttcttgtttttatgttaaaccaaacatgtctcttcggaacacagtctgtatacaaataacatgcatgaggactttccatttaatctgtgattcagccacatgatgtttttgccaaatgatgtgatactttccaaagcaccttgagtgtgaaatgtcaacagaaatatcagcaagcttttatgttgcagagtattatggtacctctgaattagcctgtatagttctcttcctgctttaagcattacctggttagctcagacggcttgaggcagtcccttaataatagggatgcttttcatctctaaggatgtaagaggcaaacaaatcatgtcattctttaagtgggctatgctttgatagatgtgctctttaaaggtgtgagattggaatttagagttgttaaattgaaatgtttgcattgcaccaaaggagctcagttttcaaactttaatggaaccttgggtaaagggaaaaaatttttaatgaaatctggggttttatattttgattagcctaaaagtaaaaatacagctttatccattaagtgacttttaaaaatcagttttgccataccaaagaaattagattcttagtgtcacatgctatacttttgtctgtgcttgaaacgagcaatgccaacattgggaacaatgacagaggtttgcatcagtttgtcttggctttgttaaggacttctgc

SEQ ID NO: 79520 - DNA, 1333 bp, Homo sapiens
ggcaccactgtattaatcagtgatgaagactcccctagctccccaggtcagacaaccagcttctcaagaccctttggtgttgcagctgatacagaacattcagcaaatagtgaaggcagccatgagactggggattctgggcggttttctcatgagtccaacgatgagatacatctgtcctcagttataagtaccacaccccccaacctctgattctttcactggcagtgattcaggtggagattccgcattgaggaagtgtgaagaccctgctgtgtcatctgttagtgagcagacttcctccttagttctgcagccgccatctgccatgctatgctttgataaaaatgattttccaatctagacggccatgctcaggtattctcaccattaaatctgttcgaaggacaatgaacagggaaccaaagccttttgtgaaaatcttaatatctttatggggtattttagctttttttgaatgtgttttgttttttatttttaaacttgtgtaatttgaatgtttcattgtcagcaatgtgaaagaacggtcgagatgtttgactggattataaaatatatcactggagcaaagggaagacttttgaaagcccctttgctgactatctacctcagtttgcctcccggcaaactctgaagacaactttgttacctcatttgttgttatagtttatctcagctacataaccaatgatacttcctagtagtattgtgttttcattgctgtacgtgtaatgtgtgtgatcaaaggagtcatataggtagatgagtaagaatgtttatctgaagctctgatttttttaaaaaaagaaactatgacatctgcatggtttggataagttcatacctctggctgtgaggaccgttaaaccactgagaagaggaaaagtggggctatttcttctaacgatgaccaaaacaagaaagtatatttcttttgagaacagaactattcaataccaggtagggatcattttgcttaaaaggcctttatgttttgggcattagagtctgagtgctttatctcctatatcccaaacctcaagctgcccagaactgtgccttttctaccttcccctttgcctgacggttggccaaaggctgcactgtctagtttgcaaagcatcctcaactttgccagtattagttgcaaaaccccatgcagaatatggatttttaaagaaaatgggttaaggtggttttttttctttttttaaatcccagtttggcttaaaggagtgaagacatttcatgaactattaagaatgaaggtaaatgcaacagtagacagtaaaatgaactcgaagttattatg

SEQ ID NO: 79521 - DNA, 1033 bp, Homo sapiens
gatctgcttttaaggcatgacataaaatctgttcttgggtctatcaaggaacatctatgttttgtacctgttttataaattatgaattgatgttcatgattgctataataatatatctaaaactcatttaaaatctttaatattgggccgggcgtggtggctcacgcctgtaatcccagcactttgggaggccgaggcaagcggatcacgaggtcaggagatcgagaccatcctggctaacacggtgaaaccccgactctactaaaaatacaaaaaaaaaaaaaaaaaaaaacttagctgggcgttggtggtgggtgcctgtagtcccagctactcgggaggctgaggcaggagaatggcaggaacccgggagttggagcttgcagtgagctgagattgcgccactgcactagcctgggcaacagagcgagactccgtctcaaaaaaaaaaaaaaaaactttaatattggaagagaaatctgtctctgaaatcactgattaaagattactgtgtgtcctttctgctttgatgttgacaatgtcaaaacttttcctatgagataaagaaaaattttggaaaagcaagtacctgagaattataaattaaataatttatttttctgattgattctgagtaaatgtgttttcccttctagtttattcaggatattaccatctggaccaaaaatcaatgactggcattgctgtaggtgttggcatagccttgacctgcatcctcatctgtgttctcatcttgatataccgaagtaaagccaggtgtgtttccattgctagagatgttgaggtgaaaaacatttaaattacggtagccacaggaaacaaatgaaagtcaagtgccttttagagtaactgggatttcctactttaaaataaatgtgcagtattgttccctgagttcttacagctatagaaatgtgctcattttagagggagattattttcttgctgtttgaaaacattatgccaatattctttttttttcttttttcttttcttttatttttttgagacg

SEQ ID NO: 79522 - DNA, 1011 bp, Homo sapiens
aggcaggagaatcacttgaacccaggagacagaggttgtggtgaaccgagataatgccattgcactccagcctggtcaacaagagtgaaacaccatctcaaaaaaaaaaaaaaaaaaaaagcaatgtatattttgttctggctccttttaaatgtattcatttgtaattttggaacagagctcagaaaatagtattttgtctcattgatggctcagtagtgaaagggattacagttacagatttttacatctgtataagcctttctagctatataatagtgcacaggaaaaatattctcttagttgttgtggttttaagaaacatttgtgaaaagcttttgtcatttgttaaatgcagagaacttttttcgtagctaaggccaatgattcatagagaacaaataaatcagtaaaaagcaactgagtttacttttctgagagagaaaaacagtttgactcacatttaaacaaaaagcaaggaatataacatggcatttaaagaaaaattaaaatgtcttttatgtataattatggcagcttttggaaaaggtacggtatagaaaaagatgaaggaaaaaagaatagggagagtgtcagtttctcattaggtttatacatatttacatatatatttaatccacatattttaatacaaatggaacaaggtagtttttgtgaatcaaaacatttaaaaatgtttctggtgagcatataatacttgtggctaaaatggtacatggtagtacaatagttgagcagaaacatcatatgaaattatacttgtatgtaatttaaagtaaataaaaaattatagggcgtggtggcatgcacctgtagtcccagctactcgggaggctgaggcaggagaatcgcttgaactcaggagacagcagttgcagtgagccgagatcgtgccactgcactcagtattaaaaaaaaaagattacaggcctttaccctcctcatatgcagtaaatcagcacaaactgctcaattctttttaaatctaaa

SEQ ID NO: 79523 - DNA, 1013 bp, Homo sapiens
cctactgtctctccatttatgtttaaaagaaaaaaaaccccatgagttgaagcaagtaaagtttacactgttatgaattacaatattctgttgtgttaagctctgttatgttactactgtacattgtctctgctgtgggttttgactagatggtaaatgaagtttagagaagatgaattcttttcagtttgatttattcaggaaaaatgtcctctaataatttgtagtgaaatatggttacttttagaaaataaagaccttcctgttcacattttgtaaaggggcacagaagataagagattgagattagacccaaggaccagtgtttcacagtgcaggaaaatggtcttgttaattttattttgaatatctgtcattttaaaacatggattctttaatttaggtttaaataatgaagagtatcaagtagtcatcggaaatgacacaactcattatattattgatgacttagagcctgccagcaattatactttctacattgtagcatatatgccaatgggagccagccagatgtctgaccatgtgacacagaatactctagaggatggtaagaaaacatgattctagatcatttcagtatgaacattcgtatgttttgtcaatttcaatgaataaatgtgttttaaagaaaatatcctctttttggttaaaaaacaggtatgttaaatttgccgttcaaaatctcactcttgctttttgccagtaacataaggataaagagcactttcagaatataaaatttaataataaaattcttatattcccattgtatttcttcaaaggttactagtttaaattgtaaatatgttgcaaacttttttgtactgaatagaacattttctaggcatgaataactgtaatgactgttacatattgagtgtatgtagtgaccagggccagaggtactggacttctgaaacttggactttatacgatttatcacctgtcaaaaaattcttagcacttagtacctgttgattaactacaatatg

SEQ ID NO: 79524 - DNA, 1044 bp, Homo sapiens
tgaaaacaatagaatcaagctaatattttaaaaggtctttaaagtattgcttgtagcactgtaaaaaggttgagtgtattcctatcacagaatatgttaaataaaatatgtagtctaagcccggcacggtggctcacacctgtaattccaacactttgggaggccgaggcgggcagatcacttgaggtcagaaattcaagaccagcctgatcatcatggtgaaaccccatctctactaaaaatacagaaatcagctgggcatggtggcgcacctgtaatcccagctgcttggtaggctgaggcgggagaatcgcttgaaccctggagacagacgttccagtgagctgagatcatgccattgcactccagccggggcaacaagagtgaaactccatctcataaataaataaataaataaataaataaataaataaaatatgaaatctactacaaaaagtttaattatctttctctcataacaggataactgccctaccaacaggagtattgcagatctatgatgtcagccaaagggattctggaaattatcgttgtattgctgccactgtagcccaccgacgtaaaagtatggaggcctcgctaactgtgattccaggtaccacgcagagtggtttttccatttttatgacgttttattggcgcagttgttacttcttctcctctgctgtaataatgtgccataaagtagaatttcatttaaattattataatctatttggaaaatggtcatttttagttattaagcaactcttctttcataggccagttttctatgttatgtcaatgtctttaagaaatattcagtcttaagaaagattaacaaatattcagtctttggtattctattcaatgccaaaattcactgatgctcaggtctctcatagaaaatggcatgttattttcattcacctatgcacactctcctgtatactttaaatcatctctagattacttataatacctaacaatgtaaattctatgtaaatcattgttatactatattttaaaatttgtgtattttta

SEQ ID NO: 79525 - DNA, 1063 bp, Homo sapiens
ccgccatgcctggctaatttttttgtatttttagtagagacggggtttcaccgtgttagccagggtggtctcgatctcctgacctcgtgatccacccgccttggcctcccaaagtgctgggattacaggtgtgagccactgcgcctggcctttttttttttttaatttaagttctagggtacatgtgcacaacgtgtaggtttgttacataggtatacatgtgcctatgttggttttgctgcacccatcaactcataatttacattaggtatttctcctaatgctatccctcccccagactccctcccctttttcttttttttgcaaacgctcactaacaagtctgtttgttgggactacacccagctaaaaagagttaaaatatgtatttggcataaaggaagattttttttcttttgctatggcaaggagatatgcattcatttttttctagtaattaggctaagcagtttaaatatttagaaggatggatgctgagacatgatgctttttgacagcatttacaattagaatcacatttttgtgagattatttccttgttggttttagaagtagtggattaacctatagaagcctttgaatggatagatgaaagctgcttgagtctaatgcagcttatcaaacactggtgtttgtctggagtgttttgaagaggggaagggaagaatgaaagcagaaacaagataagaggctgatagtggttcaggtgagagattgggactggaacagaagggaatggatttgacacgtgtttaggagttaaaatcagtgggaacaggtgattgagaatacagaaagagtaagtagtctctagcttaggtgagtaatttgatagtggtgtgacaaagatgaagcagagatacagctttggaagaaagaagatcacttcattttggacacgatgactttggagtgcctttgttttgttttgtttctttttttgagatggagtctcgctctgtcaccaggcgggagtgcagtggcacgatctcagctcactgcaacctctgcctcccaggttcaagtgattctcctgcctcag

SEQ ID NO: 79526 - DNA, 1055 bp, Homo sapiens
gctcctgggaatattaaaggggtctctagttctacttgggaaaatcaggactaactttatagaagaggtgaagatagtctctaggagtcagctttttaaatctctgtgtgctgtcttcctgcttaatttataagttttcttctttaacactggctagaaaattaaatagaatcttttctgttttttaaagaagtatagccttcttgaaatttatttttaaagtttacatatagtaaattctgtctttcaaatctatagttctatgaattttaacacatgtgtagagttgtgtaaccatcactacaatcaggatacagaatagtttcatcatcccaaaacggtctctcaggctgtactatatagtcataaccctctctctcccctgactcctagcagcccatatattttgcattttctggaataccatataaatagtagaattatatattatgtaaccttctgtgtcttgcttcttttactcagcataatgcatttgagatttattgatctatattgttaagacttacatattttgttttatcagtagtttgctgctttttgttgctgagtagtacttcactgtatgaatttaacacagtttattcattcactacctttgaaggacaattaggttgtttccagttttggatgattatgaataaagctttcctaaactgtctcatacagacttttgtgtgaatgtaagtttttatttctattgagtaaatatttagagatgagaatgcagggttttgttttgttttgttttgtttttgagatggagtctcactctgtcatccaggctggggtgcagtggcgtgatctcggctcactgcaacctctgcctcccgggttcaagcaattctcctgtctcagcctcccaagtagttgggattacagtcgcctgccaccatgcccagctaatttttgtattttagtagagagggagttttaccatcttggcctggctggtcttgaattcctgacctcatgatccacccgcttcggcctcccaaagtgctgggattacaggcgtgagccaccgcgcccggcca

SEQ ID NO: 79527 - DNA, 4177 bp, Homo sapiens
agatcacctgaggtcaggggtttgagaccagcctggccaacatggtgaaaccccatgtctagtaaaaatacaaaaattagctgggtgtggtggcacactcctggaatctcagcttcttgggagggctgaggcatgagaatcatttgaacccaggagccagaggttgcattgagccgagatcatgccattttacttcagcctgggtgacagagtgaatggcttgtggccaggagttcaagaccagcctgggcaacatagtgagacccccatctctacaaaatgaatttttttaacagttagccaggcgtggtggtgcacacctgtagtcctggctactcaggagactaaagcaagaggatcacttgagcccaggagcttgaggctacagtgagcttgaatcgtaccactgcactccagtctgggtgacagagggataccccatctctaaaatataaataaataaaccagattagttccctgtgtgtgtgtaggaactagtgtacactagaaaaagttttgatatgcctggagatccttgtagagagtaaatgaaaccaaataaattcttccttataggttcaaatggaccacagtcatttacagttgaacagtggggtactcctgaaaagctgccaagagctcatacctggtaagcagttgtttggaccttgatagaacaaagcctcagagagtgagattcctctgttagtctagccacagcagggctagtctcctctgtgttatgtcggtggcaggtatggattatgggtaagaaggagttggtgacacccaacgaacaggtgttttgttaccaagttggcccaagcttgaagtccaggtagctgaagatcagagagacccacctaaactgagtgatgagtgatgggctgtcccaagacaggctagaacattccatcttggaggctgaagtggcagagaactcagacatttggaagatgtggtgggggcagcactccacaaggagttgtgcagagtatccatgcccagaacccagtcctacgtcttacttctacccctggtgaaaagacatattttggtggtgttggaacattctcatcaagaatagcagcattgctctgtttgctgtggtggtacttgctttgtcagtgtctttcataaccacttcctctctgttctttcagttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcatgctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgttggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatctatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtg

SEQ ID NO: 79528 - DNA, 2548 bp, Homo sapiens
tgacctccctgaggagcaggtgaagcacaggtgcaggcctagcctgaaagaagaggcggcactgcggtgggaaggaggccatgatgggtgttggtgatggttgggacgcagggatggagaagcttgagggagttccattgtgcataattgcctcttttccctcaaatagaacttacacttacctactgtaaagaaggggtgatgtggaggcttgagaaggatgggaaatttgttttttgttgttgttcttgttgttttgagacaggatctcactttttgccgaggctggaatacctcagcctccccagtagctgggaccacaggttcacaccaccatgcctggctaatttttgtatttttttgtagagatggtgtttcaccatgtttcccaggctagtctcaaattccttggctcaagcagtctgcccacccagcctcccaaagtgctgggattacagaatgagccactgcgtctggccacaggaagttttaaaaatagccactttgaggaataaatgagagagaacagactgtgcacatgtacattttctggccaatattgagatctcagtgaagagcccgtgattgtgtagtggtagaaacttgtgtggatgtgggattcctccagtagcatccagaagctgaggcataggaaaggccattggccctgcccatcaagtttttaaatacatcttttttctagggattctttgaactaataccacaggatctcatcaaaatttttgatgaaaatgaactagaggtaagacataacattttatgttgaaacagaaattgtgaacccattattttccttgtttataatttgacatttcttatgtagcttcttatgtgtggactgggagatgttgatgtgaatgactggagggaacatacaaagtataaaaatggctacagtgcaaatcatcaggttatacagtggttttggaaggtaatttgaaacttctattttcataacttactttttgatagattgaatcatatttaagtcaactcttgattaactatactggtggattacatttaactgatacagaaaaatatacagaccagaaaaaattatctttgattttatactgtatacatgcaccttctgggtctgtaactattactaggtaagtaaaatgttcagaaggtagtaagtggaatgacaggctgagacaggcacttagttttctactaaagtagggactgaaagaacttgtaataacctgcagggtattcctagggactcctgggtggctcttttaaaatttctcatagagaaatatgtatgccattcaatcatattaatataatgtgttttttgagatggagtctcgctctgtctcccaggctggagtgcaatggtgccatctcagctcactgccacctccacctcccatgttcaagcaattctcttgcctcagcttcccgagtagctgggattacaagcatgcaccaccatgcctagttatttttttttgtatttttagtagagacggggtttcaccttgttggccaggctggtctcaaactcctgacctcaagtgatccacccacctcagcctcccagagtgctgggattataggcatgagccactgcacccagcatataatttttaaaagtcatgagtcacatctcaagagaaattttgttacttcactaggttataatcccattctaaaaagttgacatgtagccttagaaataaagttttcaagaactttataaaccatctataaacaaaaatttaactgaaagaaacatccacatctagtaagggattattaatattctaaattccgatagcttatgtttcaggataatttgtttacctctttcccagtgctgttccctaaatgatgtttttatcttattcaggctgttttaatgatggattcagaaaaaagaataagattacttcagtttgtcactggcacatctcgggtgcctatgaatggatttgctgaactatacggtaaggattttccatagatcattaaaaaaatggaataatgcgtattgtctttttcatggctgacgaatccgcaagcttccatcatttactaacacttagcttaattttaaaaagaattaagattttgaaagtgataccattagggacactggagtaggctaaaatatatttacaccttctaatcagataataaaggggaaaactggaaacatcaaatgacttgagtcactttccgttctttaacttcaaattctatgcccagtatgcatccgttacagaaaaagcattaccttggccgggaggggtggctcacacctgtaatcctgcacttcaggaggccgaggcaggcagatcacttgaggtcaggagttcaagatgagcctagccaacacagtgaaaccccgtctctacccaaaaatacaaatattagctgggcttggtggtgcacacctgtagtcccagctacttgggaggctgaggcaggagaattgcttgaacccaggaggcggacgttgcagtgagccaagatcgcaccactgtagttcagcctgggtgacagactgaga

SEQ ID NO: 79529 - DNA, 1486 bp, Homo sapiens
tcgccccactgcactccaacctaagggacagagcgagaccctgtctcaaaaaaaaaaaaattaaattaaaaaataaaaataaaacatttaacacgaagtcacataggcatatgaggaatgtgctaagtgctcctggatatccagagaagttaggttttatctgaaaacttctgtattcattcctttaactggatgataaaatctgtacctccactgcttccacataaacatagattctaaacttttaagtaggcaccaattgattaattgattgatgcatttttactcttgcccttacctgtcatccatctctttttgtaatacacacacatacacacatacatttttgtttatatatgtgtgtaagtaaaggatgtccatctgacctctcatcttttacccaattattcagaccctctacatactgttttttgcaatttcaggtgtgttatagatacaaattttaaatatgtaatttttcccatctaggatagtgaatattacaattccctaagatggattcttgaaaatgacccaacagaattggacctcaggtttatcatagatgaagaactttttggacaggtttgtgaattttgatcagttaaaatggcacataaattgtgagacaaatgtttagatgttaatacgtacacttaatacattcctaggctctgtttttacattcatttcccagtaacaaaagctgtctctgagcaagaatttgtactttctttaacatttgactcgttccatatttattttagtaaaactagtattttaagttttcttagtttttaacttttgactggacttaatttaaaacaccaagtttctcgtataactacaatatgtatactttttaaatttttctcgctaaaataacatatcaagttattgtgtttaattttagacacatcaacatgagctgaaaaatggtggatcagaaatagttgtcaccaataagaacaaaaaggaatatatttagtaagtattttattagtatgtattttattggatataattttgtactttattccagaaagactcttcttaccatctttctctgtccccttgtccagaatctcagtgttctttttctctatcacaatgcagtagcaagcactcatattcagcttttaccttggtctcagctagcctttagtttttgtttctaactagaataattgtgcctcagaattttgtcttggttcacatgaaaatgaaatgttgtttctttttagtcttgtaatacaatggcgatttgtaaaccgaatccagaagcaaatggctgcttttaaagaggtattcattttcttttatttgctcttccataatgtcacagtataacctataagtttcaaatattaggcctcatcacatctgagaaaaataagtatatggcttgttttgtgaaatcattctaaattatatttttatattaactaaatattccattcagtcattcaagaagtctagacaataa

SEQ ID NO: 79530 - DNA, 1253 bp, Homo sapiens
accatcaattgcttctttaggccgggtgccatggcttatgcctgtaatctcagcactttgggaggccaaggcgggaggattgctagagcttaggagtttgagaccagcctgggcaagatggcaagacctcaaaaacttaaaaaattagtcaggcatgatggcatgcgcctgtggtccagttacttaggaatcggaagcaagaggatcacttgagcccatgaggtcgaggctgcagtaagccatgttcacgccactgcactccagcctggactacagagctgtctccaaaaacaaaagcttcttcagatgtaaagaagtctatattactaagtgattaaagaaaatgcagaaactgtctcataccatagaggaaaccaagacaatatacctagttgtgttttccctgagtatattacgtaaggaaaaagagacttggacacagggtgtagagggaatgttataactttatgagagatgggtttgttattatgttgaactgatttaaacagtacgtctctcctctggattttcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacgtaagtacctttacaatgattatcggcagaaaaagaaaaatcactgttttaaaagtaagagtcggccgggtgcagtggctcatgcctgtaatcccagcactttgggaggccgaggcgggcggatcacaaggtcaggatatcgagaccatcctagctaacacggtgaaaccccgtctctactaaaaatacaaaaacttacccaggcgtggtggcgggcgcctgtagtcccagctactcaggaggctgaggcaggagaatggcgtgaacccggaaggcggagccgagatcacgccactgcactccagcctgggcaacagagcaagactcctctaaaaaaaaaagttaccattttagccattttaaatatacaatttagagtcattacatacattcacattgttgtgctgccatcccactatccaactctagaactttttcatcttcccaaaatgaaaccctatacccagtaagcactcgctccccattccct

SEQ ID NO: 79531 - DNA, 1599 bp, Homo sapiens
cgggtggatcacctgaggtcaggagttcgagactagcctggccaacatggagaaaccccgtctctattaaatatacaaaaattagctaggcatggtggtgcatgcctgtaatcccagctactcaggaggctgaggcaggagaatcccttgaacctaggaggaagaggttgcattgagctgagatggtgccattgtactccagcctgggcgacaagagcgacactccacctcagaaaaaaagaaagaaatatcatgtggtccaatttaatgtcctactctttcaccagtttttacatagagaaaagccctatatagtgacacatttcctaaagagcggggcaaaagaaatgaccagttagtggtgatccctgagaactgatcgttattccttttgatattatagcctgacagtgatagattttagaaggagaaaatattgtgtcacatatttaggaaataaagtataaattgacttttacaagagaatattttaaatatccattgatgttagaaaacatggtaacagactgactttgattattttaaaatttgtgtgtattgttctttatttactctaccaaaaaaggaagatccaagattgaaaattccagcccatctgagaggaaagacatcacttgatacttccaatgatctagggcctttacctgtaagtgtatagaaatgctaacccatctaacttggctatctcaaatattttgcattttcgggtatagtatttctttatcatctataattaatgttattattaaaatgttgataccttctaagaatggaatggaatatgcaagttaaattaaccatacaaccagtgctatttttctatccattcatctacgcccctctcctaaaataattgaaatacatttttaattatagccaggatgggaagagagaactcacacagatggaagaatcttctacataaatcacagtatgtgcagtgcgatttttcattatgttattttttgtaataaattttatgtgtgagaaagtacatcttttttctttttcttcccttcagatataaaaagaacacaatgggaagatcctcggttggagaatgtagcaataactggaccagtaagtctctctgccagtgtgctctgatgggactgtccgctcacctgtctcttcaagagcagatagtcacgggcataaccctacaggcattgagaggaaagcacattggccgttctctcctctcccccatttcccatactccaagtctcagttatttgaaaagattctataacgtcattatccttaccctacgcaatagcagtgaggggacaagtgagccagacagtcagaatgctaaggcagtgtgggctgctgagctcaggctggtgcctcccactgtctgaacaagaatgatgacagtcctccacaaatcagagaggagcagagagtgtatgcggatgaggaagcagcagcaccctatccactccagggtcattcttaaatttttttatagaaatcaagccaggctcacacctgtaatcccagcactttgggaggccaaggcaggtggatcacctgaggtcaggagttcgagaccggcccggccaacgtggtgaa

SEQ ID NO: 79532 - DNA, 1063 bp, Homo sapiens
aatcgcttgaacctgggaggcggaggttgcggtgagccaagattatgccattgcactccagcctgggcaacaagagcgaaactccatctgaaaaaaaaaaacagaaaagaaaatgtaaaatattgtttatatgcctgtgtttctaattttgcaacgagagaacactcattttattttatagaatgaggtgctgcttgataaaaaaaaaactttgcattgatgttgtggccctgtaagtctacacctttttgcttaacattgttttaaagctctgtccatgttgttatttatagatccagtgtatttctcttaactactaatattccatcatgaatatattgcatttcaattatccatttctgtggtagatatttgccattcattttgtctgcccatcatttgaatctacttctgtgtatgaggaattccccatcctgtgagttttgggaaaacaaagacgacctcctcctataggcacgagagctccccttgcagctagggcttgagcttgcagacctcgctccttcagtcagatgcacccacagcatactgttaactaacatcttactgcttgagaattagttgaaaaattataaattactgtaaaaataaagttttacaaaataatttattggaaaaatgttattaaatgtaatgcattattgaaatgttgggaaaatattaacatgccataactacatttgaaaatgagcctcaaatatttagagtctctttaatggagggtgtgtattctatttgcaggttaagttacctttttaactacatctatttgtgagttctctctataaaatattacaatatgatttcattaatgtgctaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggtaactttgatacttttccat

SEQ ID NO: 79533 - DNA, 1108 bp, Homo sapiens
gggaggccaaggcaggtggatcacttgagattaggagttcgagaccagcctggccaatatggtgaaaccctgttgatactaaaaataaaaaaattagctgggtgtgttagcacatgcctgtaatcccagctactcaggaggctgaggcacaagaatagcttgaacccaggaagcagaggttgcagtgagccgagatcataccactgcactccagcctgggcaacagagcaagaccctgtctctctctgtctctctctctctctctcactctctcagaaaaggtaaatatatatatatatatatatatatatatatatatttctagaaaaggcaaaactgtagtaacagagcagatgagtggttgcttggggctgagagtagacatagggacagagggaacttttgggggtgatagaaggattcttaaacttgatgtatttaattcttctgttattcttcactttagcttttgcctacttcatctggattaccaccaggttgggaagaaaaacaagatgaaagaggaagatcatattatgtagatcacaattccagaacgactacttggacaaagcccactgtacaggtatcctgtaatctatcaacttgctttcttacaggatttaaactgtcacatccctatgtaaactattacatcactttgtaggatacactggatacttctaccaccttcttttttttttttatttttttgagatggagtctcagtattgtcgcccaggctggagtccaatggcgtgatcgtggctcactgcacctctgcctcctgggttcaagcgattctcctgcctcaccctcctgagtagatgggattacaggtgcccgccaccacacctggctaatttttgtatttttagtagagacagggtttcaccatgttggccaggctgatctgaaactcctgacctcaggtgatccacccacctcggcctcctaaagtgctgggattataggcatgagccaccgtgcctggtcatagcatcttctaattatttatattctgacactgatgttaagtgtctaccttttcctatgaatctctaatatacacgaattaccacttgttattatataaaacaagtacaaa

SEQ ID NO: 79534 - DNA, 2775 bp, Homo sapiens
attataaagttcttacaccatctttcattctgcccttcacattcatgcatggagtactctactcctggcttaagaccaattctagaaaatgtactatctgattcacaaagatgtatgtatgtgtaactctattactcttataataacatggcaaaataatacaatgaaataatctatgaagcgctctgatatttattcattcaacaaatatttttgagtacctatatgtgttggacattatcctagacatagtgacaaactaaaatatcaaatcagacatgttataccttttcacaaaaccttaaactccgtaaggtactctaaatataccagtctgcctacccatgattgaatctttgcatgttgaaatagcctttggtcaaagacaataaatttttttattgatgtaatgtagatttttttcccaatgatcacagaatctttgacaatcattttaactacttaagacatggatgatggctttttatacttccaatatagggacaacctaacagatgctgagaatggcaacattcaactgcaagcacaacgtgcatttaccaccaggcggcagatatccgaggaaacagaaagtgttgacaaccgagagtcttccgaggtataagtagtttcctagttctccttgaaagacacatgctatagcaataaagtatgtgtggctcaagcttattctgttcattttagaactgggaaattataagagaagatgaagccaccatgtatagcaaccaggccttcccatcacctccaccgtcaagtaacttggatgttccaactcatcttgcagaagaattgaatgccagactcaccatttttggaaattcagccgtgagccagccagcatcgagctcagtaagatgctcttagattttgttacggcttcagtagtttatattatgcatattatactattcaacaactaacttttatgtaaaattttgtcttaaatgcaataatatgtaataatacattagggaccttgggactttacaacatggtcatttttcaaatatcctcattagtagtatggaccagagtcatggcatccaaatttccattatgtcagtgccctccagtcaaaaatcactagggacacatttgtcattgaacaagttgggtttattattcatttcagcaagggagaacacgcaccattggtgttttggtagcagaatgttagaaaagacttcagggatttgggctcctgttaggtgattttgaagagggttttaggaagcaggactttgctctacatgagatgctgttgggaagcagggataattctatgattttgtatctcaaatcttatctgtagtgaggctaaagctatgattagcaaagtagaacagtcactcacatttgccaggatggggaaatgtttggtattttgtggcttggacaatgttcatgttttgtctatattcagccacgattacagagtggtcttgattttgtcttgatcttacctatgagtgccaggccagctcttggatgttagggactgcttttctctctcccagttatgctgaagttggttttttgtttgcttgtttgtttgtttgttttgagacatctcactctgtcacctagactggagtgcagtggtgctatctcggcttactgcaaactccgtctccagcttcaggcgattctcatgcctcagcctcctgaatagctgagattacaggcgcacaccaccacgcccagctaatttttgtatttttagtagagatggaggagtttcaccctgttggccaggctagtcttgaactcctggcctcaagtgatccacctgcctcagactcccaaagtgctgggattacaggcatgagccactgcttctggcctgaagttttaacattatatcacagatgtcaccaacaggtatatatgaataagaactgatatactttgactaaacaaggagatagatgacattttcacttcagccaccactgtaaaaactgttgtccatagggttcagaataaagtatcccagcatatgcttccacgatgagaacttcatagctagctgtctaatatgtatcatcaagggagattgagtagaagacaaagattattctctgaggatgctatttgtcatttccagttgaggtttccctgcctttcatttagttagtaaatatttaatgagagctgatcacatatatgcagagtactatatgctagttactgaggatacatcagtcaataaaattaacaatatctcctgccttcatgggacttacattctagtgcagaggaaagcaaactacaaccggtgggccaaatcagcagctgcctgttatgaataattaccattggaatacagccacatcatttgttttggtattgcccatctctgctttcacacgacatcatctgaataaagtagttacagcagcaaccatatggcccacagccagtatttactgtctggatcttaacaggaaatgtgtgctaacctctgctctagcatcttcttcaagaagcttcacagtagatagttgtacgtgaatatgaatatctgccagtaaatccgcctgcctgcctcctgcccttcctttcttccatttgtctgttctgtcttccattcatttcattttttcacaggggagtgggacaggtcagtcaaagacctaaactacattaggccaggcgtggtggctcacgcctgtaatcccagcactttgggaggctgggattatagatgggttgaagtcaggagttcaagaccagcctgggcaacatggc

SEQ ID NO: 79535 - DNA, 3877 bp, Homo sapiens
tgcttgagcccaggagtttgagaccagcctgggcaacataacgagaccccatctctacaaaaaaattaaaaattagcttgggatggtagtacacacctaaagcctgaggtggaagattgcttgagctcaagaggtcaaggctgcagtgagctgtgatggcaccactgcactccaacctgggtgtcagaatgagaccctgttgagagagagaagaaagagagaaattcccctccagaccttttctcccaaaataatttattctgtcatcttcctactccactactcgtcaccttctatacagagctagccaaactagatcagccttgctgcagaaacccctatccatttctccctgctaccaaaaaacattcctttccttcccaactcttttccctgaggcctcgttttcaggtctagccttccaacgtggaagaattctcttccatcttggaagccgtccactgcctgtcacacagcagtcatttactgctgatctccaggcctagaacagaagctctgtgtatctaaggaaattattctgtgtcagttatcaaagcaccaaaaatgtttgccactttgtcatttggtctttttttttttaatgttatttagtagttttggccatatacaaatgtgggtgttttgttatcaaatttatggatcttctctttcatgccttcaaggtttggtgtcatacttaacagtgtcccacttttaaaatatatttctaaaattttcaaaagtttgttactactactttttggtttcacttttaaacatttagatattattcagtctgtaacttatcctgatataaggcatgaggtaggaattcaagtgaagttttttccaaatgggtgcccattttctaagtaatctgcgtattttgccacagatttcaaatgtctttatcatattctaaattcctataaagtttttttttttttttttttttgagacagagtcttgctctatcgcccaggctggtatgcagtggtgcgatctcagctcactgcaacctctgcctcctgggctcaagcaattctcctgccccagcctctcgagtagctgggattacaggcgcccgccaccatgcccggctaatttttgtatttttagtagagatggggtttcaccatgttggccaggctggtctcaaactcctgacctcaagtgaccccctcacctcagcttcccaaagtgctgagattgcaggcatgaaccactgtgcctggccggaattcctataaagttgagtttctttctgggcaaatctattgagctgcctgtcgatgcatgcaccagaaccacacagctttaattgttgtcatttataatgtgtttttatctggtagggttgatcttcacttcttgcttttctttttaaaaattgtgctgcttattcctgcttgtttatgtttctgttgaacttgagagttgcctcgtatcttttttttttttttttcttatgagacagagtttcactcttgttgtccaggctggagtgcaatggcgtgatttcggctcaccatcacctccgcctctcgggttcaagtgattctcctgcctcagcctcccgaataactgggatttacaggcatgcgccaccacacctggctaattttgtatttttagtagagatggggtttctccatgttggtcaggctggtctcaaactccctacttcaagtgatctgcccgcctcggcctcccaaagtgctggaattataggcctgagccaccgcacctggcctatttttttttttaatcataatacagttttgttggaatcttggcaaatttatagattaacttgggaagaattgacacctttgtgagactgagtcttcccagccaagaacagactatgtctttcccttatttaggtcttcttttgtgtccttttgggagcattttaaagttttcttcaccagtttatttcagtttctaatgctttcctaaccaatcagtatttaatagaatctttgacctactgccttttcttttgtgaggtttctcatataaaagcattaactcttgctactcttttctatcaattccttactttaactgccctaaggctttatgttaattttgccccttgttaatctctgagaaaccaaacttctcagtgcattttttaaaaatctttctttggctgttttatgacttgataaaatgccttgccttggtccagaggagaaagagagaaatcagacaagggaatgagaatgacttttccatcactagagagttcactgtagcagttatttctaaatcatttgccttccccatcttgcccctttgtatatttgacctttatcaaatgattttttccatgtgtcagatagttattgatttctaccgtaagcaaggtgctttctctgtaggaaagacaatgaccaataagaaataatccttgcccttcattcagttgataatttagagaacagcctaagattacactagtagtttaaactatacttctcaatttctcagtactttccaactttccgtggttgtttatttaaacgattttttgtcctttttttctattagattttttaaaattttatttttgattgacaataattgtatatatttatggaggacaatgtgatgttttgatatatacttacaatgcaaaatgattaaatcaggctaattaatctcattaaatcacctcacatacttttattacttttttgttatgaaaattttaaatagatttgttttaaagttctgttttattgttgttttgagatgggatctggttctgtcacccaggaagaacctggtggaaactttacaggcttgtgcctttaaagttttttttgaaaaatttttagacaattttaaacaaaatttaaatggttatcatttttgcaaaaagagtcttcattatcataaagtatttacattatggtcttaaaagttgaggattgtttattctgtctatgcataatttctaaaacttgatataataaatctctttttaaatttcctttagcatataatttagaaagttaaaaaaatcatgcgtaaacttaattgctgccatcctgtttttcagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcagtatgtgctgatggctttcacaattttaatctggaaacactttaactacgaattttcattttgaagtcatgtctcagatggattcataacagtatagtgatccataaactataagaatactaggatttttattgcccaggactttaaaaatcctaactctgctgtttcgttttttaaatgacttgataatattcaaaattacttgactctagatactacccttttaattgcgtcttaattttaataggtttttaattttatgtagccacaaatggtagatttttatttttaggctgaattagaagtcttggagaattcttgtagtttgttattaaaatgtaataaaatgttaatttctatagtactctatttttaaaatataaattatttgtaaaatataaaggactcaataataagggtattacgttaaacgcgcatttgacagtctggtcaatgtccacataacttccagcacgcacagatcaaggacggaatgactttcaacatattctaacttctgtctcctcagtgattttttttattattagactgtatatacatttataaaatctcccattattcatatttattctcaaatccccttccatttttccttccatatagtcttataaagtct

SEQ ID NO: 79536 - DNA, 2256 bp, Homo sapiens
tagtccattttcatactgctgtgaagaaatatcagagactgggtaatttataaagctttaaaaacaggtttaatggactcagttccacatggctggggaggtctcacaatcatggtggaaggtgaaagaggagcaaaggcacagcttatatggtggcaggcaagagagtgtgtgccagggaactgccctttataaaactatcagatctcatgagacttattcactatcatgagaacagcaccggaaaaactcactctcatgattcagttacctctcactgagtgcctaccacgacacgaggggattatagaagctacaattcaagatgagatttgagtggggacacagccaaaccatattaacagcagttactgaaagcaaagcacacagcgtatggcaccaaattgctctggagggttcttatttgttgccttgcttaacactttctcctctgactgagggcctgcttaggtctccataagaacagtgaagctgagggccttccccaggggctaggctctacctcacatgcccatgtaccttgagaaagaaaagctctagaacaggtagtgaatttgcagcagagctttctgggaaaattttaaatgcactaatgagattttgctttgcaggagaatctataataatagaaggaaagaccttttttttttttttttggagtcagagtcttgctctgtggcccatgctggagtgcagtggtgcaatctcagctcgctgcagcctctgcctcctgggttcaagtaattctcatgcctcagcctcccaagtagctgagattacaggcatgtgctaccatgcctggctaatttttgtatttttagtagagacagagttttactatgttggccaggctggtcttgaactcctggcctcaagccgtccatccgcctcggcttcccaaagtgctgggactacaggcgtgagccacggcacccagccaggaaagaaccttttttcttcaaatcacagagtatagatagcccctggtttggtgatcaaagaactctcttcacttatttgattaactttttgttaggtatttttctctgattttcgtataattgtttttaaagttttcaagtattcattcagtagaagtttctctacctggctttttggtgtaccagagtatctcgaataatggaattctgtttgaaatgaaggatatctgctgtaaagaaagaaaattatttatttagtaacttgaaaaaatttaacagcatttcattatttagtaacctgctccaagttttgcccacatgcacgcatcataggaccctattcacagttgagtttctgtggagagaactgcttcacttcattttgcggtctcatgtctcagtgtttgaattccctcagaatgcaccttataatttcaggagatgtaagcttgtaggagtttatttatgaaaggccctaggaattcaaacacatgaatctgtgcttatttaccttctgtgtagctaatgactagaggagtcttgcctagtcctttgacagctagtttgtgactgtatatataaaattctactatttaaggaaaacaattgtaattttgaaatgaagctcactcttaggtagtttgtattctgtagtaaagtatggctataatagataattatgtaacatttgatttttgtaccatttgcaactttagggttagttgtatgtattttacaaaattaacataaaatgttggttgtacctctgaatgctttctttctgaccctctttgacttgattaaattgtgagcaattacatattggctttgcggttagaaattaaataaggttcattgatacttagaaagttattttataaagaatagcagctgatacatatttaataggaaggccttctatccaaaaaattgactgtatagaggcattgtatccagtctttctaagccgtgtttgattgtacaactctacttccacaaatttgagacaggtcttttttaagcccttaattaaattaatttttgttctttctcttcctgaatttactcagataatataaatacattaagcagacatttaagagagaaatctctaagaagctttaaaagaaatattcttttgctaccatttttctagcactatttttataatcctttacagcagtagtgagaactattttattaataaattgtattaatcttaaaggaaaagtaatcaatggttatattcaaccaaaaaatgttaaatttatattttctcaaaagagtaaaatat

SEQ ID NO: 79537 - DNA, 1286 bp, Homo sapiens
tttgcatgacctctggaccatcccaatctcctgtagtcccctttacatgtcctataatctagccaaactcaactactgcaatttccttaattgcaccccaaatttcccatctgtttcctggatcttgccctcttctttactcatatgccttttcctctactgccacaggtaagaatcctccccagtcttctaaccccaactcaaaggccagcttctctttgacattgtctctgatcgttcacttaaacttccttagcatcttctttgtgtcataacaattatttatttatttatttatttatttatttatatatgtttgccttttctctaccttctattcctttccctagatatcttctgccctggaacttgtctttgaacctccctttgtagaccccctggtacctagtgggtgttcattaaactcttattaattgaatacttttctcccggtgttaaagttttatgaatatttattttcttttctacagtcacaaatcaagagttaaaggttatctgagactaaaaatgacttatttacctaaaaccagtggctcagaagatgataatgcagaacaggctgaggaattagaggtgagattttataaatatttggttaaactaaaaaaattttaatttcttattttactgtactctgaagaacaataactattgaatgaagttaacatgtgcaatgaagattatttacttggatgtttatttcacccaagcattaatagttttccctctaaggatatttccgtagaaggaatggccattattgatggccttcttaaaggttaaggagtagagaatagaatataaatctagtttttcaaagttttctaaaactgtatattctccattaaagtaagaacacaatttagtattttgaagttaaatatatggacattttgaggagactccactgattaggaactcttttatgaaatttaagtcctgttaatattcttattatggtgggagggctcataggaaaggaggggaattagggagcaaggaaaatttaagtgatctaataaagagccttctgtatgtggggcaagtagaatttaacaattttcatggatgacaggatgagaggaaagtccaagtcaagatttgtgtagagttacatgcatctggagtaagcaagtaggaggcagaaagtatgtatttggaatagaattggatagggtttggagactggaatcctagttgcacactctgtctagccagacctgtgtgagtcattgaacttttccgaacctcaggatcttgtttgc

SEQ ID NO: 79538 - DNA, 1572 bp, Homo sapiens
tccaacttaaattatgccttaggtgatagttcatgagtattcttgaaaagtacatgcttttggtgttatagatatattttgaaaacccactattttattctagacagaaaatccaagattggagagaccatatacatttaaggattttgttcttcatccaagaaggtcagtaaatataaaataataatagcatattaaattttttatctcttcattacaccttacagtagccttattagaaattcagggtttaaacctctgtaaataagttacttctaaatattattattattattattattattttaaaagcttcattgctatttctgattaaaagtactgtatgcacattgcaaaacattctgaaaatacagaaagtgatcacagccttttgggaaagattcgttctcctaatacttatcagactagaaggctatttatgtcatattgtcatactatgctttaaaaaatcacaaacatgaattcatctaaaaccattacctaactcgacgtgcacaaagccaatttcagaaaaacctaactatattttgcatacttagtatttcagaagactcaaatatttagagaaaataacataagactggaatttaaaacccaaatagcatgcttataattccattttcccaaacaaagttacttgatgtttatcaaaaaaatttaaatttaagctgtaactaaaactccttttgatcttctatacctcattgacaagtaaaatctagtgaaaacgtgtgtggatttactgtcaaaaaggtcaaactaaagcagagaaaggacatctgtgaaagcaacagtatttgtcttgtttcttaaactataaaatgcatttgaaaatgtacttttggaacttagtaaaatttttcacttaaaaatgattttttaaattactgtttgtaatgtaaatattaaaaaaatgaaaaggagtgctcactgactgttaatatttactctctataaaggaagtcacatttaatttctgtagatgtctggaatgtaaatctcttttagtcttttaattttagactgattgtgacatctgcatatcaagaataactaaattgttttttcttatttgattgtcctagcagcctgcttttcaatttgtcacatgctttctagcgtctttatctttaaaaaatacaatttgtttcttctgtctgcaatgaatattattgcaagtgtagaaagaactttattcagatagaaaatgtactacattcctaaatttgtgtgagccccattaagtcaaaaccttgaggcttcttttccaattgaaaagacatgaaacatacaattgtagagaaacttttcaacaaaacattgtctgagcacattttctgtatccatcttttatagccacaagtcagaatgttcacatctccttcagtatggagacacaagccacattagcggccttgggaataagcatcaggatttcactgactactcatgaaaggatacactaaatttgccaaatccatgagaaccatacagagaagagctaaaaagattaggggaggcttgggagtgggggtaggtaatctcttgaag

SEQ ID NO: 79539 - DNA, 2043 bp, Homo sapiens
cgtagagatgaggtttcaccgtgttggtcaggctggtctctaactcctgacctcaggtgatccgcccacctcggcctcccaaagtgctgggattacaggtgtaagcctccatgcccagtgttgatttttgttctagcaagttaacatagctgaactccaaattctgcttcccttttggtgaacatcagctgaaatcagtgctgagccctctcagtcttccatctgttgattttcacttgttcagttcagagtaaaactagggatttaggtaagagtttatatatagatttggaagaactctggtggcttctttttttctgggacgtttctcctctttttctagatatgctgtcaaccccaaactaggccttctgactcctcaagccagtaatagtgcagatttcagcttaagttctaggctctctgcattatgtggactgtagaatactactagaggaaaagccatataaatactgaatcttacctagtgtagttccttctttgaaggattgacatccctccagtttctgcttgtttggggtcattctgttgtactttcaaatagctcttttagtattttgtcacagaatataattgttatctgcagaaggattaatctaatatatgctactctgccattaccagaagttgtaccacattactttttattttccattgatgctgcatatgactgaataaaaaaaaaactctacattttctgtgaatggtggcactatctcatcaaactcttctaaaggaattgagcgtattactaattatattttttcttccttctcttatagacaagagatgatttcctaggtcaagtggatgttccactttatccattaccggttggtataggtgtccatgattttccttttgggcttatttttttaatttaataaatacttacatatataatatagctactgtaaataattgatttatcaaatgtatactacttttatttattgagcatactgttttctaaaaactcatttcaattttccgtttccattttctctttaagatttccgttcatgaaccccagtgagaaatagagaatttctgatgtttgttggcattgtgaaaacattgtgtaaaaaagattagtttgaaaatattctgctgaataactagaatgaggagtgcctaagctcacagaagaaaactaagatagtttacgacaatggaaacataaaacactaagaatcaggactaagaatatagcaaggagaaaaacagattcaggaaacattgcaaaatagaacattattgaatcacatgtctgacatggaggcttaagaaaataagcaagaagtaaagataatacaagttgaacttggaagataagagtggcgtctcttgtagaaaagtgaggaagaaaagccattttgttttgaaaagcaaaaaatttatttttggacaaacagagttttgataggaaacaaagaaaatgaaagtttaaagtagactgctgacagagagataaaaatcagctaggtagggaaaagggactggaaggattgagtgttatcactgtccagataacagcagaatctctgagaataatgggctctcctgatgaaagagataagaacggagggccagccattgaccctcagtcaacgtgagtggatcagaaaagaaagagaagacagacaaggggaaacaggaaaagagccaagtaaaataatgtcatgagaatttaagaaaggagtttcaaggcagactgggtagttaacaatgcagaacatcagagaaggataataaaaactaacaactgctgaattttaaagaaagagaaaaaatacttctttttcagtcttgtgagttatattaattggctctccacagtctttccagagcataatcttttttttttttttttaaacagggtgcaggaccataagctttcagtaatatatttaatccagtcttactttccaggctgttgacttttttgatctcctagaattatctctatgctctaaccaagccagcctgcagacatgtgcatagtccgtgttcttttgggat

SEQ ID NO: 79540 - DNA, 1041 bp, Homo sapiens
tagtcccagctactcagggactgaagcaggagaatcacttgagcccaggagtccaagttgcattgagctacgattgtgccactgtatttagcctgggcaacaaagtaagaccttgtctcaaaaaaaaaaaaaaaaaaaaaaagttctttttgtgaaatacaaaagagcagaagatattatcccaacttctgatagggcagtctaggcaaggaagacaaagaacatatataagatgttttgaaattattaaagaaggatcagagtgttgaaattattgtaagcatcaaggctgcttgcccgtgaattaaggaagtttgcaggaggataatctcagtaaagtctgtagactgaaaactttcataaatcctgagttgttaacagtgttttcaggcccactaatgctagtgttgtttaatacatagaaaaaattgaatatgaagttcagtagtttgtaacttttagattcatttacctttgaaaatgattaaaaccggaatctggagcaataaatctaacaaccaaatgatgagctaaatagtgacttccaactatgtgcagtgtgttggtaggccttacactatatggaaaaacttaggaattatttttaaccttccttttggaacattgtgtaaacattcttagattatacttaaactattaagtggggtagttttatctgaatctaagtccacttgagttgtggatttcacctctcatggatgtgtgttttaattgtggggtaatgtcaatggaagatcagggttataatatcatggcatttgaataatagaaattcacgtaaaatattctaatctgtcaaactttaccaactgtgtgcagattccacagccaaggatgggagtgtggctcatggccactagagggcaggaaaggtcaggaaccggatgtggaagcctggggaaaagtataggggaaagcttggatcaccccttcgtaaggaagacaacttgccacaacttgaagcaaacacaattcagtccctgaggcaggaaagacagtaaacgatgcaggaacataagc

SEQ ID NO: 79541 - DNA, 1030 bp, Homo sapiens
tcaactttttgcattcttggtaatacattgaagtgcaaatatgcatacctgtcactcagaagaagagaatcaacctgtttaaaatgtgtatggaaatacgccgggtgtggtggctcacacctgtaatcccagcactttgggagcctgaagtgggcagatcacttgaggtcaggactttgagacaggcttggccagcatggtaaaacctcgtctctactgaaaacagaaaaattagccaggcgtgttggtgcacgcctgtaatcccagctactcaggaggctatgacaggagaatgtctttaacctgggaggcggaggttgcagtgagccgagatcgagccactgcactccagtctgggtgacagagtgagactctgtctcaaaaaaatgaaataaaataaaaggtgtatggaaatagaacaaggaggaagagaccctaacagccttctagtagagtttaatattggatgttcactgtcactaggacttgaagcctcaactatgatttttaacttggagaaaaccttgatatattcttttcttttgagatgcagtcttgctcttgtccctggagtgcagttgtgcaatctcggctctctgtgacctccgcctccagagttcaaacgattctcctgccccagcctccgaagtagctgggattactggtgcccgccaccacatctgactaatttttttgtgtttttagtagagatggggtttcaccgtgttggccaggctggtctcaaactcctgacctcaggtgatcctcccacctcgccctcacaaagtgctgggattcacaggcatgagccaccgtgcccagccaatgtgtgtatatatatatatatatatatatgtgtgttttttttttttttttgagatggagtctcactctgtcacccaggctggagtgcagtggcacgatctcggctcattgcaacctccgcctcccgggttcacgccattctcctgcctcagcctcccgagtagctgggactacaggcacctgccaccacgcccagctaattttt

SEQ ID NO: 79542 - DNA, 1698 bp, Homo sapiens
aattgtcccctgttgagagtcactgctgtaggtggcagcagcagcatatgcaaggctagaaatgtgaaagaatctccactgtaaatagtccagtggggctcaagcatagggtagcctggggatgtgggaggcggtgatctgccagaagtgggtcagagtccgattaggcctggtgcttcatgctgaagacaaagaagggggtcttcggctgatagttaagtagttgggcaatggaggtctttatttgagagtgtgaagtgctctctttaaggtttttagaagacaatttttcatggtttcatggattataaatgaattaaagttttcctaacttggatgactgggttaacagtgatgttatgaactaagatggagaattcaggagaggggccagattgggagggtgaagaagaaatcatgtatgaagtttatgtgtatcagaggctgccctgatagtgctgttttcaagtagggcagttggacatacaggaccaaggctcaggagagaagtgagagttggaaatgtagattgggagtcaggagtatagtcaaagcctcagataaggatgaacacgttagggaaggtatacagtgagatgggaagggaagataaattataattttggggaccaccaactttggtgaggcggtagaagaggggataaagaagagactaaggaggaaccacacagaggccaagagagcatggaggcatggagagcatggaggcgtggaggcatagaggcatgggtgaaaggtgagggaaggaggaaagcagacagtaccacagagaacataagtatccactggatgtgtcagttaggaggtccattagcaagagtaggctcaggagaatgcggggttaaaagccagattgaagaaagaatcaaacaggtaaggaagcagaaacagccagcataggttgcttgctcgatgtcataaaataagcatgagatagcataggcaaggtatatatgtagttattgttatacagaaggcatatgtgaagtggatataagatgtataagacaaactccctctctacagggagagtacagtctctttttcctggagaaaaaaataaaggttacagtcttacgttctttcaccttggaactatagaataagcaagtatgatgagtgaaaaggaaattcagcaatatcaaatgaaggaaacagaaaattataagtgaaaacttgaaatcgcttatgaatattcacacctcattttggacagcattagtctaactttctcagtcccctctctaccaccaaaaataagacgagacaaaatagagcttccatgtagaaaacaagtcaaggttttaaggcctattcccagaaactacttggataataggcaattctgtctatgttgccggcttcttacaggctatggagcctaccatgtgctagctgttgtgaggcctcacccgtttgtgtccactctccctttacatcacaggtgacagggaaacaagacagaccaggagaagccaggacaagaggctttgtaggctgaaggggcttggcagagtctctgggtgaggccaggcgatgtgttgaggtcaggaaggtggttagcagaaggagcaaatgaatgctgagaaagggaaccagttgtcttgtcagcataccctggaaataatccaaagtattgctcacacgtctggttcagtatcctctgttccttgtgta

SEQ ID NO: 79543 - DNA, 2065 bp, Homo sapiens
ttcagctttattatattagtaatttaactcttatgaatcttagccaaaagttctttatgtaatttggccgttccaaagtatttaaaatggtttgaactgaaatagattttttaaatttctgtatttggaatgttttaccagattccaggaaatttaaaaaattttctaactaaagcaattttacatgacagtacatcatagttttggggggaaaaaaccttaatctgtgtttttgtaacatccattatgtttattaaagattgttttaaaaaaaaaaacttctggataagtaactttaggtgaataaaatagtaattgctagtttattttctctcttctgaaatctggtaaatataataattgttaccaatgcccagatgttaatataagccactactttactaaggataaaaaaagatcagatttcaaattctgatctataatttagaattttaaattccatttaggaaacttttctaaaaccagattttaggagattataatctaatcaactgtttttcttcctgaaagaaagaaatgaagtggcactgagaagaaacgttaatagtatgctagttgaattaatgttacttataaatttattttacacttaatgaaataatctgaaaggaataattcatgtagaaatatttgtagaaataccttaaaatagtttattttgtggtaataattatagtttgttgtggatgcttttgagaagagtattttaaatgtgttttttaatgaaatgtggatcaaatgccttttgcattgttaaaaatatccactgttactggttttatttatgcttaggtaagctaacttaaatattttttgtgacaatcaaatgtataactttgtgcagattctatcttttggtagattattggattataaaataattcagaagtgtgcagtttgctggagatttaaattgtccccccgtttaatgtttattagacttctctttataaaagcattgtaaaccatatagtgacagttaaatttaatttatgctatatctaaatagatctaattgataaatcaaaggcttgttttatggagaagattctagtgttgttttttctaaatatagcagtggcaacaataatgggttttagaaataatcttgtgtttatcaataattatatattaatctaattatagtggtatattgtaactcacttataaataaacagctcccaaaatatttcccatgactccagttagtctgggttagtattctgatatgctgagtccggattcacatttaacaagttgatattagagtagcatttagtaatgtcagctatctgtactgagcagccgtgaaattaaatcactgctttggtcagagaacctggtttctaaagcactgagagtctacaacttcttttcttatatgtttagctaccagtctctagcagtataaaattgagtttctagcttactgtaatcaacagcttattaatgactgattttttaaatctaatgagaacttttacctgtatctgggacactgtctgtgttctgtgtttacaacttagagtgaagatgagactttgtagtctatctccataataatgttgatttcaggcatagcaaacaacataacagtgactggcatatgtttattacatatgccttttgaaatacagtattacttttgtaaaggctatataatgacttttgatctgaaaataaatacttgatattttaacagtatgtgtaatattttgtcagttcaatcaagaagcaggttaaggagctaaggtactatgtatacagttacaacaatgattgctattcagatttctaaatctgtatagtagttacttttctctactgttattttgtttcccccatctgttgttttctaaatctcctatgttatgttgttaggatgctcagagatttcagtaccctattatttaatgtgcattagcatttttcccaagcttgaatgtcttccattctttacttatattcatatttttattagaattattttttacattttttctttttgttataaaagtttttgttcattatatgtaacttaatc

SEQ ID NO: 79544 - DNA, 3918 bp, Homo sapiens
tagcatgtggtataaacaacggaactattttaccttttactttcctatgaatgagccagtatatatttattactggagttccagctataaaatttaggtgaggggtttaaatataccctagagtattatttaaaaataaatttgtttctttcaaatagaataccaaccttggtctatggcatttgagagagaaattaaaatattaaattttgattgcctagtaaactgaaaataaaggttaaataaatacaaagcagaaaaaatatatatacaaaatcacaacctctaaaaggacaaacagtccactgttctctactgtgggagctttatcagcactggtgagtaattccacctctagggtagggctagctctcaaaaatgtaaacaagtatgtacttcgtttatataaagaaatgtgcagcttggtttgtatttctttatagatatcaaacagctaaatggattgtttcaaagtaccagcaggggccagcaaagagctcttagagtttttcagaacagaattggcattgagacatgtttatttgatgtgctaaatcctttttagacttctttacttaccacaacactctcttaagtgaatgaattgcagagacagtggaataaaatatcctgtgtgttcaaactatcttggggtatagttttttttttctaatctgcatatatttttattggaatgtttgcttaggctatttcttggcagttttaatagtcaaaatataaatggcatcatttaaagactgttctacttggctggaaaaggccttaaaattacaggagaaaatgcttagtgacagcttctcttaaactttttttcttgaacctatgcttcagttttgcaatggtattactaggttaattttgtagttctgtccttaagctttcactttttatgtaactagcactttggaagctaaaatatgtatctatttgatgtagtgctaaagttttaattcattgtaaagttttggtatttccaaatttacctaactgtttgaattcacacattaaaaaaaaaaaattaacagtccctatattaactaacttgactagattcctagtatggctactatttggaaattcaatctttgatttgatgcttaattacatggggttttgttcctaccaacttcctgtaattctatacctatgggtaaaaatattagtgggcaaagtcggctggagaaagtataggcactgtgattcacatagttaaatgttcatttagtagagctggggtgaaaaaatactgtttcaacttgaaatgttagaagattgttgttcttgtgttactcattcatgcaaattggagaaggtataattgaaacaaggttggctgtgtttgagtcagtgtgctgcagctgagctcagcttaaaggtcgctggaaatcaagtgctttgtaagtgaaggcattttgactacaagcgattcaagacattttggaaacgtcagtctctggaatgggtcgtctttttctttctatgatatctggtatctaatgttttacttaggataaagactactacttaatagctcttttaggcaccacaaatgattttttcttttgatgcagtgcagctgcttctagcctgtctacggacagagatctttgttatgactttcagcccttaacatgtttggaaatgagaacaaatggcacaaagcttacgattgcactttgcagccagaagaagcaatacttaccctttgtcagaaacctccggagatgacttggatagccatgttcacatgtgcttcaaaagaccaacacggatttcaacgtctaacgttgttcaaatgaagctgactcccagacagactgcactagctccgttaataaaggaaaacgttcagtctcaagaaagatcatctgttccctcatctgaaaatgttaataaaaagagcagctgtctacagatttcactacagccaacaaggtacagtggatatcttcagtctagcaatgtcttagctgatagtgatgatgcttcgtttacttgtatcttgaaggatggtatttacagtagtgctgtggtcgataatgaattgaatgctgtgaatgatggtcaccttgtaagcagtccagccatttgtagtggtagccttagtaacttttcaaccagtgataatgggtcttacagcagcaacggtagtgattttgggtcatgtgcaagtatcacaagtggaggttcatatactaacagtgtcatcagtgacagtagtagttatacttttccaccaagtgatgatacttttttgggtggaaacttaccttctgacagcacctccaatagaagtgtgccaaacaggaatactactccttgtgaaattttttcaagaagtacaagtacagatccttttgtccaggatgacttggaacatggattagagattatgaaattgccagtgagcaggaacacaaaaattccactaaaacgttactcctccttagtcatttttcctaggagtccttcaactacccgaccgacttctccaacaagtctgtgtactcttctgagcaaaggatcctatcaaacttcacaccagtttattatttctcctagtgaaattgcacataatgaggatggcactagtgctaaaggatttctttcaacagctgtcaatggacttcggttatctaaaacaatttgtacccccggagaagtaagagacatacggccgcttcacaggaagggctcgttacagaagaaaattgttctttcgaataatactcccagacagactgtctgtgaaaagtcatctgaaggatattcttgtgtttcagtgcatttcacccaacgaaaagcagctacattagactgtgaaacaacaaatggtgattgtaaaccagaaatgtcagaaattaagcttaattctgattcagagtatattaagctcatgcataggacatctgcatgtttgccatcctcccaaaatgtagattgtcaaataaatatcaatggagaattggaaagaccacattcacagatgaacaaaaaccatggtattttacgaagaagtatttcattgggaggagcttatccaaatatttcctgtctatccagccttaagcacaattgttctaaagggggaccatctcagttactcataaagtttgcatctggaaatgaaggtaaagtggataatttatcaagagacagcaacagagattgcacaaatgaactgtctaattcttgcaaggtaagtttcctttggtcttggtaaatgttaatttatatgagaataacttaatgaaatatttggagaacatttattgtaaccaagcagttttacatattttcctggtccttagctagcagtattttgtagtcataaattttatatttgtaaatctgaagaactctatgtatagttttttactctatttgttattttaccagtgtacaaaatgtatatttttaaaaatcttcctaagtgatttaagctataaaacttttctacaacataaaaaactttctacaacaaaacaaactttgaataacagtctatttcataacattttatcttggcatatttttcctttaaatgatatagtattcttttgtgtagctcaatactttattcctattttcaaatgatcattttgttttctcctcttcttaatcattatgaaatagagtaaaatttagaatgcttatttaaaatattaaacaaaaacccatatcaaagtgtaaagatctttttataaattatcatagagaaactatatctcaaatacatgtgtttataagatcattcataaaaactattatgctgcatgtttaaagcagaggaaaaataaatggcatttgtatttgtatatacccttaaccacaggaattttgtttccaccctatttttctttagccacgagttaatactgccctctaaaatgtaac

SEQ ID NO: 79545 - DNA, 1070 bp, Homo sapiens
ccaggaggtggaggttgcagtgagctgagatcacaccattgcattccagcctaggcaacagagtgagactccgtctcggcgaaaaaaaaaaaaagttattatagatccccacactaaggactaagaaattctattataatcctgcctttcttttggggtattagcttgtaaccctaaacaaattattcaatccttctaaaaataccttctcacatttaaaaaatgaggacaacaatatttgccctgcctatctcataagcatattgtgaggataaaatgagacaatgacgatgaaaatacttggaaaattctttatcatgatacaaatataaaatgtcatttaacattcgtagacttaacgcgtttgtagctctctgatatggtatatcttgtgttagctaagatataccatttagtatatctactgtgttagatgctcttctatgagtgggaaatacagcttttcttgagaaactcggtttaccagcaaaacaaagagccaaagataattagaacatggtggtgtgtgtcattctagtcctcttgatttgttgctagtcttagcaggtaagggaggtatagagatgacctgagatgttatagaacctatagccattggtggagtaacagacctgattgtatagcaacaaatgacctgtgtcattataaatgtcattccgtctttattctgctgaggcactcacaactaaatttaaaatgtaccattttcctagcaaattctcttggaaaatggagggtgaagaacacaagtataatattaagcagaaacaactttagtcatctggaaaacgtttgtaatgtaagtgatatttgctttcaataaagagtaggcttatatcacttttttccagccaattttaagacttgagtgttataaaatattgtcgtttcattatggtgatggtggtggtagtggtggcaataatgacagaacatttcagaatgatgtgtcttaaaaaaactctacccaccaatgcaaaagttagcactgtgtcaccagtctaagatatacacctgtacacattcagccaccggttttaggagccacc

SEQ ID NO: 79546 - DNA, 1453 bp, Homo sapiens
agtctgctcttatttcatgtaattttaaaatgcattccaaataatcggaattagaaaatggcaacttctttttgtttgtttgttttgttttgtttttcttgagatggagtctctctatgtcgcccaggctggagtgcaatggcacagtcttggctcactgcagtcaccacctcccaggttgaagcgattttcctgcctcagcatcccaagtagctgggactacaggcacatgccaccatacctggctcatttttgtatttttagtagagacgaggtttcaccatgttggccaggctcgtctcgaactcctgacatcaggcgatccacccacctcggcctcccaaagtgctgggattacaggcatgagccaccatgcccgaccaaatggcagcatctttaagcatttatttctgagtatctgtgggttgatgtttacttgtttttaaataaagattgtgtttttcttaggttcatcctcagcagcaccggcttctttttgaagtgtttgacgaaaaccgattggtaagttatattgtgcttatatgaaatatgaagtaagggtacatttcagtggagcagccaggggaagtgggtaagcagtctgggatttgagtgatggcttgggggtggttatggagactctgggcaaaatggtgagggagatagaatttgttttcttcctcctggtcctactcgctccctttccattctcctcccaagcacctcttctgattgccaacatattataaggtcttactcaagacctcttgtgacaggagaggacagaaaaccaacctctttgtcctgccttccctctcactcgcccatgacccctggttcctactccatggctctgggaatcttcccagggtatccttcagttgcgcctcctcactacagtggcctttcttagggttacctgtatccaatggacatcctatccactctctcatccccactcttctacagaggaaatctgtcctttttacactgataaggaatgagcaaataaagtcttctcaaagatggccagctcttacagaagcaaaaagcaaagttaaacctgatgttctttttataaaatgattgttctgatttctgaattcctaaagactctcttaaagtcctatccttttcctaattttgtctctgaggatccaatctcaaaccctcatcttagcatcttacatctatattttaaacctgtaagatttgaacaggtaagtatagaaacagtgttatgtgtgcaaagcttatcagttacaagcaccagaaaaattaaacagttttgttcattttttagctaacagagaaactagctttttttttaaaaaaaagtctgtttttagtgttaaactacattcatgttttttttgccctcaagaaatggtaattatactggcaactaaagatattgccaatgaaatctttaataaacatcatactaagcaaa

SEQ ID NO: 79547 - DNA, 1052 bp, Homo sapiens
tctaggtaaaatgcataaacatttaacaattatatgttacaattttagttaccatttatattttatatattaaaactgatgcttacaggaacagaaaaccaaccaccacatgttctcacttataagtggaagttaaacgtgagtacacatggatacaaagacaggaacaatagacaccgcggcctgcttgagggtagaggagaggaggagggtgaggatagaaaagctgcctgttgggtactatgcttattacctgggatgaaataatatgtaccaaaaaaacccataccacacagtttatctatagaaccaacttgtacatgtactcccaaaactaaaataaatttttttaaaaaaggaaaaaaatctgatgcttatattttcattaaatctcctcctgaaatcagacataaagagaaaatctctaataagagggtgtgtgtgcgtgcgtgctcgtgcatgtgtgtacatgtaccatctggaggctaaggtggtatttgagacattctgtcattagggcagttgcccctgttgctttgacactctgttctttcggtggttttcagcttcctctgccctccatcatcacttccatccctgcttcatctgtctgctaggtaactgttgaaattactcagctgctgatggccctctcatcttctttgctgtaatggttttatatcttttacaaactattacctatgatttaaatagactctcccaagagagaagatagctgtttatgttcatgttttaattagtatttttaatttttaattagtattctcactacacattttaaactatatttttgcatttattatatgcttctgaaatacaaaaagcaacatgaataagtcatttgtgatgtttataactcagtagggagatatcacacatatgccaaattaactttaataaaaggaaaaaatgtagtaaatctgatcaactactttgaaaatagaggagtggtagtgaatggggaggtcaggctctagggagaggttggcatttgagctgggcttgaatgatgagcacagtgtagacatgta

SEQ ID NO: 79548 - DNA, 1020 bp, Homo sapiens
cctagtttttgtttttttttttttaagtgaaagcagtttgcctttactttataagaagagtttacacccatgagataacttgagacaacctgaagtcttacaaaaccagcgtcagaatcattgaattaaccatcttatctcaaaagaagaaagaatgtaataaaaatcaaacaaaattttaaaaatctaggaagcttataatcattaggcctgtgattaaaaggttttctttctagttctttgtgtctttcactaacatggtacttcaggtttttaacgagatgcaaaaattactttaattgcttacctgcctaagaatcctgacttttaaattcaggaaataattgtagatataactaacaaggaaaactgtgaattttatagtctgggtaatctgagcttggggtaagcaataattaaaatttttctttctttttttttttttttttaacagtgatccttacgtgagagtgacgttatatgacccaatgaatggagttcttacaagtgtgcaaacaaaaaccattaaaaaggttagacttagcaatattcaaaagtttttaatgtactttgttttatttttataagacaaaaccttatttagttatactatgtttattattttttagagtttgaatccaaagtggaatgaagaaatattattcagagtaagtatatattttattttactaaagtggaaaaagtaagtttttttcttaggaggttagaatgataaattctcatttttaatatttgaagatgtatctcagaatttgcctaaagttgtgaaaatacaaaaggaattgaaattttgtcttataaaaaacataaatgtaagataatggagaggtaaaagactagaattatcttattctagtaaaactgatttagagactgtacagtagtcttactccagttgagcagattcagtgttttctcataaagatgatgcaaattatatttatgtctccccagtcatttattattaaacagattagggcctatcaagtgaatgcattt

SEQ ID NO: 79549 - DNA, 2224 bp, Homo sapiens
caaaagccaaatggttatgaactttcgattttgtgtacatatatagcaataattggaaattcctattagttgcaatactttggctttagattttcttgagcgcagcgataaattcttattcagtgtaataagttgactcaagtttttgcttatctttgtaaataatcaggtcatctacaaataattttctttttttcccgtgtaacttttaataaaattaattattgaaaaagattcttcaattaattttaatatcctaattactttatttgatatatattttttaaaaaattgtgtcttagttaacttataagtacatgaaaatgaaatctaaatttttgtattttaggaaaattcacgaattgtgagagtaagagttatagccggaataggccttgccaagaaggatatattgggagctaggtaagtatatctatttggattataattttaaaactttgcatttgttaattagttttttccaaactttggttaaattagaaatcaaatagtattagtaaattgttgtggaaagtataataataatattaccagttggtggtttactaaatctcttggtatctgaattactaaatttgtgaaattaggcagaagtacaaatgatagcaatagtcacaagatacattattgagctctgcttctggaaatttgcaaaattctaacagactaatcctttagcagataacaaccataaactctggacttaatacaaaaagcagcaacctgaaggcagtggagagtgaacagagcaggcagattctggtggggagttcatgtttggaagaagggaattgtactgagtgagttcctgatactatgaattggtctgagggcaggtagaatcagaacctggaaaaattgtagtcttcatggcctgggaacatagcagaatccaaactttggttcaattaaaaatcaaatagggccaggcatggtggctcatgcctgtaatcttagtaatttgggaggccgaggcaggcggatcagttgagggtcaggagtttgagaccagcctgaccaacatggtgaaaccctgtctctactaaaaatacaaaaattatccagaaatcgcttgaacccaggaggcggaggttgcagcgagccaagattgtgccactgcactctagcctgggcaacagagtgagcctctgtctcaaaaacaaaaatacatacaaacatgcatgcatacatacatacatacatacatacatacatacataccaaatagtattagtaagttgttgtggaaagtagaataatatttccaattgttgatttactgaatctctgaatctgaagaaaacatggcagtggtaaggattctggaagagagagagctgaagagctcagcaactcatctgaagacaaaagatctgaacagagatcacagtcactgcctaagaaacggggtttgggagactgaggcagacaggttgcttgagctcaggagtttgagaccagcctgggcaatatggtgaaacctgtctctacaaaaagtacaaaaaatcagctgggcatggtggcgcatgcctgtactcctggctacatgggtgactgagtcaggaggattgcttgagtctgggtggttgaggctgctgcagtgagacaagattgtgccaatgcactccagcctgggtgacaaagtgagaccgtgtctcaaaaaacaaacaaccaaaaacaggatttgtggctcttgtccaaacaggatgattagttgcatgatagtcttattatgtttagtgttgctataacagaattcctaagactgtgtattttgtaaagaaaagaggttgatttggtgagtggaaagttcaagactgggcctttgcatctagtgagggcctcaggctgcttcaagtcatgacagaaacgggaaggggacctagcgtacacaaagaaatcacatagcaagagtggaagcaagggggaggtgtgccagcctctttttgacaaatcgagaggaacaaatagaatgagaactcactcacttccgagggagggcattaatctattcaggagggatttgctcccatgaccctaatacctccaaccgagacccatctttcaatattcccacattggaaatcaaatttcaacatgcggtttgaaggatacaaatatccaaaccatagaatgataagcagacacacacacacacacacacacacacacacacacacaccagcagcaaaattcacacaca

SEQ ID NO: 79550 - DNA, 3221 bp, Homo sapiens
tgccacgctcaggctttccctggcggtccccaggtccagcttcttatgggaatgacacccttaaccgacaagaaagcgctatgattttccgtttgggatttaagcggggattaagctcacggattcccaggcgtctagtcagaggccgaactctgggtcggatctcagcgagacttgttgctgaggaacactgcagcttggcttcccggcgcttcccggcgctccctggctccccggcgggcccgtcaaccacccacctcccgggaagggaccgagggcgcgccccgccacgcgcgctccccacgccatggtccccgccgcgcgcgctcatcccacccgagccccgccgcacgccctccccactccccgagccccgccacgcgcgcccccgcccagccccaggagcgcgcgccgccggccttttcccgccgcgctgccgggtgccgctagtgcccgctcgccgcgggaggcgctgctgtcgctgagggagcgcctcctcctcttcctccaactcttccccgcctcctcccgcttctcctcctcctcctccacagttgcctgccctgggcgggggcgagcgcgtccggtttgctggaagcgttcggaaatggcaacttgcgcggtggaggtgttcgggctcctggaggacgaggtgcggggaccgcggggctgcggggcgggcttcccttcgggttattcagcagccggacccggggaggtagcggcggcggccacgaccggaggctctgctgtcagcccctcctccctcggcgcgagcctggggagcgcgcgaggcgccgcggggactgtgggggcggctcggcgcgcgggcgctgggggctcgctggagggagcaagcttgtcgggtccacacccgccccttcccggagcggccgccgccttacttgtcagtttccttcaggaagtgttgaggagggggctaggcggtcggcgggggacccacatcaccgcgccagccccttcctgccacccccgccgggtgtgcggagctcccaggcgttgggagacggtcgcagcatccccgctgttgatttgcttgctctggcggaggccgggccgacttaactttacggacttcggtctggagagttccaagtgaattgtcattcgctggtttgtttttttcttctttatctgaaatcctttttaatcccctaactagagacagggatgggagagcaggaacataaattttcctcctcctctttagcaacaagtgtctagtgtgagaagttcatgctttatttcaccggtcgtcgttgatgttaaaaagtgaagccaaaaaagtataaatactttataaagaagttaccacatctgttccctttgaaaactagattaagctctgggatttgaagaaggcaaagctgtttcttttcagctaaataactaatgctgattatgcctatgcttattaaaaatattgtacgaccatttggaaaggttgttccgtcgtaaatgatatgtggcttctgtgtgttcttggagattgtctcaaaaatgcaaatgggtgggagatgaaaaggctgcatgtagtctaacagtgactggttccgagtgaaaaaaatcaagttttttgctttcttgttggctgactaagctgccacatgtaccttttatcaagatgagacccagttaactgaaaatccatcaacctaatttatactgcttgcttaagtattgtaatatttaagttgtatagttccttctcttagtaccttggtgtcgtcaaacattttacacttctcttgagagttctttgtttataaagggtgggcaatttgttaatgcagttatttcaggatattttgagaatgcttacgtgatgcgattagaatttaatttcctagctattgctgccagaagagaaataaagtgatgatggacaaatggtggcggctcatagtccctcagaaacaatagtcaatgtgttacagctaaagatatcattctagctaatggcacctttattctgtagacgagatcagaagataatacagcacttcacctgtggtcgctttcttatcagtcagatttccctgcttgctacgtagactgcccagtgcagttgacttcaaggtggtgtccaacccaatcaggctgaccttggactttctttccctgctatattcacaggtaggccctgctaattgcagatttctcatctcaccgccttccagcagagccagttgatcttaaagaaaatagtgccaaaggtatcattcaccatctgttttctccctcttggtacatgatcagtgtttttaattatctactttagtaatttctctgttttcaatcatcacccctctgcccagctgaaataaaactaattgtggcagttaatgggtggtcggtaaggaactggggccaaaggccagaaactccaccctttgaaatgtggatttcctgaacttgctgaaggatttgtacttctaggaagtttcatggactgtggcctatcccattcacattctgggagttctggctgtcagttccatgactctaatttgcttctgtccccgctctattttgtccacattgaggaagggagtgagataggaagataagagacatgatgatgaagagtcttccacttcttccattgtaattggattattcattcaacagacattcatttactgtttgctctgtaccatgcattgtgctaggcaccagggatagagagggaaaaaagacagtctcagcctcggactgagggaaagataaaagtcactttttttcttgtggaggttgccctctccactatcatttgccatttattttctggtctatcacaaaagtaaaagaaggattgaaaccacactcccccatcctccccacccccaaacaccccttttgttaaaggaagaaagcattgcagctatgtcacttctaaaactcacagactagtctggaaataggcagccctctgctgttgattaaaagtaaagtgctttttcattacaacaaaaggagaggattcttattttaaatttgaaactaaaacagggagaaaaataatttgaaatgggatagaagatagtgaaagaattgtaatttaatcagtatatagtgaatagtcgctgagtcagtgtctgagcatattagcactgaagtatgctaaaatgtagatcataatacctttctctcacttttcagtgagttttggctcttcttccacatataagtgacttata

SEQ ID NO: 79551 - DNA, 1425 bp, Homo sapiens
aattaactcaaagtagatgacacacccacatgtaaaatgctaaactacaaaacccctagaaggtaacataagagaaaaactctagataccttgggtttggtgatcactttttagatgtaataccaaaagcgcaatccttgaaagaaagaacggataagtctgaccttattaaaataaaaaaaaattctgttatctgaaaaagattgtcaagagaacgaaaaggtaagccacaaaatgggagaaaatatttgcaaaagaaaatctgataaagagttgttatcgtccttgcccgcgccctcctggagcgagcagttctccaagcacccagcatccagccagacacgctgcacaccgacggaggggacgtgggcagagcagtggtggccaggcttgggctggggctgctgctgctggcactgctcctacccacgcagatttattccaatcaaacaactgttgtaacaatttcaagtaactcctcccagagtacttcgactgccccaaatccagctactgccaccaccaaggcggctgttggtgccctgcagtcaacagccagtctcttcgtggtcttactctctcttttttttttttttttttttttttttgagaaggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccttactctctcttctacatctctcctcttaagagactcaggccaagaaacatcttctaaacttccccatcttctaaacccaatccaaatggcgtctggaagtccagtgtggcaaggaaaaacagttattcatcgaatctactaattccattccttttattgacacagaaaatgttgagaatcccaaatttgattgatttgaagaacatgtgagaggtttgactagatgatgcatgccaatattaaatctgctggagtttcatgtacaagttgaaggagaggcaacatccaaaatagttaagacatgatttccttgaatgtggcttgataaatatggacacttaatactaccttgaaaataagaatagactgagactattatgtatataatgtggggtaaagatattgagtaaattatgggatatgctaattacatcttcctttgactctgaaaatcagtattcttgatgcagaagaaaggagatatacatgtaacataagaggttaagtaaaaacttctaattttcaaattgaattg

SEQ ID NO: 79552 - DNA, 2299 bp, Homo sapiens
gttgaaatgttgggttaaattgtgttttataacatgtagcacactgtatctaaagacatatgtattgtatttgtcttaatggaagtgcctcccgcagcagaaatactattaattgtgacattttaaaagcgtttgctgcagaagtggtttcttcagtaggaaatggttagacttgcctcagttcttaacaagtgtctaaagacagtaggctgtagaagaacaagtattaggttttaaattttataatgtgccccatttattcacattgattgactatccagctgttacaagagcagtcgatctttattttgtgtaagttagtttcatttcatcagatgatctgcacagaactcagaataaaccatcaattttaggtataggctgttttgttgttggcattatcttttagatataaaatcatagctagggtgaactgtagacaagaaagtcttccttgaaacagggataatattcaggttattataaatatttaggcttgaagcatagagctactgtagggtgaaaaatctctgtaggactttctggggcttcagtaccatttacacccacgatgaagggcttaaatagaaaataatggaaaattaaatattactttaaggaaagcaaagctgcactaaaatttttaagggaaaaaaaacaagtagccatttatatttgtgaccttgcattaatatttaaatgttgattttaatatggagctagcacacatagatgcgcaggcacgcacacacaaaacaagcaaatgtaactccaggcatttgtaatttaatataataaatacaagcatgttagaaaaatgctttatgtcttattatttgttaagttaggggaatgagaaggaaaacaaaagcattctcttagtttcatcacaatggctgcatgtacatattgagattctaactgagatttactttgaaatttttcattaaaatattccacaataatcagtttttttcctcttcaattgagtgactgactccctcactcctcctgaatatagtaatgtagtttgatcataggatccctttgaaaaacaggaaggaggataacataaaaaacaacaaaaaacatttcaccacctaaggtctgaagccacaaatctttatatctctgatgaaacaaaggggatatcaatagtacttgaagaagaagagcattttattacttgcttaatttatttattgtgataaccacaattgcaaaagaagaactcaggatttgttttaaaatgtttctctctatggctcccattttgttttgtgaataattatttatgagttgcatgttgacacaaacctactcactggttgaaagctccatttaagtgagtttcaagatcactttcaaagagatttttaaattgccattgtttttaaagctaacataaaaccatttgctatgctaccttgaacctagctaagctttcctttaccttagtaagccaatcagaagactacaatcaatgaatatttagcaaatgtgctgaagggtttaataaggttttgttgttcaataaatttgcaaggtagggtattaacatattttgataaataaatggtgctagagttggcgcagaggtttatatattgatatgtcttagttattggcatttgtgtgtgtttgctgttatcttgatttcatgatttgttaggtatttttttcttgatgctagttatttcttcactgtacattgagacacagcactactgcacaccaaagtatgcaatacccaaaggaaactgtgtgatttctcctgacaaatgatgggagcctttctttatgagatactctgaaaaggagattttgaggccattctaatcccttgtttacattattagcttcctactaatataaaaataatggaaatcttttttgataaaaatattaagactggaggatttttaaccccttgtacagtattgcagcaaactctttaaatttggttgaattcgtccagcaaactttctggggttcatatattgcactaaatttgttgaacctgtggtaggcacatctcttaggataaatgcaaccaatacagtccacagattaaactttttaaatgtgtttcattatgaaaagacaaaatgtcatcaaagtgacagataaaattgtcttatgtagcaatgtgcattgatctcaatgagatatttctattattctcttacatgagaatattacagcaggaagaattaagtttagtttgcttcaccatgttaatacatgatcacaaaatgtgcatgagtgttattgacttatcttgtacagtactaggatt

SEQ ID NO: 79553 - DNA, 2583 bp, Homo sapiens
ttcttttttacattcagatggagtaaaattctaatgtgtaatgattacttaaatgtaggcctatccgtggcttatcagatacaggactagaaccttggccaagttctttagctagtttattaacctctatttgtagataaggaaacagtctcctcctttcctatctcacacaactgaggttatgatgaagggacttttaaaatgagagtaagttggtgctttatgttattattgataataatatttaggaagtattttgtcgtttttcttgttcctattatcatcatcgtgttattaaaatatgaaatacatggtaaccgcactattcattatagggcaaactggagtagacagtagttgtatcttatttgcagtggtttagttacagacatttaaggtagacacatttataagacagtttcccctatgagtgagccatcttagcatagattctggtaggtaacctttacagttgtatgtttcttcaagattttatgtcttcttcctgtaacccccttaaatcattgtttcagcaaatattcatcacaggtgtgaagcttttagtcttaattgaaaagtaacttaatgttcttacatattttttaattataatgcattatggttgcatttgttacatttatgtgtctgattgtgtagaacctggtctagaagaactctcttctaacataggaacttttttctttttaacattaacatttaataaatgacttaaaagtatatacagatacatgaattactatttacaggctagacctgttaaatctgattttttgctatcttttaacaggtccagcggactaggcaattggtaacttcaccgagtccaatgagttcttctgacggcaaagttcttcccctcaatgtacaggtggtcactcagcacatgcagtctgtgaaacaggcaccaaagactccccagaacgttccagccagtcctggtggggatcgttctgcccggcaccgttaccctcagatcttacccaaaccagcgaacaccagtgcactcaccattcgctctccaactactgtcctctttactagtagtcccatcaaaactgctgttgtacccgcttcacacatgagttctctaaatgtggtgaaaatgacaacaatatccctcacacccagcaacagtaacacccctcttaaacattctgcctcagtcagcagtgctacaggaacaacagaagaatcaaggagtgttccacagatcaagaatggttctgtcgtgtcgcttcagtctcctgggtccaggagcagcagtgcggggggaacatctgctgtggaagtcaaagtggaacccgaaacatcatcagatgagcatcctgtacagtgccaagagaactctgatgaggctaaagctccccagacacctagtgcccttttggggcagaaaagtaatacagacggagcactgcagaaaccttcaaatgaaggtgtcattgaaataaaagcaactaaggtctgtgaccagaggaccaaatgtaaaagtcgctgtaatgaaatgctgccaggcacgtcaacaggcaataatcaaagcactatcactctatcagttgcttctcagaacttaactttcaccagcagcagctcaccacctaatggtgactcaatcaataaagaccctaaattatgcactaaaagcccaagaaaacgactgtcttctacattgcaggagacccaggtgcctcctgtaaagaaaccaattgtggaacagctttcagcagctaccatagaagggcagaaacaaggcagtgttaagaaggaccaaaaggttccacattcagggaaaacagaaggttcaacagcaggtgctcagattcctagcaaggtatcagtaaatgtcagttcacacataggagcaaatcaacccttgaattcctctgcccttgttatcagtgattcagctttggaacagcaaacaaccccatcatcatctccagatataaaagtaaaacttgaaggaagtgtctttctcttggacagtgattcaaagtcagttggcagctttaatccaaatggatggcaacaaatcactaaagattctgagtttatatctgccagttgtgaacaacagcaagatatcagtgttatgacaattcctgagcactctgatatcaatgacttagagaaatctgtttgggaattagaaggaatgccacaggacacatatagccagcagctacatagccagatacaggaatcttctttaaatcaaatacaagcacattcttcagatcagttacctctgcaatctgaactgaaggagtttgagccttctgtttcccagacaaatgaaagctactttccttttgatgatgaacttacacaagatagtattgtggaagagctggtgcttatggagcagcaaatgtcaatgaacaattctcattcttacggcaactgtttgggaatgacccttcagagtcagtcagtaactccaggagctccaatgtcatctcacacttccagcacccacttctatcatccaatccacagcaatggcactccaatccacacacccacacccacacccacacccactcctactccaaccccaac

SEQ ID NO: 79554 - DNA, 1031 bp, Homo sapiens
caagctatgagccattggcagaggctctccagagtgcaggtgctgagaagccagagctgaggcttggggtcggaaaggggcaaaacaactggagctggatttgagatgaaaaattgtgatttttaaaaggggctgggggttcaacagatcctcatcattattgagtatggggagagagttatagcttcctcattgtctatttcctgctccccacaccaagttgttgttgttaactagaatgatgaaaagcagaaattgggatggggaaaagaaaagaaagggcaaggtgtaccagcaggatagttgttcctctcctttcttctcttcattgtttttactgcccacaacttactttctaatgatctcaatgccacgccctaaatctgaaatgagcttttaaaaaatttttattttataatccatttttcctaaaatttatattttgcttattttgtcaatttttttcagtgtttatcttactgttttaaaggttttctcagtgacacttttttggaatatcttaactttagtcttgttaagaaattctgcttctgaatttcttctaggtcatactggaatcattgtatagtagcaataaaataatagtgcctatttccatgaattgctggtaggattaaaaactgttttctccatacaaatttattccattatgaggagtggcttcagcaaatatttattgaattattgaatgcccctcatgggctaaatattaaaatcatgaaaatacatgtatttatttctgattagaaatggggggagggaaatttactgacctttgagaaaatgtaaaaatgctgtgttggcatttatctcagcttctgcacatttacgatatagctacggtttttaaaatcctgttgttaactgaaactgtcacctgattttaaaatcctgttgttaactgaaactgtcgcctgagttgaaccatattgtaagatgacaaaactatattgacaattgtttataaattcgaagtctaatgcttcataaagaaattgtgagttaaaatt

SEQ ID NO: 79555 - DNA, 2248 bp, Homo sapiens
gttaaagcccttgtgacactcttaagagttgtttttgtcccagagccctgggctgaagtttcccttccctgtgccaggtttccatctggctattcctttccttctgacctgtttgttactggtggctggcacagcatattaggaacatttattcataaaatttataacagatgagaatcttttcatttaagacagtagtatttaacattctaaaggggtatttcagtttcaaaagagtaaaagtgtcccaagtttttaatattaaggtttttcttactgaagaattcagaaagtagatgttatgtcatgttgatttttttttctcatttcatatatggttacttttaaagtgctgtctgtataagcaattcatttaattttgaatatttagaccttaactgtttattacatattgctacagtggactaagaaaaaaagcttttgttcatatgccaacactgcccaaccttgactttcacaaaactggagatggggtaagaattcagccttttctttttaataagtaaaattgtacctttatattaacattgaaatgcatcctgcaaagtctcatttggttaagcctagcgactgtgccttttacaaataagaaaaaaaaaatcacacagtggctgaaaaatgttagtgtatatgacctacgtcaacatgaaatttgggggaacaaaagtttagaagttactgatttctcgatatttccaaaatacatattgactatatgtgtgtatagtcaagaggaaaaagtcagtcatcatgtaatatgttttataggaattttagaaaaaatgtgtggctattggcatagttttgacattagaaagattcaaaacatcagtcttcttgtatgtttaaaaaccatttaaaatgttatattcgcaaggctgctgactgctgtgcactagtgggtatgagtcccttatttgcaaagctcttatatgtctgccagtgggtcaattcatactactttaacccacagatttatattgtatcttctaattaagaatacatatctttaacatgcttcaatttaatttctctggtcttttacaagttaacatttccttttttctttgcctagttggaaggagctgaaccttctgggcagcttcaaaatattgatgaagaagttatctcttctgcttgccgtcttgtgtgtgagtgggcccagaaagtgttaagccaaccatttgacaccgtcttggaattagcccgcttccttgtaaaaagtcactatataggcaccaagtcaatggcagctctaactgtaatggcagcagcaccagcaggtacaacattactgtgaacaagctaaaaactgacagaggtattattgtatttagaattggtagcaaaagaagagttagatcaaagaacttcatccttttagtacttgcatgtgttcactcttactccgcttaacactaaattcagatgggtctgttgagccaagaaaataataatcctttcattataaagcttaatgctatgtttctatatattgctttgctggcatatgaaactgtagattccccagctgatatgttattaatttttccattgctacttttacatttatagaatgtgtttatatgtacttttatatgtacatatatgtatatgtgtatctaaattaataagagaagtaaaataataagattaaattttaaaattacttgttagattcccattccagaaactaatgcttataaataaaattatctttgcacactgtgacaggtaacttagcctcaaaaaaacaaaaccgtacaaagccttactaaaaaataacaagagtgatattttttactgtgtattcatgactatttttattcaaagatgagtttttggaatcgacaattttgggaattgacagtcttgttagaatgactccctcctaaattaatagttgtgtaaaataacagttctgatgaatttttaaaaatatcttatttcagttataccttataaacctagagtggataaattattctagaaaatcaggatgtctgttaaaaatgtagtgatatagtgatcagagacttatttttccaaggactgtccttctaagtgttaattctgaatatttaaaaatctacaatagatttatcttggccagaattatagtctcttaattaacttcacttctttttttagtatcttttacacattaataatgagtccgttttcttctaattttacatttagtatgtgggatgtatgtgtgtgtaac

SEQ ID NO: 79556 - DNA, 1050 bp, Homo sapiens
tcattcatatttcccaggtagtggttctcccaaaggccttggtggccagaataaggtgtggccttggtctgctgctgaactggtagaggattgacattttacctatgactggcagctctagagaaaaacagaacacctgattccagtagtagttaagacttggtgtgtctccagatcccacttgaagttactgtcttacaaagtaacttttttcctagcaatactagggatggtgggggtagaaggaggataacactaggacctttggaacctctccccttgcctgttttttctcttatcagtaaaatgagagtgttggtgtattcgtagggtcccttttagttcaaacatatcatgtttctaaattttaaaccacctagtagtattatctctgtctgatgtgcatgatatgtatattggaaattatcccagtatgtgagcctgatacatatgtggaaacttacagccctactggctgagctggatatattcatttatgagcactggttgggattgtaattcgaaaactttgtaccaacattgtatcttactgcaagatttatgaatgttattgaaagcaggactatataccctgaggttgaagccagctaactaaacctgagttaacatgcatcaccaaagagtgatgatcatagacattgtggcaaatgacttgaaagatcctttgcttcactttgtcagaaggatcaaattgtattgaaatagcaccctgcgatataattctgaattctgtcactctaaattggtccttccttcttttgcaggagctattgtgacaatcttggttaccatccattaagtgctgctgattttggaaagatcatgaaaaacgtctttccaaacatgaaggcacgtcgtttgggcacaagaggcaaatctaaatatcctttaccagaatggtgttagtaatatctctgtgttctcacttgttatagaacatctattgttgtagttcaactggcaactttatttagaaataaacttcaaattaaagcaactcaaaagcttaagtagaataattgcaaatgt

SEQ ID NO: 79557 - DNA, 1028 bp, Homo sapiens
acaggaagtctatgatgagtacaagtaagtagtatgtgtaatatggcatgctgatatattaaagaggtaaaatactatacttggccatagtgatttgttttattattggtgaatatcaagctggtatatgggaattacacttagaaatctcttaagattcattccagctctaagcttctgtagtagcatttataataaaggggggcaggattaatgaataaaaggatttctgtagagttcttcaggatgacaggagggaggtcagagagtgcaaggacagtggtgtaggattggtgaataaaaggattcctatagaattcttaggtatgataggagtgtgtatctggggttagagagtggaaggcaataaataaatcaatacataaggcgaaactaaaacatgattttttacttggactttttaaaggcccttttcatgaatctaaaagtcttctaattcttctccataccaaagaatattgtatattatttatcaaggacaagagagttgtccttgcacatgttagacactcaaatttggttgtatttacaatttatttaaatccaggatacaaaaatacagaggctgatgagcccttctggttagaaaaaggttaataggtgctaaatatagtctcgtttaacatttttataattgatttggaaggaggaatttattccagcagagtaaataaaagcaaatttgagggcatattgaaaggtcagaccaacaagaattaatgtgttgtacttacaaatttggggcaaaaagtgtcaaataagtgctattgctaaccagtgtaaggtaatgcgaaggaaattgtacttattgagattattggtatctattcacagttcttactacctcaccaaaagaaacataatggagctagaagaaagtctagataaaaatatctgaaatgatcaagagaacaaagttaaactgaaggactctagatttattttctctttacaaaggttaaaactgagagtgcatgtgatccaacttgttcattcattcagtctac

SEQ ID NO: 79558 - DNA, 1011 bp, Homo sapiens
ctggccccaactacttgggaggctgaggtgggatgatcagttgagcccaggagtttgaggctgcagtgagctatgattaagccactgcaattcaatctgggcaacagagtgagactctcttaaaaaaaacaatttgacaaaaaaaaatttcaggaaccatatttaagacattaaagtggggtgacatcggaggtaggaaaaccagctggttagacattttagaaatttaagtgtcattaaaagttcattaagggcaagaactgtggtggtggtgtgttgttcatctttgttgtattgttcactctttgtatgatttgtgatacatagtataggttcatagttattttatgccacttgtggaacatagcagaaaacaaaagtaatgcataagcaaacgaattatccttattcttgaaagaaagacagctgaagacctagactactgtggtggcagtgaaaaatcgagactggaagaagatggggcagagtgttagagggctaaataaaggattaatgtggaatgcaccaagagaaaaagagttaaacacactcccaaactgaacactgtggaaactagagaaaagaaggtgatgataagtagcaattaagaagagaatgtgtgtttgttttctttgaggggagagctacacaagggtatagctgataacattaggtattggagcaagagccaattggaaaatacctgtaggccatgggattttaaaaatgtaaatttgggagctatttgcatgtgattgattaaatcattatgtggatggattctaagattaaacttttgtggatatcttctgataagactaagaataggcttggttatatcatgttaagtattttcaaaaactgaatctctgtttaaactgtgctttattaagtaagaataaattctaccaggaatgccagtaatctgtccacatttttcattgcaatggaattttgcttagattaggctaccagaattttactatgaatatttttattataataggattt

SEQ ID NO: 79559 - DNA, 1051 bp, Homo sapiens
agtcatctgcctctgggaaacactaagctgctttctgtccctagggatttgcctattttggatatttaatataaacagaatcacatgatatgtgtctggcttctttcacttagcacgatgttttcaaggttcatccatgttgtagcatgtatcagtactccattccttttatggctaaataaaaaattataatttttaaagtttatgaagttggtcttttctctggtgctccaaaaatagaataccattatgatttattttataaatccagccaaaggaattttttttgaccaccaacgaatttcaacatagaacagaaaacttttaattcttatcatttaaattgtcataaagcatatcaaataatcagatgtttaacatacttgccacatgatactcttgccttgacaatcaagcaaggttagggtcttctcctaaaccagtgagcattgtttcagaagccactaattagcagtggatgacacagtatatccaaaaccagaaatcttgatgatgagcccagccttgctggactgaaatgccatcactatacacttgagtcattttttttgtttgctttatagaattttgttattatcagttttcatgctgctctccaaattttttcttctatgtgttgtaccccatatggcaatgaaaacagtaattgaacagttacaagttttcattgttttaaaaaaaattaggacactgactttaatctttttcaaaacttttttttgccatcttctaaatcatctctttggtgcttaatactaatttagaacatcttctgaaatttcttctatgttctggaatttcttttctattcttttttccagtatatttaaaatttgaaagctatatagaatccaaggtttctccaacagtagatttttttctttatgatcaaaaatgatatttttattacactttctcagacatggctcataatattaggtattttattattataaccttctcttaatttaatatgattggcattggtgtgattaagtgggtgatgttaataatatttgacagtagttca

SEQ ID NO: 79560 - DNA, 1498 bp, Homo sapiens
tacgtgcctggcgtttgagtttgtggcttttgtgttagattatttgggggcaaggttattataagagctattctttacagggttggggacccataatggtacatatgaggatagataatgggaagaaagcctctgtttttatttcttagtaatatggagtctttactgtcagttcctgctttagctgccattacaacggccagccaatagaaagcaaaaatagtatataacaaagaataatgataactgttttgagtctctgctatagatcagccactgtgtaaaacatgttgccttctcactttcctgtgagaccatccttgattactctattttaaattgtggtttaacataccctcccaacactttttcttcatagcgtttatcatcatcatgtaacatatgttttacttttaaattttattgtatgtcttcctgttactaaaatataagatagtgcctagagcatagtaggcacttgatgctagatgaatatataaatgaataatgttgtttaatttttaaactttccaagtctgtcccatggtttagtgttttaaatcagaagccagtcttcttcatttacttactgctaaagtgttcctgagaaacagacctactattagaatggggccttctaagaggtgacacactcccagcaataaatttgagtagttcactccagtagtaattcttaacaattactttcctgccctccagagatatatgctgcatctgtgaggggttatggatgtgtggagtatgcaattccaaaaaattatcttcttccctttacaagagaaagcatgctttctcacctcaaatccttgctttaatgaatactaaatggtgaccaaggtcaactcaccgacacagacttgattgaaactaaaattttgtttgcattatctaattaaaatatatcaaataaataaataacaaaaattcacctgttactgctcgaaaaaggctcatgggtagaagatcacatttattttgtgatacggcactggagttactgttagtaagatttatctcagaatcttattttttctttctattcacttagtggagaagaaataggcacttttcaaaatgaagagcatgtctgtgcagaatttacttgaatgagaaaacttggcagtggggccagatttaaatagcttgtttggttttgtttagtatcacaaaaagaaataatttatataaggccatgccatttaaaggattgtgaaccttttactctttcctttttttacattaaacacttgagttattgtatcctcctttagtatgtgagaaaaacatggttattaatgttttttttttctctcctgttagggactcgagtggactaaattgccactgagccccaaaaaaataagttctggtaacttttgtgtttcatgattataaacaatgctctaaccattgtcagctagctttcaaatttattacattgtctcaaaaatatgatgggaatttctcatcattacca

SEQ ID NO: 79561 - DNA, 1106 bp, Homo sapiens
gtgtgtgtgtgtgtgtgtgtgtgtgtgtgtgtgtgtgttgagacagagagaggagggaacagaatcttttatgtatcaaatcttacaagctacagattgtagtacatcgttatgacttttaagtgctaagcaaattattgtccagagtggcaggcagacagtaaaaatcataattattgtaagctctgggccatacttgtaagtatagtaataaatctgcacttatacactgttaaaaatttaattgtttattcaaaataaacttaggaaatgttttaaccatgctttaagattaaatttagtacagtaaatgggaaatagatttttgttttgctttgtgaaaaacacagatttaggctacaatccctaatcttaataggaagctgtatttatttttttcttagtaaggaagactaaattaccacatctttttgagaatattgcagatagttaataaacttttcattttactaacctaactttctctttcttttagcaaaactgtacaatctaaagtggactgcattttggtaagtgaaataactaatattaaaatccttttgcaataaggtttttatgacgatataaaatatacagttttcaagtaaatattgattttaaatataatctaactccagtgaataaaatttgatattttaattacagccccctcgggtgaattgtttataagctacctagatacttacctgtatctcatcaataataaaatcacaatctgaggtaattacatgtttttgaatcttaactggctcttactgaaagactgcttaaacgaacaattaaattggatatttatttttctattctaataactctgagaatttgtttagagaaaagtttttgaagatgtttaatgggttagttttgttgagatagtgtgtttttcatgttttggttggcagcctgtaggaattaagccataataatagtttaagtttagattctacttaatagaattgtaaaaatttgttttcaaaaacagcttttaagatgcttagtggattagtttttgtggggttgccagctttcaagatttaaagccacaataatagtttaaatttagattgtgttagtatagtagtagt

SEQ ID NO: 79562 - DNA, 2290 bp, Homo sapiens
accttccacaagtaagtgagaacatgtactgttttttttttctgtacatggcttatttcacttaaaataatgacctctagttccatctatattactgcaatgacaggatgttgttcttttttatggctgaataatactccattgtgtatatgtaccacattatccattcatctgttgatggacacttaggttgattccatatcttgaccattgttaatagtgctgcagtaaacatgggagtgcagatatctctttgacatactgattcctttctttgggctatatagctagcagtgggattgctggataatatggaatctctatttttagttttttgaggagcctccaaactattctccatcatgattgtgcaccagccactgtgtccccctaacagtgtatgtggtttctcttttctccccatccttgccagcatttgttattgtttttctgtgactggcttattttacttagcataatgtcttcaagattcatttatattgtagcatgcatcacaatgtttttcttttttatgtctgatgaataatattctattgtatatgtgtatcatttttttttgtccatttatccatcaatagacacatgcattgcttccactttttggttattgtgaatagtgctgctctcaacattagtgtacaaaggtctgttctagtctgtgcatttattctttttgatacatactcagaagtggaactgctggatcatatggtaattttaatattttgatgaaccaccatactgttttccataacagctacaccattttccatccctaccagcagtacacaaggattccactttcttcacatctttactaacacttgttaattttctgggtttttatataatttttatttttaatagtagctatcctaatggatgtggggtggtatctctttttttaacctgtgagtgtctgattgctttagcaccatttgttggaaaagctgtctttcctccatttaataactttcacttctgtcaaaactcacttgagcatatttgagtgagtttatttccaggttcttagtcatgcttcactaatatatgtttctgtccctctgctaatagcagggtagtgactagcttcataaaatgaattgggaagttttctctcatcttctgttttctgtaaaggaatgtgtagaattggtgttagttcttaaatgtttagtagaaatctctagtgaaaacatctgggcatttacattcaattttaaagttttgttagtcaaacttgtgtcaacataatgagagtgaaagggtaaaatcactctgggaggagaagtgagagaagatagttgcaatataactgaaagaaggttagtatttgagataaagacattttacagatttctaagagagaaacaaaatttgggcaaaaagcataatcaggcatttcatggaaaggaaatgtgttcaaaaacctagagaaacttgttcagacttgttagttctcagggaaaggcaaattaagacagccttttcctacccactggaattggcaaaacttgagtttcctgctactggcaattacagctatctgctctgaaaactaaagtgttactcacaacttcattttatgttctctctcctttggtgatgtagaaagagcatttaattcagaccagggatttggagaaattagacaatattttttggagtatgtgctttgtcttaaatttttgaaatgctctccacaagccatagaaaactcttctttcttaggggaaaatactcttcttttgcctttattgtcttaatagatgcctttataggcattcaggtgccttttggttctagacaatatgatcgttttagatgtttctgtgtatactacttattctcattggtcagttacttctttaaactttgtgctttgaggttcacagattattgagcacgcctagtttgaactgtagcaggtttagagtaaggtgcatgaccctgactcgcatttgatttcattaagttccttttttggtcttaagagcataagactaaaataagattatttggggtaagattttaattacactcatactatattccattgccattattacttgaatgtaggtatgggtagatagtatagctccatagatcattaccttttggttttgatcaaatcaaaaaggtgttcctgatcatttagttattagactttacattaaaatattgtaaggatctagaccctcaaagctttagcctacaatattctcatattgcttacaaatactctggcactgattttccctgggtttgt

SEQ ID NO: 79563 - DNA, 1030 bp, Homo sapiens
ggtctggagttgggttttgccttttgcccaggtcagttatgctctgatgaagctccagcaggataggctctggttgatttaatttctcctgagggtagcgttattaggaacagaatgctttggcatatttcacaatgattccttttctccttcccttgtctaaggcatgaaagttatctccaatattcagaggaggtttttcttaaatattcactgggaaaacctggtcaagctcttggaggtaaaagtgtggagatgcttgattactggatttccctggagtttatctcagacttgttcattctgagcctcttgtaattcatcagttatagtttgtttacctcctttggtacagattctcatgcaggtttgtggcttgtgggtttctgctccagcaagctacaattctctgcattttcctattggtctttcccatttggggggtttgtgatttgacccctgatcttaccactctgacaaatcctaagaagagttgttgatttttcagtttttttcggctttttatcttgtagggcttagtgttgacttacagcttcttacatgctggaccagaaaccagaagtcctagctctttttaaaaaattaatctgcttaacagtcttttgtagagcacaagtccaatttatcagtttttctttctatggataatatgtttggtgccaagtctaagaactttgctttgccctagatctgaaagagtttattgctttttttctcaaatgttttgtatttctatgttttacatttaagtctgtgatccattttgagttaatttttctgtaaggtatgaggcttagcttgatgttaattttttaaaaatttgttttaattatagtaaaatgcaactaagataaaatttaccactttagtcatttttaagagaacagttcagtagcattaagtacagtcacattgattgtagccatcaacactagccatccacagaactcttttcatcttgcagaattgaaactctgtacccattaaacaatacccccccatttcctcc

SEQ ID NO: 79564 - DNA, 1030 bp, Homo sapiens
acatttagaatctgagaagttaacagctttttattaggttgtttcaaagtttaattaggttgtctaagaaaatatgtgattagcctttgatataaaaatattattacaaaatcatttaataatgtcctatagggaagatgtgagtcagcaagcaggtttatagaaggaaacggttatgctagatagtttacttgcttgtagtctccagatataaagataccaaatttcaacctgttgcaggcacctgttgaaggcagagaggaattaagctagaaagacattttggagttcctaacttctaaagtgagatgtgattgggattcctgacttctaaagtgagatgtgaaatgttgtgaattacctacattttcagcctatttggagagaagtacgatttatgtcttgctttaaataatagaataaaatctctataattgtttaaaatcagtttttaagtaagttggagtgcatattccagcactggcagtgcagtataaacaatggagaggtagctcagacagggctttccataatgaagacaatgacccatgagggactgtaactgaaacccagcaagagaaatccggttttataagaaattgttttgggatgtcagttgtacagtgtttgttacttgtttatatagctgaggttacatgtgttaatctttgctatgacttaaaagagataaatgggctctggagttattgtggcagattaaaaaacaaaacaattatattttagacctgcatattttggctgttttggactacagttgttcatcccttgagttccaaatgtaaaaatgttacattcagtaatatctaattgtgaaatcttgtttgttactgctgttcttgttctttttttattcagaatcttaagtagtatttttgttataatactaatacaaatcagtgataaaggaggcatcaacaaatcagcaggaggattatttaagaaatggtattagtgcagttggttagctgtttaaacaggcagagagagagaataaattagcctcaacccc

SEQ ID NO: 79565 - DNA, 1465 bp, Homo sapiens
aattttgtttttgtatttttagtagagttggggttacactgtgttagccaggatggtcttgatctcctgacctcgtggtctgcccaccttggcctcccaaaatgctgggattacaggcgtgagccactgcgcccagccatttaattacatcttaatcattgttgaagccatagctcaagtactctgaaacattcgttagctactgtagtacacattgaccttttcttgacttcatagtgtgtagtgagttctgtacaatttatcacttaatcactcattttttttccagtgctgttctaataaacaagctatttgaaggtggggacaacaattttgcatctttttatttttcacctagtggtaggtactagtgaatatctttttttgtttactgcattcttagaggcacttttatttttttctacatattgtttctgtatttgataacataatgtggtaattttctcccaaaacaagatattaaactgatgttacactttacagaataaaggacttaacagcaattgatacttttaaaaattgcatttgtgaaactgaagtaatcatttgttgagagtttcagttttcccaatcccatatctttcactatgtacctagatttaataatgtgtgttccaaatgaaagccattgtgtccttcatctaaaaaccactgagcagatgactaccacatggttcagcaacctttcgtgactgagtatacaacagtagttagggttttatggactggttagttattttgtattccagcctagttcccaagagataaacttggaattttaaagaccccttaacattgaattggagatggcttttttaagtttggtcctagcagagggtttgagctatttttttttaggagacaagacccaaggctaagataacttgtttgagttatggccaaagcctgaaggtggcaaaggaagcctgtcggtgagggcagataaggaaggaggtagatttatttgggaagtatggaagaaataggactaaaataggaaaacaactgtgagggcctgaagtgtttcaaattcatacaagtggctaccctggctactgatgtagagctttctttccttccttcctttttgggtggggggcaggggtccaaagatcttgcttttaaagaccctttcagctttaaaattgtattttatattgtgctacttggttacagcagtggttctcaaattatgaccctattagcaccacctgggaacttgttagaaatttaaatttgggggctcccccaacccagaattgctataacagaaactcttgggctatggttagcagtgtttgttttaacgagtcttccgggagattctcattctctaactgaaaccgaagtttgagaaactactggattagaggagtcatcttcttaaaaacaaaacaagcactttgggaggccaagacaggcggatcacgaggtcaggagatca

SEQ ID NO: 79566 - DNA, 3563 bp, Homo sapiens
aatataattaatttatcataggcaatcaacagaacattttcattggatgaattattaggatttgtcagtgtttccttgggtgttagctgaggaggacttgcttattgctaccttgtgcaagggttctgttatgtgagattaactgtgcaaatctttattgagcatatattacatttaaagtagttaagagctgtttattgtgcaaaagtaaggctatgcagtaatcctggttgttggggagtttactaactgctggttgagagattgtagtagggaggctgtttgtgtgctgcttttgttttgtcttctttataaagagatgtttaaccttatcccataatagtaatgtaatattttaaggcagtgaatgtcatattgtagattcaattatataaataagaaaagtatgtactctttcagaataatttagtgcagagttgagcttcacagctattcctcttcatctaggatagatattttaataagtaatcgtgacagaatgttctttgtaaattataaggaacatgatagtaagatggttattctacatctctgagcaaagtagaccactcttgtccagtgcctcctattctaccattctctttctgtttagtcttttagttgctttctcttctgctttttggagggttctaagttcgagttaaagatgagaagcatgggccaataggaggaagaatcttcctgccttgggtaggataataaaataaggaacaataaacactaaggccttaatgcacttacttgctgactatgagattaagatatttggcactcaacccacataaataaataccttaaaacatgatttttctttttttgcgactgtaaataggcatttactttttctatttcactaactgtatgcctcctatttataagacaaaatagaaacatgaggtttggttaattatgtacaacctctctatcaggcatctattaccgtagctcatatatatataacaaaaagttgtgtgggaggtgaaattttctatttcctcgtaactgagcacaaactgaaaaattctgatattccttactatttgagtcttgcttttttcctgagtgcagaaagtgaaagatcagaaagtgacagattccaatctgttatgtcttggatttttgggaggcatgagtccatatggtacacactaccatgtcttccaaatagccttatctgaaataaaaaaaataaattatctgaacccatttgttgtctaaatttgaatagcaaaggtttagatagcaaaggatacctttacacccattccaacacgggattagcaaattgattggaacttgcatgctaagtctgattgattagtgatatttctagcaagggcatgggaataagaagtaatgatacacatgccctataattgccaccctttttctttccaaaatcagtaatttttaatttgagctctcttatagatgaagcattacagcaatggctatcttggggagggagagtcactagggctattgtcttgccatttatgatgcctagttttaaggtataaaccaagcatggagagcacttggtttgtgtgtttttctgtttttctgtggcttttctgttttgagcacctgtattgtcaagtagctacaagatgagaacagggcactttgggaggccgaggtgggcggatcatgaggtcaggagatcaagactatcctggctaacatggtgaaaccccgtctctactaaaaatataaaaaattagccagtcacagtggcggggcctgtagccccagctactcaggaggctgaggcaggagaatcgcttgaacctgggaaaagcaggggctgcagtgagccaagatcacgccactgcactccggcctgggcgacagagtgagactccatctcaaaaaaaaaaaacaacaaacgagaacaggggattactgtatgaactggctgcttcaatttgcactatccataaccctttttctttgcttccattatcttatttctctacttacgtatgtgctggtctggtcccattacctgctaccttaagaatgttgtttctgctgatataagtgtctaactttaagatccagcttgtgaaacatgtctcacgaacctttcgtcaactcccaggggaacaatgatctgagttgtgtaatttaatttttttcagtagtttagactggcctttcctaaggtaagtccattttagtgagtttttactgaatttaaatgaaacactctcattttctaatatgtaaagttgataggaatttggagattgaatatatctgaaacaaagtaatcacttgcagaatcagtagtctacaatatgacagtaaaatatgttatttctatatggcaacaccaagaacttaccattgtttttgcagtaagcatgaaatttaaaaatttaattggatgagtgtcacttcagtgacatcttgcttagagtaaagttggtgcttctgggaacctgagaaacgtattccaacaagatgctttagttaatgtaagtgaatcacttccgtaatttgattgcagtcattacatctattaataagatatatcaaagcaatctatgatcaaaatttaactgtcatattattaaatgcatgtccttttttctgaagcaggagccactagcaagcagcattttaggcagattctacatgtacaggtttttaagaagtcagaaggtcaacgataaattctgaatttatagaatcatgtagtcagggaaaactgaattcagtacacatttgttttaatgactgccacatacaaggcataaaaaggttaaaaaagtataagacattcttaccactttaaaacattcaccctcttttgtgggagactcatcaattgagtttatcaaaagtaagttttgttaaatgcaataatggcgtataagcagtggtataaacaaatacagaattaggtgagggagagattcagtgaggacataatatttttactgacaaaattcaggatagtggccttaatgaaaaatcaagggatgggctataaatccaaacacacttaacagtatacttacttggtcattgttaatctcactagcagaaattagattcagagttatgatgacagtgagctttgccaataatgtgaataaatagaggaaaatggcttgggagaaaatttgcttgactaaggaataggatttccactaactaatcacaatcctctcatgttaagtttcgatgtacaagtagaagaaagaatataaagtaatagtagagaagaaaaggatgtgagctgggtgggaactggagcagagtaccagagtacaggttgccacaaccaatgtcaccttaaacttggcctttcacaaccacgatttttctatgccttagtaccttgccacctcaaattgctttcatttactctcatttcatttactttcatttcattactcatttcagttactctaattcttttgatagtagatatcacttttccttctttccatcagtctggcagcattggtttcatcttttatttttctctcatcctcgtgtccagtattttaacaagtttcccagtttgc

SEQ ID NO: 79567 - DNA, 1034 bp, Homo sapiens
gtttttgaatcaggtagtttattaactctgttgagaaatattgttccttcagctacagtggaaaacatgtactataaattcataactttagagtttactttaactgaaagtctatgattttcattttgctttaaaaatacagaccgactagcacatcagctggcttccatgtatttttgattagtaggttgacctcctacctaccctgagtttagcctgtcttcaataccaagcacacaaaagacttaagatgcattttgcatatccgtattgaggctagctgtgtcccaacatggtttctggttccagaaggaaggcagttccttgctctcctatgattttaaactgataaaattgtcttccctattgacaaaagttaattgcaagttaagcaattccaagcctgttgattttcttgtcttgtttaggttgggtagtggatatgtacatatttaaatgattgaccaatttgctctctccattgaaaggtgtcttgaatgatggtatgtgcaggactgatttggtttatgtctaactgtaaatttttggtattaattggggaaaatgagcttcatagtggtagaaaagagagaagtgtcttgttatgaaagatgcattggattaagaattatgttgcattactttttccattagaaaataatattgcatgctaaaattgtgcaaatgaaaattaaaataagccttatcatttacttatatttgaggactttaagcaagaagagtttgtaagtacttaaatgagtatctgctatatacaaagtatgccagagactggcatttgaggaatgcccattcacttgtaatattaaccttgtaaaattgacctaagcaaaaatatgcaataaaacttctcttttattcagttaggggaccaggaaaagaagtgacaagtgtcaaggtaatgcactgtggaaaaagtagaccttagtttcctcatttacaaaatgagagatttttactaagtgaccgtgaaggttcctgagattctaacactgttactaaatcaatattga

SEQ ID NO: 79568 - DNA, 1422 bp, Homo sapiens
cttgcttgccatcaaggttttcacaaaaccagtgtgtatgtgtgtgtgtttttaacctctagtaacgtgacgtaactttgtgtttctgaaatcatcattaaattgaattaagcaccttggttttacattcagatgtgggaaatccaagttaatggactaaaatcttttaagagagacaaattttaaaagttgaatgagtaatgtatattttaattgattatgagaacaagaggggaaaggaatcttcactttatagttttaaaataagtgagttgtggaggcaactgactgaaatgtttgaataatgatgatagtcgagtgcactttttggcaaataatgtgtaaatttaatttttttttatattggcacatccattacagcctaactgctctgactttaacatgagaaaaacttctgaagtagagtgcactccagtttttggtacttgctctgaaaaaataatgggcagcaaacacgtgaatcccaaaatatgaaaatttatatttttgttttaaaattgtaatgatacacttattggcatctaatgatcaactttagaaatcctatttgcaaaaatgatttttatatacttaaaatttcggaataaacaacatttgtagataataaacaaaattagtaaatatacttaatagtgtcataccccctgctccacaagaatggatttatattattcatcaagtgactatgtaaaataaagatatcaaaagtgaaaactcctttactaccatatattcctaagaaatagtatatatgtattaaatcatttttaatagatgattgcagttagatatttcacatttttgagacaataatattattttacaaattattttatcacctgataatattctgagagactatcagttttgtactacttcctgaatcatcctttggtgccattattaatgagagtttaaaattacactcaaaagaaatgtgacatttaaaaattatcaaatgggttttgcatttggtttatcatagtttctaaattactgggcttgcatatcacaaacaagtctgtacttgtcctcctactctacaaatataaatatagtatgtgatgtaggcctttggacaataagttatcagttcataatttactctgtttattaaactgaaatatggtttgataaaagtatgtgcattgaaatatcaggcattaaatgagtctggaaaaaaagcattcaaagttgagtggaaaagagttggaaatatattttaaaggtaattatagaaaataaggttagtacaaaattgacaatgttgttatgtttctataatatggttatgaataccttcaagttaactctaggttaacaagcttgcatgtttcttacccttactcattcttactccatagacaaaaggtccaaatcactgacactattcactagaaa

SEQ ID NO: 79569 - DNA, 1022 bp, Homo sapiens
acttcgtcttcaaacgcccccatctcacccccccacagccccggccgctgacgggaggaggcggcggcgccagcggggggctgaggggcgccgccatgcctctcccgcggtgaagcgccccggccgtgaggagccgctggtctccccggtgatgttccccaggcggcaggcgaaagcgactcactcgagccctggggtaaaggcctagcttatccagcttccttcctcctcctcctcctcttcccctccccctccccctcctcctctccccccttcgtcctcccctcccggtctcttccctcacccttccccgcgcccccatctttccctccctccctcccacccctctgcagcgatggcagaggaacaacaacagccgccaccacagcagcctgatgcccatcagcagcttccccccagcgcccccaactcgggggtggccctgccagcccttgtgcccgggctgccagggacagaggccagcgcgctgcaacacaagatcaagaactccatctggtaagaggatcctccatcgctcgcgtgaaaaagcccaggcacatttctgctgcaaagtgggtggggggcggcgggcggggggagcggaggaggaggctgatgcattcattgaatgtggctttccccagtcgggtgcacatttgtaggatctctggaggtgtgcggactttgcatcaatcagcccctgtcttcttagctaaaaaatgcttttaccccttcctcaattgtgagtgcagataaacaagttttttggttttattttttcactcattgtaacagaaatatgggtcgaaattaagtcatattgcatgatggtggcatgaatttggaactggagaatgtgaaatgtgtttactcctttttgcagccatagaaggaggaagaagtgtattgtgaattttcaccaaacagatactgtgcgtaagaatattaatatgcagcacaaaacctaatgtgtctcttcctttcagttgggttagctgctatttctgaatgtttttgcctcc

SEQ ID NO: 79570 - DNA, 1050 bp, Homo sapiens
tccaccctcttgcctcactttcatttcttgatgtgtctttgccaaaagcttttacccctgatacttcacttttagcatcttcacagtcttctcaacattgaagtttttcctgatttgagacaaatttttctacccatttagtgaatttattttttaaatttcttgtgcctccttctaatttctgctgtatgctgtataagctggaagactctaaagggctggggaaactggagttagaaatattatgtaaaggccttgatattcttacattttccccttaggatggaattttttaacccagaacaaatgaaaggtgcaactagtgttatagaccttatcttcatactatagcatttagaattccgtgcctttatgttatggaaaccttggacaattctgaaatgatgaatgttcagagaggcacttgaatatatcttaatggtttggttttttttctatatgatatattacctatctttactcatttaagagagatcggcaagaagtacgatctaggcctgtttcaacacaaatgaaatcatgtgatgacgaagatgattacagtttaaggtaagtatcttaaattctcaagcaccttcttttaaaaggatgtacatggatcgttatgtaagatcttttttgcatgcaaacattgaaaaatctataatttgaagaataatgtatatatagggggcttataccaatcagacacagtgcaagccctttatctcatgtaattttcaaaatattattttgaaatgtatattcttgtcctcatttttaaaactttagagaggaaacaggaaaagtacataatcgatgtgaataaaactatgaaatcatattgtagcagacggaatgatgatcaccaaacattccaagtctcttacagttgtcattgggctatgaacagaagtttagttaatctcttccaagccaaaacagacaaaaattggtgtgtggacctccaaatgactttccagccatgaagatgagtaaaattccaattggtaaaatctcctagcctggtgtctgggtgaccgtgtgtgg

SEQ ID NO: 79571 - DNA, 1942 bp, Homo sapiens
ttctaagttcagttttcactttatttactttatgggcctataaacttcaaagatttactgctgatattattgaataatgaacttttgctggcagtaaagtaccaaagatagatcctgaaggtttgtgggagaaagcttagacagtaaggtattagtgtatttctttgcttcaaagacacatatactacattttaactgctcagaaattgggatctgtgttacagtcagtggcattttgtaatcacagtggctgcactgaagctgagttttgctagagaagatttatgtttgtttctgccaaactctcagggacattactgacctgagaacactttaaataatctgatgtagtttggaccaccctggtgcgtgtgaatttagtctgcaaacttatgtgaatactacctgtgatttctttctgttgagtggatttattcgtcattgaccttttcattaggactgttgagtacctatagtgccccctaacagatatctcctatttgactccccatcttgagtattttcttctttataaagtaatggtctgtcttacaattgatgtcatcttagattcagcaaaagacagtaaatataattatttaaattcacagaagcacagatcagatttctaaaggccaaactccatgttatgcaggaggaattggataatgttgtatgtgaatgcaataaaaaggtaagttttaaaaacctcttaaaaggctctaatattcaaagatattttaggagcaatttcaattacattttttgaattactttatttagatataaatcatagttaaattttgaattcaaaaattgtatataagtactgaactttattctgagatgttgaattttcacagagctgaaatatcttaaattcttgctacaattagaattctctatattagtcttacaaatgtagtgtaagctattaaatgcaaataaaacatttgacttccatttttgaagataaaaatagactaatttgtttttcatgaaacgtgtataaatatcaaagaacatatgaaacgtctttttttctgctttgttttgataacaaatcttacatattttttcacataatctataactttataactataggaggatgaaattcagaatttaaagtctcaagtaaaaaattttgaagaagattttatgagacagcagcgaacaattaatatgcaacagtctcaagtagaaaaatacaaaactcttttcgaagaagcaaacaaaaagtatgatggattacagcaacagttgtcttcagtagaaagggtaattatttggtatttttcctaacttaatgccacagatacaagaaaattattaaggttacacatttgtatagatgccattttgacagttcagttattttattagtatttactgaaaactctttccccttacatagaatatttttaacaactttattgagatgtaattcacccttttaaagtatgcaattcaatggcttttggtgtattcatagaattgtgcaactatcaccacaaccattttcataatccctaaaagatacttcataccctttagccaccacaccctgaccctgctcccctcaatcccttacagccctaggcaaccactattctattttatgtctcaataaatttgtctattctggaaatcacatatacgtggaatcatataatatgtggtcttttgtgactgacttttacttaagatattttcaaggttcattcatgttgcagcccctatcagtattttatttctttttattggcaagtaacattctgttatatggatataacacatttaatttatctgtttatcagttcgtagctttaggttatttgggttgtttctactgtctgacaattttaaatactttgaatattcatgtacaagtttttgtgtgcacgtatgtttctatttctcttggttatatagccaggaa

SEQ ID NO: 79572 - DNA, 1050 bp, Homo sapiens
tgaatatattctgaaaagatttactttgtcaggtatacagaaaaacagtggagagtttctcttaacattggtctttttgggaggttcccaagagaagaaatacagttataatgagttgtttataaaatagaggacaggtatactgtgtcttgagtcaataaagagagagaaaattccaaacgaaaagtaatttgaaagcccggttcacaactacattttttaggatatatttctctaataccaatttgaggcaagaattccttgagacctctaacacttagtgttcagcctctacccccaagcgtgtgtgtgtgtgtgtgtgtaaagtttgagagaaagcaaggaatatggatatggaagatactgcaaaatgataaagggggaaactatgatatatttataaatgttccataatcttttttactatacaggaattagaaaataaaagaagactgcaaaaacaggctgcaagtagtcaaagtgccacagaggttcgcttgaatagagctctagaagaagcagaaaagtataaactggagttaagtaaattaaggcaaaataacaaggtatggaaaaattgaatagcttttgtagtgatcccttttggtaactacttcttttatgaacatgtcaaaaataatacttaaattataattcttgatgtcatgctgaacatttctcttttcagaagaaatatattcattagcagtatacacatttctaacatgttaggatgatatgcttgtctgtcgccattattgggtgatggcacaactctttggaagattgatttcttcaaccagttttatcaggtgcccatattatatgtcagacacttttctaagctcttagaaaaagttgtttaaaaaaagtatcttttgtatctcaagtcttttattcttctctgaacctcagttttctaatagataaagtaaggctctattttacagggcagtggttctcaaacttgagcatgtatcagaatctctgggagggcttgttaaatcacattgctgggtcccatccccagaatttctgatttaataggtc

SEQ ID NO: 79573 - DNA, 1044 bp, Homo sapiens
agaagaagctagttgaatgtggatctcaaccagtatttctgctctttcaaggatcatatcgcttccagtttctacttattattgattactcatctacaccttcaaatatactttttaaacgtttttaaaatgttttcaaatatattatttttgaaaattcataaatccagagtttatgttggttcaatacaagctactttgccattactggaattagaactgagttattttaaaaacattttttaaaaatgggaaatacctgagcatgactaaaagctatcaaattccagtaattcggtaatggaaagcaatttttatctacaaaaattttatatttcagtttaagaaagtactttttattactgttgtgatgatagtctataattctttccattgaggctgtatattaaaaatatatggcacttttttttccttgtgtaggacatagcaaatgaagaacacaaaaaaattgaagtgttaaaatcagaaaacaagaagctagaaaaacaaaaaggagaattaatgatagggttcaagaaacagttaaaattaattgatgttttaaaaaggcaaaaggtgagtctatcattaaagttaaatcatcatattatttgtaactttcttactaaaaaatttagcatttttcactttaggtatgtttttgacatctttacgcactgaacttcatataaaatgcatcatacatatgaaatcatatgaaatctaacatttatagtgagatatatgtgtcatctaagcaagtggatattttcacataagtaagttagtgtagaaaatgggactggaaaatacagtataggtacttctcaactacagaaagtaccaaattaaagaatgactattaggggactgtttgcctcttcaaaccttagagcgaacatcacttccaaaccactattgctgctttctctaaaaattcatagttctgacactttccttctttgcaaaggtcaggtatttaaaatattatagaattattattatcttaaaagtaagttggttcagtactactgttggacaata

SEQ ID NO: 79574 - DNA, 1027 bp, Homo sapiens
aattctcctcccttacagtagaccaaaaaagatgctttaaaagaaaattccaaatatttatttccctggctaaatcaagtaagtaaagttcgtaaacacagacagaaggcagttcactttggggtagagttctgtattagtcaaggtaaatatactgtcttgaggatggggatgcaaacagtgctctgtagtgttgtagaaatcggattttgaaattatcagtacaaaaataacagcttgattaaaattaatttgtatctgataattgtttacaagttatgaaattcagtgatgatttacaaaatccaaacagacaatggatacctaatgccactgaactgtaaaacaaaagttatgctgacatctagtggtaacatgcaaaaaatctatgctttacccaattttgatgatatcatttctcttcacaaatttcactcctttgttgatatactttcctgaactcttcaccaagcagatcaatatcatcctcttttttaaatactccctacgagaaaaatactttgtgggttacttttgaataccagaatatttcactaaatgcttttaagactgacagacataagattagtaaagttatctccaaggtaatgaaatctattcaacagattaatgaaactttaaaaaaatcaatacttttcaaaaaataagactttacatatatattgaatattcctagactgacccaattttctgatttatcagctctagtgtaggagcttttcataggaatctgagctcttctacaagttctactgcttggattacctagataggaaggcacttcatctatactgtaccctacccttttctttaaatagctctataatatgatataatggtgagcttcagtagattcatgcatgggattagttcttcatgcctcagttctatggctaatcagcaaacagtcaatcttgcagaaaagaatccaggtttggagttaagccatttaagcaaaccctttggaattcttcactgttctatttttcttttcccctacagtata

SEQ ID NO: 79575 - DNA, 1049 bp, Homo sapiens
tattagaagactagagatgggtaagtgcagctttgattttgaggaggaggttggaaactgaaaaatacttatgggtggtttggacagcttttgtaagcaagattctagaatgattcatagttaccatagactttagatgaataaactcaggtgtgcaaaaaaggcttttgtaacagctctttccaaagcagttacgtgttaattctgagtagagaaacaagatggtaaatataaattaaaatttgttcatgagtaacagaaaacaatccaaatgtaagcatattctttatccagctagttttaaagggatggacaaagttatcatgaaaagccttactttttcagtttgtatgatttcatattgtaatactaaatttaaccaaactctatcactctttccttataaatctggtgtaaggaaatagttactaaattaactttcagctgtattgtttaggaagaagcagaaaagaaattgagaaagcaaaaagagatgaagcaagattttgaagaacaaatggccttgaaggaattagtgctacaggctgcaaaagaggaagaggagaactttagaaaaactatgctagctaaatttgctgaggatgatcgaatagaattaatgaatgctcagaaacaaagaatgaagcagctggaacacaggagggctgtggaaaaacttattgaagagcgtcgccaacaattccttgcagacaaagtaagaaaaagttgtggggtttttttggtcattatcattaaacagcaatagctcatctatcatccactaaacatttactgagaagctttatatgccagacaatgttagtatgtttactaatatatatataaattttctgaccatttttgcttctagaaaatatttattgatgctttctatgtgctaaacactggttggtattgagaacataaaaggtaaataaaactaagtccatgtcacttatgaatttatggtcttggttaagaaaaatatataaaaagtaattataaatatgtcatgtacatgtgataataggttatagagctatggatgt

SEQ ID NO: 79576 - DNA, 2747 bp, Homo sapiens
tatactttttcaggcatgtgttttttttttaaattgggctattaaaaattagaaaaatatgtttgaatgcttatctgattttatgtatggaaagacattctaaacataagaagctatttaaatcataaaggagactgggcatggtggctcatacctgtaatcccagccctttgggagccaaggcaagaggattgcttgagcccaggagaccagcctgggcaacatggcaaaaccttgtctctatgaaatataaaaaaaatagctgggcttggtggtgtgcacctatattcctagctacttgggaggctgaggtgggaggatcacttgagcccaggaggtcaaagctgcagtgagatatttgcaccactgtgttcctgtctgggtgacagagcaagaccctgtctcaaaaaaaaaaaaaaaaaaatcataaaaaaatatagatttttttccaaatatatttttttattttaggtacttttacaagttaataaaaatacttaaatttaaactagaaacaggcaagagatatgaacagatgaaaataatgacagccaggactaaaactagttgatagatatcttttagtatgtgattccagagtttctcagaatcttgcctaagaaaatggcctcctcctaaattttactgccatagcgaggattgggaacttggactgttttcctttttggtgggcaaatgtaccttgactttttattttttagaacacgtctttattttgacagtgttcaaaaacattgctttatgaagaaatacataataaatgactttatttttcagtaaacaagataaagctgcttcttcaaaagaaaaaaatggatgtaatgcaaattcatttgaaggctcatcaacaacaaaaagtgaagaaagcataacagtttcagataaggaaaatgaaacctgtcttgcagaccaggaaactggctcaaaaaacatcgtcagttgtgattcaaatattggtgcagataaagtggaaaagaaaaaacaaatacaacacgtttgtcaggaaatggagttgaagatgtgccaaagttcagaaaacataatcttatctgatcagattaaagatcacaactccagtgaagccagattttcttcaaagaatattaaggatttgcgattagcatcagataatgtaagcattgatcagtttttgagaaaaagacatgaacctgaatctgttagttctgatgttagcgagcaaggcagtattcatttggaacctctgactccatccgaggtacttgagtatgaagccacagagattcttcagaaaggtagtggtgatccttcagccaagactgatgaagtagtgtctgatcaaacagatgacattcctggaggaaataaccctagcacaacagaggcaacagtagacctggaagacgaaaaagaaagaagttgaaattagtcattttaagtttcagtgtaccaacgataagggcatttggaacagtgctatcaggtgagctcagtggtgctgttgtaggttcagaaatggaaatatgtaagggaggtcacacatacactttacctgtatgttcaacctatgttatcaaacaaatcaattcaccaataatagcatgattagtagggattcccaaaaagtttttaaaaacacgaacaggattttaatgataattaaatttgcagtggaaaggtctcatttaatggttttcaaggaaatgggatttggttgctgacatgaattgatgatattagtaatatttataaagcctttcaaacttccatcaatcctaagctaaaaatctttattacctgtatatccttttcagttaactgagaggaagggatttggaaaccatgtacttttggggagtaattgattaaaaacaatggctgattggcattgttaatgaaggctttatttgtgaggatgatgctggtaaatggagcatgcttagagtactaaattgatctaatgagaatttggatgaacataaacttaattttggatttaatataacattccagtcagacgcatgtaaacagaatatttgaatctttgtacctccatacaagtgttagcctgccaggctgtaagcttaccttaattaaactttcagtgaaagtggaattattaagatataaatttatatttgtgctttttgtcagtgtgtaagctgtgtagaaattctttgatgtattagttgtattaatgtaaagtagaaacccattgttgaaactcctgtagctattatgcttttaatattgttttaatgatcttccttagaaataggcccataaaaatggtctggaagccaaaccaaagtatggtataatgtagatattgtaaagcagtaaactgaaaacatgtcctggcatgtattcagccatgtttaagtgacttttctgtaattgtaaaataaaaacttcaaatgggacctaaaacagtgatgtaaaagaactggttttggaaatttagcctaatttatctataagatggctgctaaattgatttttcagttctttttatcatctagaatataatagatatagaaatgaataatatgaagaacagtagtttgctttgaaatactaataaacttttatttaaaatgcttcatttttacttcttaaaatgtgctttggattcttaaattttgtttcactgaatgttcaatgttttaaatggcgattaaaatactctgctgtatatagtagtttttgagtaaatatttgcaataaaaatctgcccccgaataatt

SEQ ID NO: 79577 - DNA, 1058 bp, Homo sapiens
gtcgggcatggtggtgggtacctgtaatcccagctactcagggggctgagacaggagaatcgcttgaacctgagaggtggaggttgtagtgagctgagatcataccactgcactccatcctaggtgacagagctagactctgtcaaaaaaaaaaaaaaaaaataggaaggaaggaagttaagttttagcctctttggtaagggaagggataggtgcctgttgtgtaagttgcggggaaggagcatttagatttcccagcaatgctttgtttttactttttatgtactaaatagtagactgaccacctgcaaataccaggtgtttttggttctctgggcaaattgatctcttttccttgcactcctccactgcagacattcattgtaacttcctccatactgctaaatcagtaaccactcttccaatgactttcctgtttctaaacatttggtgaaatctgtttagcaattagtatactttggtgttttcttcatctttatgagtaaaaatattttatttctttgcccttgttttagcagagttttgagacggtgagtagataagtgtgtgtgattaatacaccattatcaattttacaggcttgagtcgatctaccatagtggttaagaggtagatatagatttgaatctttactacttattgtggtattgccttgggttcccactcaagtcttatttctcatatattgaaatagtgtttataaaatctaatatgtagattaaatgagatagtgcatgtaaagttcttaatatactgcttcatgcatcatatgtactccatagctggtaattgttacaagctgttaggttggcctatggcttactgaggttttacacttttcttgcttccctgtaaaacatttgaaataagtagaatgtttcttactttgtgtactgtttcatgtttttggtttgacagtggaagggttaccatgactcaatatgaaatcataaattcagaaatgttttatctaaatacctgtgcctaatatatttatataaaatactgtggatgcatcttgttattcaaattcaagt

SEQ ID NO: 79578 - DNA, 3413 bp, Homo sapiens
tggtgggtcattagctcagaactttgagcttagcaaatttctgtcttctaccaaagtaattgaatgtctaaaataatgactatttcagcaggtatctttagtaaataagaattataggtaagaaaatttttcttttctaaaagtgttaatgatgtgttagtagtattaatcttaaagtatacttttgtagttcaaagtttgagtgtacattttagtgatgcattttataatttaaaatttattgtgtgcttttctaaatatttttaagatttatttttctaaatgtgttcactagttattacgattctgttccttaaagagagtactaatatggtaaaaggcacaaaacaagattgaaatcataggcctcttaatgcaagttatttcaataacttactttgttctcacctaccagtttcttgccagtacaataaagagtgataaaaacctctgtcaccaacctccatcacagagatagcaagaggactgtgtttcctctgttgaaatgccagcaataatgaacatacttaacggggctcattttaatagctgcatacaattaatttattataataggcatatgctaaaatgattagcatggtgatatttcttttataagaatataataggtcttactttgataacatttactacgataagttgagggagaaaaatctttcatgaaatatttaaattgttctgtgaccaatttgtttttcaaactgaatttaaaatgactaaatgcttagaaataaaaatgagttgtaatatacacatttatttcaaaacttcattaatttgctttttcatgctttttgcttttttagactaatgtttcatgttttcttagtacttcataactaattttattcttaaaacttattttcctttatactgcattaaagcagtgaagttatactgtatacttgatgtgatctcatctttataagtattgtgcacaattaaatacttgagacaattacaaaatctttaacccccaaaatgattgacatttgtgtcttttgtcaattttttctgcaagttttattcattttaattggcttaacaagttggttgtaaattattgtagtgcactgccaatatagtggttttacaaaggacataatctatattaagtagcagttttgcctaatagctaaaatacagataagtaatttcatacagttaattattaatgtttaacaaagtataaacatttatagccctaatttttcaaatatgccctcaaaggatggatgaagaaggagggttttgccaactctgtttcattgattagccatgagagtagcttttaggatggttgacgtttctatcctattagatatctttttttttgtcaatgaaatttaagataatatagttgctgcttatgttaaatatgttattccttaggtatagctattaagccttcataaaattatgtatcacttaactcttgattaatgacatttcagatcaggtaggtaccctacttacacagattaaaattgagtttaatgtataatatcacaaataatatttagtcatttctgcagcttctaaaacaaagatcctttggataagctagttcttagattaaattgattattttacaagattttctggatggcatatacctttgttaatgttttaataagttataattaatatttttagaaatcaagaagttttaatatttgagcagtgcttatggaggttttaaagagaatatattcctcaaaattctaattacttctgtgattttactgcctccagagtaagttaactataatattgttatatttagttgaatttcacaatagataaaatatttatcttttttcacttaagtcctgtaatcgtaaatactgatgcatattacttatgtaagcatataacctgcttttaatttttaaagagtaattcttgttttgaaactgttttactaatgtgtatgtcttttattttaaattgtacttagcaaagagaacatttcttaagtgtccttgtttttagagaacaaggaaataaatgtctttattgatttagcacatttatcgaatctactatttagtctcatacgtttaacttttaccttaaaacatttacagaggtcaatttactattaaagtataaaatgtacattagtttcgatctacattttaattattttaggctggcagagaaagaactgtttcatattttaccatcgtacatataaaataaaatattcaatacttatcttgttttcaagattaaaaaaagaagctcccgcaaaggaacaagaacctgtgtctaaggtaaagtttgttttactttataccttaaaggtttatacatttgaaagtattattggtatgatataaaattttttttcaatttcagcatgcatacatcaacaatatttgggatgttgtgaggaagaaaaaaaatcgagatttaaaatttttcattacatataaaaatatctagccctaagtaaaattttaaggtattcttgttttgacaaagacatcttatatttcacttgcctgttatttagttcaactagtgagtaatggagataaatttatgaattaaaaatccccaaatcagtaaaacctcaatcatttggcacactggaaaaattaatctttccaggtttaattttctgggatattttaactgtcaaaaggttaaactaatttttaaaatagaaatattttggatgtatcttaaatatgttttaaacaagtactctgaatgcagaactcagaattatcatataaatgttatttaccggacagtctaatagatgactgtagaaatagttttgctcaactacttgctttcttgatgtcaatttatgttgatattacttaatgattgtttgcctctttttgagtgtaatgaagtgaggtagatttgacatttatcttttgaatactttgtcttgaatggcgcataatataagtgaaatccaggcagaagtatcagccttcttccaagcagctttcttttgtaccatagaaagttttcttttgtttaaaagtttttcaactacaaatttctttaacagatgcaggtttttaaattttttaatctatttcttcttgagggagttttggtagtttgtagtttttttgaggaatgggttcattttacctaatatgttgaactcgaatcttatgtatattgagaaagttgcttatagtatcccttattgtctttgtaatctttggaatctgcagtgatatcccctctcattcatgatattgacagtttgtgtgctttttctattcttattatatattttaattttaaacatgttgtaaatacacagaatgcagtattacagtttttactttagacagtttttttagggcaattaaaaactttaaaattagctttatatttacctttatttttaccat

SEQ ID NO: 79579 - DNA, 3782 bp, Homo sapiens
attttttacagggactatagtcaactgatttcataatcaattaaaccactaatatcatgtatatattgcattatgggattttttttgtgaaatgctgtatcagaagagaatctggacctattctcaaggtgaaatagcactttattctgctattctcaaaccagtaagtcattaattatctttcataaatgtaagcagtaagtaaactcttaggaacagaatggcagcctttttctataaatcttatattttaaaatattatttctgttaagagatacttactgtcattgaacctgtgaccattgaagatatataagggttcattccattattttcctgtgaaattttgaacttacttggaggaattattggctctggtcataatcctaaattataactctgtagctcttatgtgttcaaaattgttgggagacttcatttcattaatttagcaagattaaaaaaaaaaaacaaactgatctattgagttcattttgggcttgtttccttctttaaacttttgaaatgtgaccgggattttagcccctagattctctcatcctaccatagacattaatatctcaaaccgatctttaggaactgtaaaatagttcttccttttcaaaatagacttaatatatttgctcctggtatgtaattgcaagtggtttctggcaatttggacttctgcctttgatatctggtaagcagggagaatttgagacccagtgagatggaaaaataaatgaaactttagtgtagtctttcatttaggacaaactgtaccaatctctaccagtgattctgaggttactaccatttttttcagtctctggttcctgagggttgttgcttatagattataaattaaatatccagggtataattcaatattaccaacaaaccaaaataataaaatagagtcctagactgtcattaaaatcttctgcctacattgatggtcttattttttttcttcacgtttttacacatgaatattttggtcttttttatttcttgtctctctgtctttacctagttctttcttctgtctatctaaaatgattattctgctctttgttataatagctttagatggccaaatcataccctggtgttctaagattagcagatcatttcatactagaaaaaatagaactggtcctaaggagaatagaccagcaatcaaaattaatgtctgttgggttgagggtgaggtggaaacatggtatactaaatttgttgtatactctcaagcagattctgagcaagaagattgattctatactctacccatacccatgacaataataactaacatttactgagcacatacagtgtggcagacacttttctaagtgttttgcatttatttactcatttaattctcacatatttgtgagatatgagctgttactgtctgattttatggatgagacaactgagatacagatatgttaaataatttgcccaaggtcgcacatacctgttaagtggagagcctcaatttaaattctgtcagtctgtcttcagagactaaactactcagtagtatcctctattgcttctctgcttctgcttgtagttccaggtgtacatcctgccttgtttgtgattggccaagaaactggataggactaagcttcagtgttaaggccctctttctgcagaagggtaggcagcaactgacacaatcatacgattgggacagtaatctagcataccagtttactgtcccaatcctatgttctattgctcaaacttcatagaaatactgccctaatgatgtttgggcaatataacatttgagcaaagaatggtataaactggtcttttagtaggattaatttagcagtgatactcagcatgttttagagtggaaaacatatagaggcagagagatcagttaaggttttcagtttccctggcatgatcataagggagcctggttcacaggagaggaattggcttgaggcagtgcagtggaaatttgaagtagaacccacacatttaatcctccttctattgcttaatggctttataactttagcatttttaggcctcagattttctcatctgcaagatgggggtagttgaataatataatctcttaggacccaagtctaatacactgtgatgtttctgaactgaattgtcaactgtttgaaaaataacaaagtgtattaaaaatggaggagtcattctctggatgttgattttgaagttatatgaagagaagtgatggttggtggccaggtgtggtagctcacacctgtaaccccagcactttgggaggccaagacaggtgggtcacttgggctcaagagttcgagaccagcctgcgcaacatggtgaaaccccatctctacaaaaaagtataaaaattagccaagtgttgtggtgtgactgtaatcccagttactcaggagatggtgatgagaggatcactggagcctgggatgtggaggttacagtgagccgtgatcataccactgcactccagcttgggcaacagagtgagaccttgtttaaaaaataaataaataaatagaagttgtggttggaattgtgtataaggatgagatacacaagaggcaggtctgagtggtaaatatttccatatgaatgttctgtaagcaccacaaatccaatatgtccaaaactgaatttatttttccctcaaagaatgctttctcccttcttcgaattccatatcatgaataatctcttaccagccagggcaggcatttgagggggtcatatttgttctccacatttacctttatccagtgtatacttacattcttttggttttaacttgttctcatctccctaaaccaaccttttctccattgacactgttactgttttaattgagaaagtcattaactgtctcttaactggactctcagcttgtcttctaccaatacagacctttgtctttctgatgcacaaatttggtcatactttcctattagcattaaagttcttagcatgaacactttagcatggcaatcaagaccttccctgaagaggctcttgtatgttttcagtttcatcttggactactttgctttgtgcctgacatttcagtgatatgagaccaccaattctcatattgtcatcttgtttcatacttctttgctttttcatactttctctgtttcatacttctttgctttttctctgccttggatctccttactctgctttgctaattcttgctctttttgcaaaaccaagttcactgtagtatcttcattgcttccttgcctctttccctttcatagtggcttaggtctctgaacaaagatgtcttttctaaaccttttcataatgtaaacatttgcttcattgtgttttcttcacagtgaactccttgagaggagagacagtcttttttaactttggactggaacacttagtacaatccctgaaatatgtacaacctggtaaatgttttgctcaggcatcctttccacatataaatatattgataattctcagaacaaatgatcagaaatggtagagtagatgttttactgttatgtcttagtctgatgattactatattaaatttagtccctgaatgtctcagtgaatggtctttttattttattttgctgttttttgtttgtttttttgagacagggtcttgctgttttgctcaagccagagggctggattgcagtgtgcagtcatggctcactgcagcctcaaagtcctgggctcaagcaattctcctgcctcagcctcctgagactgagctgggactcaggtat

SEQ ID NO: 79580 - DNA, 1030 bp, Homo sapiens
gattttgttattcctggtggaggtttggggaggtaggggcgacctgtggggtgggggcaggttctgtaaccaatcccctaccaataccagggaatgactgtactgctttgtggtcttacatagactttttttttatagtatgtatcaaattcattttcttaaagtatgaattcttaaagttctttcccagtaaattcatttttaaaaaaaggttcaaataaaacacttggcagtcagtacaaagtttgcttattgtaagcaattagttgaattttcagtttagtgctaatgagttttagtttgagtctaatccctccttaccatcattttattctagtttattcatctggtcagatagccatttcatgcatatgtgctttttggttactgttgaataaaatatgtgattggttcagtttgagtccatcatcattcttagaaaaataattattaaactacagaggctcagattcttgccctgtttttgtcacattttggcaaaacactttgcctctttgggcatcatgtatttattcagcgaatatttattgagcatctactttgtgcctggcattgtcctagtttctagaaatatagactaatctctgctcttatggaacttacattatatttgtgaaagacaataaaagtaaataaaacatataatatgttagatgatgatcaatactatggagaaatatgaatcagagaagggtgataaaggagtatggggtaggtgttggaaggctgccatttttaatttagtgaggcctcactgagagatgacatttgagtgaagacatgaaacaggcaaagtcaaactcagtcatgaaattgttcttttctgtttctcccttacctccatttctcccctcctctgttttcttgtatatctacctggatggatgaattataacaaaatagaagtaaaggtttgagttttgtaagtttctttttcttgacaaaaagttgagaatagaatgataatttcctctaacagatcttgagagtgtaagaatctgtggtaaat

SEQ ID NO: 79581 - DNA, 1846 bp, Homo sapiens
cgcctgtaatcccagcactgggaggccgaggtggggctgatcacaaggtcaggagttcgagaccagcctgaccaacatggtgaaaccccgtctctagtaaaaatacaaaaattagccaggtgtggtagcatgagcctgtagtcccagctactcaggggcctgaggcaggagaatcgcttgaacccaggaggtggaggttgcagtgagctgagatcacgccactgcactcccgcctgggtgacagagtgagactccctagttcacagtgctgagatgatgaggaactcaagtttgcagattttagtattttattaactactttagctagttcagtgttaagtaagaataataccaaccttgatggttgtagtgagaatcagatgaaataataaatgggaaaactcttgacacataatgtacaatcgatggtggctaaaacgtgatctgtttttaaagccttcccatttttcttctgattttatctccaactgaataaaacaccagattctaagtaagctccattcgagcatagacagtactatttcttgttcaccattatattcacaatacctagtagtacagtatatataaaaatagctccagtaaatatcaagtgaatgaatacgctatgttcactttgcagatgcgtgggaggacaaatagaatgtgacttgcctaagttacacaagttggttgtggagccaagactgactctaggtcttctgactcctaacttttaacaattggtatgacaggtaaaagtgtaaaataaatactttctgtaaataaatggtagcataatttggacatggctatgtcatttaccagagaataatgtcagtttatgtcaaatttatataacaaaaatgggaagttatagttatgtatggcacaaaaagcaaattatggaaaaataatcatcaaacttataagtggattttcataaaagataaaaatctttttttaatgcttttttttttaggggcattactctagtgtgccttaattgtgatttcctaagtgatgtttctggcttagataatatggctacacacttaagtcaacataaaactcatacttgccaagttgtaatgcagaaaggtacgtatatgtaactgtgctactttagatttttgacttttattccagtatttttggtcatccacaatatggtctctttactaaatcattattctcactcatcatatttcatatgctgttgtaaatgtaaaacttttcttctaatttcagtttctgtttgtatcccaacttctgagcacctttctgagtaagtttaatttttattcagtgcattttactttgatggattttagcactattgcatttttaaatgtatcattaatacgaatgaaaagtattaaagtatgttgttgtttttttgttttttttttaaagctgcttgttgaaataggttcctgctctatggagctcgtgacctggtgcaagacaagttggaatttcctaagttcaaagttctgagatgttttcttacacaaaggcagttgagcagccaagttcatgacactagctctcattattcagctcttttcagctttcaaatgggactagattcttattccaccttatctttgtgtcaggttgacatatcttaacatatttttttttctccagtttgcgctgtctaaaaataacatttgttgctatggtcttttctttgcttacaataatttttgtttttctctgctgtacttgccttcagaataatagattccaaattatatggctgtttgtcttttgtctgtttgtctgctttcttaatttcttatacgtcttaagttttaggccagataattgtctttttctc

SEQ ID NO: 79582 - DNA, 1047 bp, Homo sapiens
agacaccattccaccatgatgccacttttggaattctttttcattaattcattcaacttagattatttgagtacttactatttacactatgttaggaaaagccttcagagtctgcattattttcatttttagatctcattaggggaatactttattccttcagaatgggtttgtattttttttaagtaggcaaaagttgtttagatataaacctgagagtttgctttttcaaagtaagtttgttcagtttttgtttaaaattagaattaatgtattataagtgactttcttgcagattacacatgacttctctgttacttgctggtcattatcaactactgctttcaaggattcttctaccttttttggtggcttcagcacttctctcggttttcccatgtcttcatggttggcctgacctcatggtatcttgcttctttagtgccagcatttcacatcaacttttaagttcatatattgtctttttttttcttgaaactacagtactatttaaatctcttcctataaactgttcattccttttggatttccattaccccatgatgttcagagctttgactcctttttccagcctagtagcacccatcttaattttgtagtcaaccttactctcaggatcatctgttttgattgtggctttttgtcctagaatcctttacatctttagtcatgctcactggcataaaggccaaggtaagatttgaacctcttctcttttgaacttcctctgtgctcacttctagactatcaaatggtccttgatttagtcaactctgatttcaaaaactttaattctgattaggtcttatttttttaaaaaagatctctttatttttacctgcaacatttgtttaatccttcttcagtaccctaaagattttattttagtttctcagttgttaacttggcctattaattagtcaattgtaggtcatcctttttatttttcctaaaattaactcttttcaaccccacgtatttttcctgttaccttcaatcagacattaatcttaaaaatctaacatg

SEQ ID NO: 79583 - DNA, 3276 bp, Homo sapiens
tattggacagcattggtttatgtaaccacttctataaaataaccttctttgaaatgtctggttagatttatttggttttagagagtttaatttattttaccaacttttcaaccaactagaaatagcaaaaattagaaataatttcctttttctaggataaaaacgtagtacatctcattttcaaagtatgtgtttacttcaagtttataatcgaaagagatttctcaccacaattaatagaagttttattagaacctattgatagaactttcatgtacagttcttacatagtagcgaacacttttgaaacccaaatactaatgtaatgacttttaaaaaatgaggcattttatattattatgataggagatgttaaaccgcaagtttttacattatttaggtatcattaaaattaagtcagcagtttcaggacacaggatttgtagtttttgaaattatttttccccctttttctgtttttttctaaacagaaaaaaggaatacatcgttgtacaaaatgcaggctgcagtttttgacatgcaaggagaaaatggatcataagactcaacaccatcgaacatttataaaacctaaacaactagaaggattgcctcctggaacaaaagtgagttaaaatatattgtattttaacattttgtatgataatagaaattaactcctgcccggctttatatattgaatgtatttttaaatgacttcagatttttgctcagactctaattttaggttttaattttatgtgtagaaggaaaaacttctaaccattgttttgagttcagtgatagctgttaggttagagtagtagtcctttttaaaaagtacaactcaattaacttttcctgggtcaatgggttgtttcaatattttataggctatttttgagctttcagttgaaagtgtatatgttgactttagttgctaaactataagatgcttgagatcaggaatcatgttttatttatctttgtgtccccagcatctggtacagtgccttgagttccataagttctcagatgtttgttgcagttgttattactgagtttactctgagaagcaagttctactgctggatagcattgtgttttaagtgagcaaacacatgtctgactgcatactgatgattgtaatttacttttccctttttgccttatgtacatctgttttctctgacttctttatatacagtcagctcttgaatatttgctccagtggagggaaacagaggcatggataatccaaagtgaataatccccaaaacatttatttttggctttgggtactttcctttgaatgtgggtatgtctgttatttgaattaactaaaacaatataaagccatgctctgaagacatgatagcaagagaagctatccagcatccttccctgcaatccattcattccatgttgggactagacatgcagaacactaatgtaagcagtgcagtcctctctcattttttcccttattaataataataatattaatgataatgatactaaatgtttttatagcaccttagaattagactttcagtgtactttttcatacattctgttgtctaattcataccacaatccactgaggttaataaggcaggtattgccccatgttatagatgtgaagaagcatagagaggataagttccttgttcaaggtcacatggctaggaaggccttttgattcctggtccagtgccattgtatgttacccaagcacatgtatgtcataggacttccttattgactgttcctcaaataccggaggagggtatagtcaaatgattaaccagaatgttggtaggcacttgtgtttttcattgtcaaccaacagatgaaattaaacattttctcattctgaatactaaatgatgaactttgtattagtttactttaagaaatttctgaatattatttagccctctatgcagtataataaattgatgtaactcctcccataacatttgtaagcataaatcttgggcactgagcccctggaaagaggagatcacatttactgtagatctgtttcttttatagttgttaaagggtaatttaggcctttctagaattatttttcaggcttgagatttaaattttgagctctatgcttgtgaatttcttaaagttaagtcagggcataaaaatagctatggaatgtgctctttgtatattcatataatttgtattaactcctaattattcactgataactgtgttaacatataactgatatcaatacaaaaatgtaatattacaacttaatatcaagtttaatatcatttaatagtttgaacatttagaataaatgggagacttacctgattgtagtttatatgtgcttttttcaaaattcttgatttttaactatttttgtaccatgatattttaatattaatgtactgattaatctcttaaagcaaatcttctctttatttttgtaggttactattcgagcttcagttggacctctgcaatcaggagcttcacctacaccttccattagtgcaagtgcttctacccttcagctctcacctccaaggactaaaaatataactgctaaaaatcctgcaaaatctaatacaagtaaacctaatacagtcaaatccaacgcaagtaaacctaatacaagtaagcctaatggaagtaaatctaaatacaaaccaaaaatctctaatatgcaaaagaaacaaagcacattggctagtagcaataaaaaaagtaaagtcaatacagcattgaggaatttaaggtaatcttttattcctgatatacaatataatttaaacttaagtataaaaacttatactttagttaagagaacattattaaggctcttccttattatttttgttttaaaatatatttttatcatttttttaatgtctccctaaggtatcgtcggggcattcacaaatgcattgagtgttgttccgaaataaaagattttgcaaaccactttcctacgtacgtccactgtagtttttgcagatacaacactagctgtagcaaagcctatgtaaatcatatgatgaggtaagatgaattaaatgtgtaaattgccaattaaaattatagttcagcaagtttctgtttcaaaaacaaagttatcctattagaagccagtttttctcttcaaggagctaaaaggatctaacaataaggaacttttaggatattgcctggtcctatttctcagcatagtaactagaaattatgggactaaaattgtaagaaaaattaagctaatgaaattag

SEQ ID NO: 79584 - DNA, 2250 bp, Homo sapiens
tgcctgtaatcccagctccttgggaagctgaggcaggagaatcacttgaacccaggaaacggaggttgcagtaagccgagattgcgccattgcactccagcctgggtgacagagcaagatactgtctccaaaaaaaaaaaaaaaaagaaagaaaattacagatgttggagcaagatagcttggttttaaatctcagatctgcctcttaatatagctacaagattttagccacgttacttaatacttgaataatgcggataacagaaatacctttcttatagggttgttaataggagttgagttaatgtaggtgaggtaatgtgagtgcttagaactgttctttgcacatagttaacaagctgtttaactcttcacaactgtccctactgctactgttattgttgttgatatagatgtataaaattaatttttatattaatatcttaaatattattatactgtttctctcccacatttagctatttgtaaaatctgtgaattgtcatttgaaacagaacatgttcttttacaacatatgaaggacaatcataaacctggtgaaatgccatatgtctgccaggtacacatacattttattgtttttttaagtgtttggtttgtttgttgttttggttataaaatttaagcctattagaccagcggtcagcaaacttatgcataacttggcataacttatgcattatatgagggataggcagcaagctgggtttggtccacaggcttttgtttgcttatctctgtactggacaaagatgagtcctgttgtatgtagaaaaacaaacatatggacttactgtgctacatagggaagaatgtagtcatacaagggaaatacaaagtgctgttagatacaaagaaccctaccaaatgctttggcaaaagtatttttccaaagaagaagaatttgaaggaagaggaaagcaaggaaaagataaattgccattgccataaacctggaggccattaacaatctaaaggagaatgctgtttcatgtagcagaaaaacattttatagagcaagaggtgctaaagcttgaaacttcaagtcaagacagaaggtgatagataaaaagatctgataaagagaaggagatctagttttgttttgggatgtatcccttaactttgaaagctacgtttaatgtctcaaagatggtcttttggtgttgccttagtgagattcttggttgcaaaggcatcagagctagattagtagtacataatgttctcctgacaaattatccatcattgttcctttgtaattgcatatcagttttaaattttcaagttaaactaagccttctttctttttttaggtttgtaattatagatcatcatcattttctgatgtagaaactcattttagaacatcccatgaaaacactaagaacttgctatgcccgttttgcctcaaagttattaaaattgcaacaccatatatgcatcattatatgaagcatcaggtgagatttaccagttcttatttgtttattatgttgtcttagtgaaaaaactgattatgacttggagaatctttagatttgttctgcaagagaagcagagttgttccaaatgacactattaatttacacttcaagttgaattgcttgtgaaaattccacttcttttccttacttcctttctggtgatggtgtgggtcataaataatgaaaattctgaaagatagctagaaataggaagctgaggattgacagaaaaagaaaaagttgagtggaatatccaaaagattgaatatttcagggtctaaaggtagatatgagaatgattttgaagggagttatcaggacaaagggaataatgagtttgaactgaggaagaaaagactgaggatttataatcttatttttcgttttgctcttcaaactttatttcaactttctaaccccttatcattatgagaagacatgttgtcattgacctggagttgtcttttatagttgtgtgaccatgggaatagtaatgacacttactgatcagtatatgaactctggcagagaactatatttagatcatcacttgttccctggatggcttccaccagttttgctatataattttggaactcaatattagtgcttgtacccctcccttgaattctgatattatgcttattggctcttttcctgaagcaattaaaccatcttttatttgggctaaaaattttgatgcaatactaatcctgttcttgcgtgcttgaaagaacaacag

SEQ ID NO: 79585 - DNA, 1035 bp, Homo sapiens
acctaaatttttagggcactaacaaagcaacagaacatggtctgtgtactgggaggagtaaagataagaatgatagatagatggtgcctgatatttgtcaaactatagtatatggcattaaagtacatatttaatatttgcagaatctttaacccacaaaaataagggataaataaggagttgcagtgaagatctattaataaaactaaaaggtaccagggctgaataaaagatgaccagttgatattgtaccacagctcagctatgcccctccgtagcttgctctatcctcctataaaaccttaaatctaagcttggttctcatctcttaaggtgcttatttgtttttttggataagcaaggatactttgccgttctcaatgactaaatccttcaccctaattcactacaagttgttgtccatttttggttgtcaatggtttattattcagctcttttatagagatatgaaacattgtttaaaaggtactctgtgaacaaagtttatatgtttatttaaaaaatctgatcctatcctacttttctgttaaaaaaatagaaaaacagcaagtaatttatcatctattatgggtatcataatttatagctattttagggtaatctttaatgttcatagactaactttgcaatgttatttgataattttacatttgggacagaagattatccacatttctaattaaggagcctattctatattatataatttttgtatattttaatttttcctcaaccaggctttatgaaattttatatatcacttgataattaaatatatacatcaaggcatataaacatttcctttctatacatcttgacgtggacatgagatgaatgatttttagttaaggaacagattattattaaatatttacatctaaaaaggcaaattgcaagggtaaagctgttagagctatggccatgtcttggttttagggtttctcaaatctttttgaatttttacatgaagataataggtgtttattatttgaatttttagactatgtacatgca

SEQ ID NO: 79586 - DNA, 1622 bp, Homo sapiens
tagtgtgaaaatcattatacttactacttccattatgtgtgaaaatcattatactcactacttccattatgtgtcctttgtttttttattttttttgagacagagtcttgctctgttgcccaggctggagtgcagtggcgcgatctcggctcactgcaagcaccgcctcccaggttcatgccattctcctgcctcagcctcccgagtagctgggactacaggtgcccgtcaccacgccaggctaattttttgtatttttagtagagatggggtttcaccatgtttgccaggctggtctctatctcctgacctcgtgatctgtctgcctcagcctcccaaagtgctgggattacaggcgtgagccaccgtgcctggcctatgtgtcctttcatataaatgaatgaagtgttatcattcaagattagttatttccactttctgcgtagcgatgaatgggtaataccactcaaagccatgagtagaccgctcttacctactcttcagtttgttaggtaggaaagaactaaatttccattagacattttaagttgttaaattgaaaaaagcatcttaagagtatctctaaatttttgaaacaggtaattgttgtttttttacaaactctagtgtactcaatgcacttaagcatctaaagataattcatttgtcagaacttattcatagtatacttttttttttggcttggaatattggtctggctccctttgtgatagctatttatatatttctttatttgaagccatatttagaattttctttcatagagggattatttttttaattatttaaatgtatgtagtccatgataaatatatgtgcaatttctttacacccttgagtttggatcatatcaagttttatcattattgtcatgatatgataattcaattatattacctttaatttagctccaaaatatttttactcagatgtaaataatattctaattttaaaaaatatttttctcactatttaaattattgtaggtatgagtgaaagttcatttttatcaaaacgtccttctacttctgaagtaaataatgttaatccaaagaagcctaaacccagcgaaagtgtttctggagcaaattcctcagctgtattaccttcagttaaatctccttcagtgacttcttcccaggctatgctagcaaaaggtaaatatgaaatgtggtacataaaaagaagttatagtatttatacatacatttttgaagtggctataaattttaaaagtattattagtggttatttaaggttaaaaagtgatgaattttgagtcataaatgttctgaatttattttaggtacaaatacctcatcaaatcagtctaaaaatggaacaccttttccaagagcttgtccaaagtgcaacattcatttcaatcttttggatcctttgaaaaatcacatgaaggtaaaactctttcaaaatttaatttgtaaaaagtttgcacatttctaaaaatactgatgattacagtaattaatggtttgtccagaaataatctcattggtatttccatttaatttaaataaaaatttacattcataatgattatatagattctcaaattccttctaaatcctcaaattttaaaa

SEQ ID NO: 79587 - DNA, 1206 bp, Homo sapiens
tttggaatttttagatttactagcaaatcagtgcggagaatttaccaaaccctctcccagtttttttttaatagtaatacttttattataaacttaaactgtttttccaattttttaatacttgatttgatattcacctctctgggtgtcacttacgtatttagtaacaatctggtttgtgaaataggtaagaaccaaaagaaacagggagaaaaaaatagttgtcttaagtctggtttcataaagcatgtagatttattcatagaaaaagtctaaattcttgaaacttcttgggaataaagagaaataatgactcctattctttctgtataagtgttctacttcagtgagtgggactttagcctgagcagtaagtgggatgatttgatcctctattcttaagatttttgtagtctctattaagttacctaaccactttggttttctcatattgttaaaagggagattttaattttttttgtagaatgcattcattcttcacatctggaaccattcatttggacatgtaactttaattcttgctctacttagggattttttatgtccaaatccaagtgaaatgtgagaatacattataagctttaaaagacttgacaatacagttattctgaatgataattatgaatgatatgtgccacatgttcagtaacatgattaacacactaccatctagggagattatgggggtttggagaaaactggatttgagctaaatcttgaatgagaataggatttttaccagcagagagagagctgttgagggtagggagcaacacaagccaaacacagcagagaaataagttaaagcatcaaaatttaaaacaaatacagagtgattttatttaatcttgagatttcttgttttaaaaattcttaaagcagtctgtttctactgtccagcctcctatataatcagatgcttaattcagaattccagcattcattggtttttcaggtaacttaaacatctcacaagaatgtgaatgtgattatacagaatttttccaatgtacctacagtatatctatcagtaatcgagtattttgaagatggaaaaaaatcatttttatgttatctgaaaaggatgaaagagagaagccaagtagtataatactcttattttgctgtaatgtttgcccttattaaaaagctgacaggttaatctattattatatttttcccctc

SEQ ID NO: 79588 - DNA, 1251 bp, Homo sapiens
caaactaatattagacacagaaaaaatagtacaaacagttcccatataccccttacccagtttccctttattttaacatcttatcacaactgggtaattaacattaacccaactatagactttactggaatttcatcagttttcccattaatgttctttttcctgcccagtatcctattcaggatacttgcagttacttctttttaatttcctcgtattttctagttattcattctttctttgtcttccatgaacttgacacttttaagagtagtggctaattaatttattttgtagtagatattatggtaacatgccaattcattagttaaatgttgctgttgtttttatttgcatttctttggctggtaatttggaaaaaaggtatttcgtatatgttgttcattagtatttgacttctgaattctctcagtttatgtcctttgcccatatttttcctaaagtgatagccttttttcctttaatttttaatcattgttaatccgcttgttatgtattatgacatgtagaatggtccaaaagtcactctgagagcttaccgtccacaatgagtatcttttagaagtattaatggtattggagtatacttgtgtgtgtgtgtgtgtgtgtgtgtgtgtgtgtgtgtgtgtgtgtatgtgtcattatatttaatgtataataatatcggagtgtatgtccctaaattatattgaccatatttttcataattatgtacaccatgtatgtatgctcatatataactttatactgctttatacttgagcccattatcattcatctcatacttttcactcctctcttcttaagatcttccttttagtttggaccaccctttctcctgatggaagggctaaaacttcctttgagtcccgaggcctccaggagcaggacagctggccccaattattcccataaacaacttctgttctaaaccctgtctgcctggcattcttatttgttcactctactgaccggtttgctttcatatttgcctgataagacagaagattcctggcctagcgtggctttctatgggatgatggaaagtgtgtggggcccattttttctctttctgacacatagcttatacatttctccaataaagatgatttcaaaattcacattatgtgatatattcatccttaacactgatgcacaatactgcagattgattccgtttgtttgccctgatatctcagatgtgaggtttttagaagcatagaagctttt

SEQ ID NO: 79589 - DNA, 1041 bp, Homo sapiens
ccagcaattttaggcaaatcctcatgcttccaaactataatttgataagctagaagttacagagtttacatgcatgcaagaatgaggaactttaaattgatcctcaaagtcatggcaggctcagattgacttctggtgtagtggtaaatttgaaacctcttaactaataaaatgctatgatgaactattggttcactttagtctgcaatctctgatagtttttcttttttaactcaaaactaatagtagataatccgatgagattttctgtaatgcaacttcaaggcttttagacgagtgaatgcagtgtagaggttgggcaaggatttgattttgaatcataggaacctgactgtatgtaacagccctgtcatcatgcaaagaaagatatacatttaaattataggttatatataaatatgtttttggaaaatttttatcaagtatgtgatgtttctttgcaagcacaatgttttgactcacctgtagtcagatttgtcatttccttctgaattttggattttgagttacaatgagaaagattgttcttagtctgtaaaacaaaacctagttatcttgtttcttttgtttctttagtaggtaaagatgtatgtgtttaaaatgaactatattcttaaatcagtgattagttatatactccttccataaatctgtttaaatgttttcaattcatgatttctattatcttaatatgtatttcattcaaacaatgtattttaaaataaatataatcttttatagatattttgaacagagttaaccccagctcatattcaaggggactaaagaatggtgcactcagtcgaggtacagtattattatactattttaattttaaagtgaagtattttgacaaaattgattatgtacaaataatttccatatattgtgttactttaaaatacaggtattactgctgcattcaagcctacaagtcaacactacacgaatccaacatcaaatccagtgcctgcctcaccaataaattttcatcctgagtctagatcttcagatagttct

SEQ ID NO: 79590 - DNA, 1053 bp, Homo sapiens
ctctggcctgtgtaccaatagaagctgcagcttctgaccatatccgtcttccagcaactcctttttatattcatgaaagagaatggcgctgtctacagccactgtacttggatgatgtagcatttagtacatttaaatccttaaggcttttgggcagaacaacttggtacctttgtggcttattagctttgaattagagaattgggcttgacattgttataatattaacgtgcagatactgatgacatttgttaaaatgtccactcaaaaatgtatgacagtgcagagaaacaatgtacaaatttcagggagaaagagaaaatagatccttttccatttcatttacttgtttgtttgaagccaggagaatttaccaaagaattttatgtacccagtttaccagcgtgtgtgtgtgtgtgtgtgtgtgtgtgtgtgtgtgtgtgtgtgtgtgtgtttacttaccatggtagtgcttaaaagtgtgattaagagaccaaaattttttgaaagcctagttcttgcttcacttacctctaaacttggattggcacctttattcagttttatcagagagagagtaatttcaccaatcgaattttcaatactgtttcctggggcacattggtcatctctcatggaatgctaagtggagtgccacttggattataaaatgaattaggcatgatggcatcgtcggtgatagtgggacataatattctattggttattgttttatactgaaatattatattgcaaaattcaaactcttattgaaaacatgacagttaagattcaaggtgaatttatactgattgtagatgactcttcatggtattcgggtagaacactgtacattagttttaaaataattccatcaagaaggggattaaccccaacagaatttcttttctacagtgttaaggtgaataatttaaatggttttattgttgttttatttgtaagccataaaatatgttaacatatggaacatgagttaaatgtttatataaaactgcaagaaaggagggcaaaaacttgtgatccatagactac

SEQ ID NO: 79591 - DNA, 1491 bp, Homo sapiens
cttttttttggtagatggactatactataacattagagtgggaaatgatttgtgacattcttcctgtgagaaatatctactttgcctttaattgaataagcctaattagttttccatattctattctagcatctcttccctgctgtgttctgtgcctggcatttttttttttaaagacatactctcaatctgtcacccctggctggaatgcagtggcatgatctcagctcactgcaacctccacctcctagattcaagcgattctcctgactcagcctcccaaggagctgggattacagatgtgggccaccatgcccggctaatttttttctatttttaatagagatggggtttcaccatgttggccaggctggtctcaaactcctgacctcaagcaatctgtctgtctcggcttcccaaagtgctgggattacaagtgtgagccactgctcccatcctgcctggcattcttgaatctggtttagtttatccagtttatctcccacctgttgcctattattcttagtttatctgccttttgtgaatacatttttaaaaagacagtgggtataatcctttttgtagagataatcatattctatgtatacgactaaaactcactttcactgaatttgacttccaaattttctgtctacggtaaataactactgtcattgattatctgtttatctaaattttactatttaatattttagatagtaagctctgtatttctcactgttgttaccacatactgactacaaatatcaattcagaaattgctattaagattattaaagtacaccttaaaattaatgctatgtattacaaaaatgtttttatttttattttcaaaaatgaggtttacttctctccttttgaaaattaggtaattcaaaaatggcagaactgtttatggaatgtgaagaagaggagctggaaccatggcagaagaaagtaaaagaagttgaggatgacgatgatgatgagccaatctttgttggcgagatatcaagttcaaaaccagcaatttcaagtaagcatttacttttagtgaaaccaagctttataaggtattatttctagtagaaaaacttgtgaactgtttaataggtagttgatgttcatgttccactgtaaagaggaacatgattggggacttgaggaaggaggtaagagattaaatatcagatgtcagaaaagagaaatggactgagattagctggtgaccctggaggtcttctgagattagaaatcataatttttaatggagttaagtaattatttatttatttatttattttgagacagggtctcactctgtcgctagtctggagtgcagtgatgcagtcacagctcactgtagcctcaacctccttggctcaagcgatcctcccacctcagcttcccaagtagctggcactacaggcatgtgttaccatgcctggctaatttttgtattttttgtagagacagggtctcaccatgctg

SEQ ID NO: 79592 - DNA, 1904 bp, Homo sapiens
tgcctgtaatcccagcactttgggaggccaaggcaggattgcttgagcctaggagtttgagactagcctgggcaacataagaagaccttgtctctacaaaaaataaaaaattagccgggtgtagtggcatgtgcctgtggtcccaggtacttgggaggctgaggtgggaggatcgcttcaggtctgggttgcagtgagctgcaattgtgtcactgcactccagcctgggtgacagagtgagaccctgtctcttaaaaaaaaaaaaatgtattaagtaaaattttagcacacacttgtaaaggatgaaagactgtcacattttctttgagcagaacagcatggtccatattcttaatgtaaaaatattgtgtgatgaagttcttcccactggatgagaatgccgtatttcctttttgtttttagaaatacgttattctctcattgattaagtttgagggaatttatctaaagtaactcatccaaggactcagtctgagatttcccttataaagtcattttcactaccatcattaagagtctaaagtgctgctgtctatctttgtgttaatcttctggttcgtctaatagttgtgaaatgccttcctctgttaattttcttctcttccattttgggcagaaaatgaagtctgagttcttaattgtattcagtgaaaactagaaacagatgaaggggatcagaatctgccacttacgcatgaggattattttgagttgaaggcaattgagagtcagtagatgctggaagagttctgtgccctccccttatttgcctagtagtagcagggcattaatttctatcttttttcttttttttctttttgagaccgtgtcttgctcttgttgtccaggctggaatgcaatggcgtgatctcagctcactgcagcctccacttcccgggttcaagtgattctcctgcctcagcctcccgagtagctggaactacaggcgtgcgccaccatgcctgactaattttgtatttttagtagagacggggttttgccatgttggccaggctggtctcgaactcctgacctcaggtgacccacctcccaaagtgctgggattacaggcatgagccaccacgcccagccagtttccttcttataacagggagggaagagcaactcttttcccttgagattgagagtcaaggcagagatgagtttgtataaacaaattttactaaaataaccgttattttccattagttctcccattttttctagtcactttcccatggtttattgtccctgaaattccaagttcccttttttgggggggttaaaatagtataaaagcctctacgtctaaccacttgtttgagtttcacttcttttctgtgaactcctgtgcatgtcaatattaataaaaattgtatgcttcttctcttgtgaatctgtcttttcatagtttaattcacaggccatgagatactgaaccaaaggtgatagaggaattgttttccctctctgacatagactacaaaaatgtcttcagttttccatatgtctttgaaaattgatgcaatatttttgcaaaactataagaaaactggaaaataaatgagaacaattaaggctaatgcattagtcatgatttatttcactgttgtattattcttttaggcagtcctattatttttttagcatagttgggattaattgatgaacaatggtgaaataatacctagaatgatggagttagcaaaatatttcaagatgtaggaaaaataaagccactaacatcccataatgtattttagattgataaaaggattctgttatagacccacataataattataagatataatgagttttaatctattttaaagtagtaagtaaattttcccttctttgtttaaagatctctaggaaacaat

SEQ ID NO: 79593 - DNA, 1025 bp, Homo sapiens
ctttagggaacttggaatgcttctatgtgttggcatcagagcctagggagactaggagagaggaggcagaaagtagatgtcagaaagctttgccttctttgaaagtttgcttaggaccattttagccatagtaagctatggtaaatagaaaagttctgaagtagtttgatgttggaggattgcaagtgcttcaactggaacatctgtccagttaggctactaatccagtcctttttcattccagtgttctattaatcagcattggctcactgaaatagcagttttcacaaatgaaaagtcaactgtagttttaggtgacaggaaattggatatttctattgacaacatactttgttattccaaaagcaagttttggaagatgaggaatacttacgacatattcactaattaaatatataaatcctgaatagtttttttcttgctttagaaaggaattaaaaactttgaattttcagattgctttaaatagtgatttaaataatgacttgatttaatcagtgccttatatcaaaaattgtatgtttagaattttgatttatttctccagagcaattttaaggattctcttaaccctcagtatacgaggaaaagtgtacaattatcactatcatctgggtcaaaagggactggttttttttgcattttacgttattatgtataatttataggagtaaaaataaagcataatgtaaaacaacttattggagcttttaataagaatttcaatacagcagatatctttgtatgtacttagaaaaataaaaaataaaaaatctatttcatgcatttaattacataacactcctacaacaaatatacatcacatttgaacgctttgcataaacattctcattgtaacacacatttttttctttttgagtttctgtatctgtacaaagaacatctttctttcttcccattttcagatctgtgcagaaatcattgtggttagagggtaagacaacattcccttcctattttctgcaagttattttcctagttgc

SEQ ID NO: 79594 - DNA, 1557 bp, Homo sapiens
gggccgcgcaggccttcgccttctgctcctccgccacctcctctcccaggcgtgtgcgcctgtttgtccccagcctggttttggcttttctctctggaggcaactccctttggtacattttgtgccgatgtttggccaagacccatggtcctcacaccacagcccacccccgtgtctcttcagtcgtaggaaaggagaccaaaggggattcgggatttgcaggcacagggcccctcattttgcccagatgaccggtcgttccacgtttgcaccctcatttttgtcaaagagacctcccctcctctgccatagaattcccgttattgtctacagaagaagggccctgaggagaaacgtggagttggagacaaaattttctgagctttgcaaggttcacttactgagacggaaagaatgatctcactctgaggttttagcctgctccagcgatggaaggaattcctcccaacttatcgcaagttttaacgcttttaaggagaaatctgctggagaggaaaaacgtcaaggtgaacccgcttctgcaagcacgggagacctttggccaaaggcctttgtttgcgaagatttgttaaaaaaaaaaaaatctgtcatcttaaatatttggctttattttcaggtttggacagaatttgtcttttttagtgccatgaaacataaaatggaacgctagaaggacagttttaaagcacaaaagctgcctcttagcatctgtaaggtgtcctgctttgggggactgctgtgccaactccagctgtctccacgcagaaacttaaccagggaaggcactggtttgcttataccattgttagggctgtgtgcctctgatgttttaacatcactacaaatactgttgtaattgtgtcttgcttttgtgcctttcattgataacccctgatttgtatctcttagccccttttgaagtggtctgggttgctggaatcattttgcaggcgaggaaacagagcctcagggagaggactttaatgaggtcactgactaggaagagccaaggccaattatattaatagaaccttaggtcttctgactccttctccggtgctcaactctagtatataccatttttgtgggaatgaggtagatgagaataggcaaggaggctcacttaaagattttaagaaacattactcagttgccctttcgttgatatttttatactttacttttgaaatgcggttgttatgttgcccaggctggtctcagactcctgggctcaagctgacctctcacctcagcctccgtagctgggattacaggtgtgcaccatctagcctggcttttatatttttattctcgagttaatttcttaactttgcaacttgctatttttttcgaaaatattggaaagttaaatagcccatttgaacacttagttttaacgctacctttttgccatatttgcatttttccacttatctcacattctgttttctgaacgtttcaaagtgcattacggatatgacagttcagccctaaatgctgtatgtgtgtcagtatgtattttgtaagagatcaagg

SEQ ID NO: 79595 - DNA, 1031 bp, Homo sapiens
gaactgattgtccatgtatttagacataaaataatagattgtaaacttctgcattacacagataaatatctgagtttgacagtgttgtaggcattatatttattcatatttctcaagctcatgcagaaatctattcatatacttctcaacaaggcaggattacacagatctgccaatccctaaaattagtttttaaaaataccttgtacaagtcaaaaacatggctcatctctcagaaggttgaagacaggctaatattttacttttcttaaaaaaaaaaaagataaggacctactatcaggcaaaatttgtgaaaatgtagcagtaatacttagaggttgctttctgcagtgaattattagactttgaaagactctcatatactgcagaggctcatttctgacatcaagttgaaatcactttagcatgaataatttttaaaatgaaatgctttttgaggatggaaaagagccatactggattttatctggttattaaattcaaaaacggccttgtatcaagaaagtggatgttgtgccaagcattattaacatattctatttagaaaaatgacattgttactcatatgaaaacagatgttgctctagataaagttaaatgccttcacaggtctcaagcatgtgtacatgaaattacagaaattaatcatagttcaagcaaggacttgactccacttctgctgtaaagaaagtgtttgggttatctatggctgcatgacaaaccatcccaacacttaatggcttaaaataaaggttgggaaactttttctgcaaaaggccaaatagtaggtatgttaaaatttggtgcaccatgcaatctctgttacaactactcaactccagtgtaactcaaatgcagccatagacaatatgtaaacaaatggatgtggctatgttccgataaaattatatttacaaaaagaggcagtatggtcaagtgcagtgcctcacacctataatcccagtgctttgggatgccgggtgttcaagaccagccttggcaatatagca

SEQ ID NO: 79596 - DNA, 1199 bp, Homo sapiens
ggtcctggaagtcatcccggcgcccccagcgctcttgcgtaatcttccccagtacctctctctgttccctcacacactttgggcctcggtggtctctcgctgagcccgtttcctctgccctaggacctgctagaagtggccgaagatgaatccccagcaacaacgcatggccgctatagggaccgacaaggagctgagcgacctactggacttcagtgcggtatgagagctttccatggcatcttggggttctgctgaggtttttgtttgtttgtttgtttgtttcttttaaataaagggtgaggggaagcaacgtggagactaggcagcgtgaactccatctgctttctgcttaagcagtagttctcagggctggagtccagctcccccaagttggacacctgaactttgatgtaatgtctagacttgcacatttaaaactttaatgccagaggggtcatttgatttaaccagttaaaaggagaacaatgtaattatgacctttggttgagtcaccctcccaccgcgatgattattggggatcttgtactttatatgaaaaagtgttgtttttttcttcagtactcctcaccattttcctctccagtatcagatgtagtttatggtacctgaaagatgtcagcgacaagaaaagtagtccagagctagaatttcgagccttctgaaacagagtacttttattttatacacacacacacgtgtgtgtgtgtgtgtgtgtgtattatgttcttaacatgggaaatgacttaaaaacatcaactgaaacctaagggcccactgcttttatttttaatgggtttaattcctttattaactgctgttaggaggcagcacctatacctgctttatacaattcagttataatccttactgtatgtagtaatttaatgggccataattctgactgtgtatattgagatataatgtaaatgtaatgaaattcacttagttctgcagtaaagatcatgtgtaatactatactgtttaaacttaataatcttggactcttccatgtaaatgatcgggtcttcagaacaaaatgtaaccattatttccaattaattaggaaatagtatcattcagtgtatttgcctctctggatctgaatgtatctccaattttattttaacttccctctgaaatttaataactgatggatgacttttggtggacttttg

SEQ ID NO: 79597 - DNA, 1766 bp, Homo sapiens
tcataaccacctaaacactttataccactttacattctaaaaagtttgtttttaaaaattgtatactaatttattaaaattcatttttaattatgaaattagagcttatggggaaagtatagcatgtccttaatcatcttaagtaagtgaaatgaaggcattttttggattttaagtagggtaaagactagtattattcttgatcaaaaggacatcatgaaacgataggcaagtcccaactcttctctcacctccttccttttactggtaatcatttgaaaattgttactttttggggaggggggagaaaatttaataatcttaaagttgtagaagatggctgtatttctttactggtgttgatacatctcatttttgcaactaataattcattctcaggaaccttcagatttactttgactaatacatagtagatgatgcttagtattttttaaaaatgagtcttgatattactgttgcctactgttccagcttaagttatggtaaatatatataactggacagtcactgatacaataacatgaactccaggaacttgctgttagaagtgcattctatttttagaataaaggcaattacatttatttcactttttaaacttaagaaggatttatgtagtctgtgaaattaaaaagtatgtgaactgggatatagattataagcatggcattggagcaatttttggacttcagtacgttgcattgcacaaagaaaaaattatttttctacattgcgaatggtcaccatatttgattatttggagtaggaacttttagttttaaaagttagatttgttatccattgaaaggtttgaacttacacacctgtagtcagtggacttagcaatatttatctgtgtgttttgttttaaatgctacaaaaaattgtaataaaaaagctgtgacttttaattagtgaatggatttgaatttggggaagagaaaatgccatgtgattttttttcaaatcaagatgtactggtagatataatttttctgtggccagttcttaaagggaatgtctaaaagaaattggtatagtaacattattttacttatatattttatatttatataccttattgacatttgaataaccttctgccctgatttcaaaggatattatgtaatacactctaatgcctatgtatttgcagctattaaggagctaaagatctgactttccttttgaagagctgctgtagtaaagattagggttttttgtttgttttctgttttgtctttggagtaacatttataaaaactacatgccatttgacttatgaaaactagagtttatagtcaggtattgtaatttcctttcttatttgtcctttttgaggaagactcaatttcacagtgggctgtttttgagaaacgatatataatactttcagaagcttttttagctgaaagaatatatactatagcatgtgatgttatctttaatcttattcctgaagcaaaacaaataactcatcatggctgagttatttatgagtgtcggaagtcactctggaaaagataaaggtgtgtttactactactaatttgtcttgaggatctgttatgttattccttcatcagggtgttaaaattttcttcacgttatggtgagagtgaatttgttcacttggtatgataggctctgtgaagtgttcctaaagtgaccttgagagaaacttttctttctgtaggagtgaaaggtcaggcactctaattagggcagtgtatagaaacaaagggc

SEQ ID NO: 79598 - DNA, 1388 bp, Homo sapiens
tgaaaaacaaggtcgggtgtggtggctcatgcctgtaatcccagcactttgggaggccgaggtgggtggatcacatgaggtcaggagtttgagaccagcctggccaacatggtgaaaccctatttctactaataatacaaaaacttgctgggtgtgatggtgggcacctgtaatcccagctactcaggaggctggggtgggagaattgcttgaacctgggaggcagaggttgcagtgacctgagatggcgcagccagtgtactccagtcttggcaacagaatgagactctgtctccaaaaacaaaaaaaaaccacaaacaaatggtgtccaccgcccccccacccccccgccccaaccccgtagtcattgcttataatggatttgaaaaacaatttgattagatcacaacattttaggggcttgtttattatatatagtgaggcatacctacaattactgtttttgttttcattagccatttaaacacaaattcaagtttctgtcttcaaggtatcctttgctatatctttgagtttttaaacaagccttttgaaatgagaagataaagatgaagatatccaaccttgactataaacaactttcaaattttatacttaattgggcaataaacaatgctgtcttattaaagccatatagtcttttctgctcttaaacaattggtagtcttttcctggaatgtcattgtctgcctagtgttgtcaaagacttgggtaatcttgctgaaagaaagtaaaagtagcactattagaaaggctctcctgaaaaagaaaaagaagtgctatttgtggacaatgtgtggaatgcctttttaaaagatcatttaataagactgcttttgggtatcacttgaaagtatgtttatggatgggaatgttgaaattgcaaatctaaattgtttgtgtttagggaagataatgagaagacaaacacttaaatatattcaaaagactaatgaatgacagtctgctttgttaaatagttgtgccataagtatctcatttttatcagttaactatttagtatttacctatgcattcttctagcagtttttgggaagatgggaaatggagaaggtcattgctcagaaaaagtggagacatttcgttggcgtggtggctcacgcctgtaatcacagcgttttgggaggctgaggcaggcagatcacttgaggccaggagttggagaccagcctggccaacgtagcaaaaccctgtctctaccaaaaatacacagaattagccaggtgttgtggctcatgcctgtagtcccagctactggggaggctgaggcaggagaattgcttgaacccaggaggcagaggttacagtgagccgagattgtgccacggcactccagcctgggtgac

SEQ ID NO: 79599 - DNA, 1182 bp, Homo sapiens
gaattgttttttgcattttatatttcacatgacctgggactcttctggctaatttggagatgtatgagggaagcatgctcggtaaagatgttggttaaaaagaagaccgtcttttttctgcatataaagttaatacatagtcataattgaaaagaaaattagagaacagaaaaagcaaaaggggaaaaattagctttatttcagtatccagagaaaattgatttatttcctttttgtctttttttcttatagttccgtttgcaaagctggtaacttaatgttagttcatttatgtcctgttttttgtttcacttaatcttctaccattaacattttctcctgttattaacttggcttaaaatagttgcatgctcttaaatggaatgaatatagcataacttaacaaatccattcttttattacttgacctttatggatttttgttaatttgctttttgatatgataaataatgtggtactgaccacctttttgtgtatgtatatgtttttgcccacattctgatttcttttggttaggagatgcaaattttgttttttgtgcctacaagttaataattaaaactaatgaattcccttagggaaatgaacacagagggagataaattatcaggccagggattgatgttaatggtggagttacatgtataaaattagtgactttggttgattatttaatgtaataatacaaaattttattagtatgtgaatggaatgcattatgacatttggagcacatttgtgcttgtatacaaatgtgttgtgtggtgactggagggaattcctgtcattctttgacctgtgcttatagaaatggagtggagtctaattggagtcttgtcagtgagagagcccttgaattcctgactttttgtgagagagacaatatagtgtattggaaagaattgggctcaggagccagacaactggattggaatcgatgacttgcagcttactagctggatggccttaggtgagatatttaaataatcagagctatacttttttcatttgtgaaaagtgggtaataatgcccacctacagaatccttgtgaagattaaataaggttatctatatatttttttcctataaagctgcttaaaaaatggtagctgctattattgtggtaccttctaactagcattctcggtaatactagtgat

SEQ ID NO: 79600 - DNA, 1728 bp, Homo sapiens
tcctgagtagctagcacctgaaaatgctttttaaatgatggtgcagtgtacaatgtgaagtattatttattgctaaagtccatgctttgagtctttacagaaaagcctgcataaggttgctctgatgtcataatgatcggaaaaaatgatctaaaatcaccgtaacttcagaacatcagagttcatatttagggaaaagttttcttttctttctttgaagaatttagtatgtaaaggttacttagcctcagggaaatctttgtataaaacagtcctttaaaaacaataccttgactgtagaagagaatgtttaaactggagtgaataccagtgaagtaacaaatatcagtaaagtttcgagtgagttgaagaaaacaaaccagtgatctcaatggcgcaatcacctcagaatgaagctggggcctgaagtttataatggaataagcttagaggttacagccagaagtacagaggtaccaaaagtttttagacctctgtaggaacatcaaaatgtattgcaagcattacttgcctattcaccttccgacatcttccactttcactcatcttgctgtatcactagagggaagaaaatgcttactgttttccctggtaaggacactaaaagtcacactctttccccagagaaattatagcctagaagaaatagacaaggccacatatcagattacctttaagttaactgagtttctggcatgatttctcttgattccaggcagatttttttgggtgactatgcatgagggaaaatatccaatttcatgacttccaagaaaggtcactttcatagacctctgaaaaggcaaaacagttgttaactataaaaaatacattgaaattttggattttgtcttgattacattaaattgttttaaatgtttatgtttttaggtgttctgagctatttattgcattgacttgttgcattactctgtacgctaattaagcacaatttgtatatttctgcatttgctggtatttttaggaatatgtcttaatgtgcagttttatcccagtaattaaaaaaagttaccaaaagcatgacagtccactgaatgtaaactcctttttaaaaaaactttgttttatttaatatttattctgagcacacagagcattgttacacacattcagtaattttattatatgaaaattatagatgtaaaactcagtctgcaaaaaggaaaaaggcttgaaactcagttatgtatgaattaaaagcatttcctttaggcaaggatgatttagtagttttcttatatacatgtagttaattgtcatggtgtttcttggaagagaaaaacagtgtaagaagaccggcttttgaaaaacttgtttaaaagagttgagctgtaagctttatttaaccaacatttacttaacatatacttaacatataatttgtgccaggctctgtgcttggtttcagggatggaagggtgacatagatatggcccttctggaagagctaatttgtttgggaaggcagtcatgtgaacagataaatactaatacaacctggaaagttctttaatagaaatggttaaagtgtcatggggttatagaggttaaagcagctacttgtgtctagagaattggtgcatgttttgctagtgtgctagacaaaggcatgtttagtggggaagacaggaaaagggaaaggctctagatttactttacagtaggcctgtgctagtaagtacagta

SEQ ID NO: 79601 - DNA, 1002 bp, Homo sapiens
ttcctttgaagagagaaaacagctttattggcagtggggacagtcaacattactatccatgttaaagaaaagatcccagaaacatgaagaaaaagactagaatgtaattatgtaaaaagcaaatcaacaaaaagcgaacccagaccaccacagttcaaataagagaaaatgcttccaattagtgatgtaacctacttaggcctcagttttctcattgaacagaaagaaaaggttgttactagatcatctcttaagttactttctgatacagaattgcaactcctgagacatctttatgtctctttaagctgtggaatcctaccagatatttagaatgataatgtgaacagctcgactttcaagaattcagttcggtgagaacacctaatgaagtggaaattagtgtgttatgtgtgcatttaatgactttattgtagcctgtgtctagactgttgatttgatgaagtttatacagaagaattaaatgctcatgatttatatatttaaaaaatctatgagttttcctggaagtgagtgtttctttgaagcagatttaatgtgttaaggtcttttttttttttttttttttttaccttctgtacaatcattttctgaaattgtaataaaaatcaagtacaaaagataatccagcatttaaatactctttattctagccttttctattatagtacttgtttttgtttttttattgtcgtggtattttgtgttaacttgaagactaattgagcatacagaaaattttttcaacttgggaatgtggggcaatataacttgaaaagagatgaaaaaacaatttctttgggtcagaagtattttacatctggaaacacacccttgaactctggctgtggtttttccacatgtgccatttattagcagatacgttctttatgaaattttgacagtatatgctgctttttgtctgaggaaagcttagttctaggcagaatttagctttgttgtttttgattcaggagttaa

SEQ ID NO: 79602 - DNA, 1180 bp, Homo sapiens
actatttgataccctgtgttataacgagtagaaattggtagttgtgctaggctatgccctgtgtctcaaggaggaattggggagattgggcagcgttcatgtatgtatcgtaacttggttcctgggagaacatgagattgctatggcaacaaaggttctttgaaggcaaaaattttggcagagtggttgggtcttttgaagtgctgggtgtgttgacaggaaaggaataagcatacatctgtagactagcagtcaaggaaaataagcatttagtattagctttaacttgaggtcaaatatattttgagctgtaacttgagcgcaaatatgttttgagttccacctcagtgctaattttccttcagaacttttatttgtatgaggttttctcttctcaagtctgctgtttcaagaacaagtttcgaagaatgtaccatgtaatgttttagctggcctaaaattgtctaaagttttggtagaatcagtgtggtgtaatgcattctgatatgagttgcttctaattttaagagtagataaaaatcattacaaattactcagcttagaatttggtatcgcttaaaaactggtgacaaaaataaattcccagactctgtgatctgcctgctgttttcaagatccttatcttacctcaccaactttctctctctcttttccattctcaatctcaactttcactcctggttttgctctgtggctgttcatgcttgcttcccagccattgctcaagatgtatctcctgcctggcatgtcttttcatttttcagcctctctaaacactactcaagttttacttttgtcatgaagtttccctgacttttataaccaacagggatttcttccttctctaactcttgattaacatttatgtattaaatcatttggagcttaataagattttacacatttttgtttatgtgttgtgtgttgaacttattgccttagtaataagtttgtggtcagaatttttgtactcttgtgccttataataaaggaccaggcacatagttaatacctggtaacaactagttgattgatggttttaattttaaatggatcagtggtaaaaatcatattcaaataatagatcatttatttagctttttaataagttgtataagtagtcaccatagataatgtcctgtatcagggatactcttat

SEQ ID NO: 79603 - DNA, 1053 bp, Homo sapiens
ggttagaggctctgactccccacacagcaaaatctctgtatataacttttgactcctccaaaacttaactacgaatagccttttgttgaccagaagtcttactgataacataaacaattaatacatatttttcatgttatatgttttatatgctgtattcttacaataaaataagctagacaagtgcaaacattaagagaatcattgggaaagaaaatatatttactaagtgtaagtggattctcataaagatcttcatcattgtcttcatgctgaggaagaggagaggttggtgtggctgtctcgcagaggtggaaggggcagaagaggtggggagatagaatgggaggcaggataggcaggtacacttggtgtagcttttattgggggaaaaaaacacatgtgagtggacccatgcagttcaaacttgtgttgttcaagggtcaactgcagcttttcttgattctaaatttagatataatttaccaattcattcatttaacatttattgactgtctacaaagctccagagactcaggtaggctttagagataatagtggggagcaagaaacacataagctcttggggcttattttaaaaaagaataaagtaggtaaagagtgactgtgatgaataattcaaaactctaaagtttctttagttgatatgactgaatttaattttagacaatcacattttatgtgtttaattaaggtaattaaaatgctccaaacaaggttgagaattcttacgctttttaaaaatataggtaaattcaaaatcttttaattttgatggtgattacatgtaatacagatttgcagaaaaatccataattatagaattggtgctgactcactttccagtgacctgataactgtctgcatcatttaccattgtgaatgaattacccaagtcagttttcagacaaatttgcagaattaaccttagtaactgttgaacacattgctgctttaaacaacatattgttacattttttaaaagaaaaaaattaaatttgtaccttgattctgtaaaccatactttaatct

SEQ ID NO: 79604 - DNA, 1050 bp, Homo sapiens
actttttcataccaaagagcaaaataagtgtgcttataaccgtagttcctgtctttataaaaatgtatgaataaatttgagccatgtaaattaaggttacagaacagatagcatttagtgaagaaaagctggtccttagagtatatcattatttaccccatagtacctacctaatgaaatctagttttaatgattctttttaggacaccaaagctcatgaagcctattacaataacgtgtttaattctgagtaattgtttttcctatttaaatgaagaactcagtgactaaaaatttatttcctgcaaattttcttagatgatagaagttatacgtagtaaaaccaacaggaccaactgtgaggctgaaggaatttcagttaagaggttttaatttttatcaatttaaactgtgttttgaggagtggacagaaagggaagagggatattttgagatcacccagcagtttttgatcttttgtcagttcttttgtaatgctatagatgactacaatttgaaacttgaaataagaaattttttgtattgggtgattcacaaactgttgggttttctgaatggcttaaatcctttaaagaaacagttttaaaaagacatagcatgagaacaggatcataattattctgtaaccagcagtctgtgttggttacagaaagtatgcttttgtttaacattataaataaattaccttatattgctgcttacgtttctggtttttggtgtgtatgttatcaatgttgaccaaaattaactgaatatggtgacaaaaccagagaaaaaatttgagcttctgttgataaataaaatgtaaatgctactttttgaaataaaactttacacttataggcttttatgtatgatctgtgttttcttgaggaaatgttgattaagtagtttccattttggtattacagtatgtcctgttgtaagtagctgactgtgtaaaaatcttttaagtcaaaaaagcagctcagcttaaacccctactatttattatggcagaaaccagaaatagaaatcttccagaagttt

SEQ ID NO: 79605 - DNA, 1402 bp, Homo sapiens
taaaagaatcttggtctataatattactaattaataaataagtttttgaggataacgccaatacttgaattttgatatctacttgcaacatgcagtaatgcaatatttagtgagcttaattagttgctttttttttttccaccctgagacaagagtttcgctcttgttgcccaggcctggagttcagtggcgcaatctgggctcactgcaacctccacctcctgggttcaagcgattctcctgcctcagccccttctgagtagctgggattacaggtgcccgccaccacgcccggctaattttttgtatttttagtaaagagagggtttcatcatgttggccaggctggtttcgaacttctgacctcaggtgatccacctgccttggcctcccaaagtgcagggattacaggcttgagccaccgtgcctggcctaattagttacttttaaatgttactaacagaatctgaggagcgtggtttgtgtcctcagaataaatgtttaagctttgagtgtctgcctgtgtcatgaggaaaacagggagaggagaaaatttcttgttgctgctattttatttgcatttaagactagtcattgttaggtaactatggaatcttcactgctttacagttttggtgcatgtcaggttcaataatttttactttaaaaagttatttttacattttaatgagattaaattgtttaccaattaacattgtactataaaaggaacagaaatgtgactggcacttggaaagaaaagctgtcatctgtagactgatgtgtggtattctaatttaaattcgtggtttggcagaattaaatttggattttaacatcatccagaagtaaaagttatgtgcattttcaagataaactcaggaaataaaccatataggaaagactcatttttgcttcagaacacagtaaagatgaaactttgaaaatgctttctaatcattcagtgtaaacctatttaccaagttaaactggtcatgtgatatttcatatatcacttgtattagtatgtggtcttatgcttataaagttaatgtgcttaaaaataacagctaaaacatataggcagtgattattaaacaagaacattaaaatacgattcaaaattgtttaattgtaccttttagcagaaataccattttaaaagatagtaacattttattttctgtcagtaaaaatatagtcatgtgtcacttgacagggataagttgtaagcaattagttattaggtgatttggtcatatgaacttcatagattgtacttacataaacctagggggtatatagcctactatacactagactatgtggtatagcctgttgctcctaggctacaaacctgtacagcatgttactcatcttagtatacagaatactgcagaca

SEQ ID NO: 79606 - DNA, 1015 bp, Homo sapiens
agtcttattgctgtaggaatcagtttgctggtttctagagggtgggctgaccttgacttagtaaagtatagtactttttgtctccctagtagaagtattaactgacctttaaagtgaacttgatgcaccctcttcaggaaacaggaaactgttacatttgggtgtgatattaggagatgaggatactgtgtaggaggtgttggacctgcctaaagtgtttggccttgaaatgtcaaggttgctctcccaaacctagttttccttgacctggctgtttttctaacttcagagacggacttaaacaatagagtttattagattatatgtctgtgtaaacaaatgaagattaaaagacaaaaaataaagtagttaaaaatgaaatgtcttactttttcttgttttaggataaaaattgtattaataccttaaaatgtattcagcaggcaaaaacttcggtagtttcggtattacagtgacaccatttatttttaggcatagtcttgtctttttttttttttttttttggtaaatattataccattttcaacttaatgtgaaaagcttttccagttaatctttatcgtgtgtgtgtgtctgtgtgtgcgtgtgcgtgtgtgtgtgtgtgtgaaagaaaatgtgttttaggcagcatcagtagagcaaaataagatttaatgttgttacttcaaaactgtatccctaacaagacgatacaaaattcagagtgttttggccccttttctaggacagatttagaaacttatagacttgtagttataggataaatgtatgccaaagctttcttcaaagaaagctccatcataaggtggtttttcttcgtggtgcttatattttacaggaacatttagagggatgtggtgtttctatttttctttgcccttctaatcagcaattaaaaaaatattggatctacaggtttggggggtaaattctattgcagatttgttattaacactactctacatatctgttggcctgtagcatacttactgca

SEQ ID NO: 79607 - DNA, 1045 bp, Homo sapiens
tactgctgagctttaaaaactttagcagctttgaccagaacacctacgttaaaatttctttataactcttcagaatttttttctttttctttttttttttgagacagggttttgctctatcacctaggctggagagtgaagtggcataatcatggctcactggagcctctaccttccaggctcaagcaatgctcctacctcagcctccacagtagctggggccacagatgtgcaccactgcacttggctaatccttaaatttttttgtagagatggggtctcaccatgttgcccaggctgctgtcaaactcctgggcttaatcagtcctcccacctcagcctcccaaagtgctgacattacagacgcgagccactgtgcctggccagtcttcagatttgttaacaaatctcaggggtttgctttagtctcccaagctcgccttacgtaaatgtgtcatgtaatgaaagatgatattcccaacccaccatctcacatattcagttgattttcactaaccgtgaaggatttgcactgatttatgcatccaattctctcctgatttctttacttttcctcctcttttctctttcctcaccagtcttccgtttccatctaatgactagtgtcccacattggacaagataaaatggttgaccagttagagacataggaaaaagtggaatattgaatttgcattgaaagggctgaacttgtgaccttatgttatcttccatataattctaatttctacaatataaggttttaatttactcagttcagaaaatctaattgtttgacagtaaagtttggacctatttatataaagtttggaggaaatatgatcttatcaatatgcactatggaaaatgtcctttttagtctgtgaatttagagctatacctactgcttgaatgaagatggtctaaagatttaaaagacatttagggttaataagttttcatggcaaaacatttaacatttttaaactaaattcagatgagttactcattttttgtgtaccttaattccttccaaatactcttc

SEQ ID NO: 79608 - DNA, 1045 bp, Homo sapiens
gtgtccccgctacctttttttttttgagaccaaggctcagctcgctctgtcgcccaggctggagtgcagtggcacgatcgcagctcattgcagcctctgcctcctgggttaaagctgttcttttgcctcagcctccctagtaactgggactacaggcgcctgctaccatgtgcggctaatttttgtattttcagtagagaggaggtttcaccatgttggccacgctggtctcgaattcctgacctcaagtgatcgcctgcctcagccttgcaaaagtgctgggattacaggcatgagccaccgcccccagcctgtgcccttttcactaaaatcacatttattgaggtttctttggggcactcctgcttgcgttttcacatttcttatctatgcacctgaattttccctttggaattttgaccacagaacctgttttgtttcagttagaataatcctcagtctggaaatcatgtattaaatgacacaatgggatggaattgtagcctataataagtgaagagaaagagaagattaccacctaagagctttaaatacttgaaatgcgcctggtctccagatgcagagaagttgtgttgaaagaatttgtatgatagctcctcatacagtgtttttatttataaaagtaattcatgtacatcagtttacaaaataaaagttcttacgtaagaaatgttagtcaccagtgtgatgaaacgtagaatgaaaccttaaactgtgttaatagaaatgtggtgtcagaatcatagatggtagtggttcctttgtaatcttcgctgagatgatgaattcattttcatactttaagagggtcactcgtcaactgtagtgacttagaaaggcatgtttaggatttgagctactgaaaatgttcttgtaggaacagttaaaaaactgggaatgggaagactgagaatgtacaggaataatactctccagagttttaaatgctgtcatgtagaagataatatagatttctctggtgttcctctagaacagagataggaaaattctttttggaaaggac

SEQ ID NO: 79609 - DNA, 1050 bp, Homo sapiens
gtgagtagtggtggcaagatactgactttttttttagagcaattcttggtatgtacaacagtttggcttattatggctcttattttctaagctgtagaaatgttctacttgtgaggtactgcagggacatgaacagccctgagaaagaaagtaggttcttacttatttttctacgtatagaattttatgatatattagtaaaaattattagctttcttgcttatttaattctaaagatgtaccattaactaaaacccttcaatttcacagctccgtagacatttggtagggattatacaggtccaaaaggaaagtaaacaccagagtagctattacaagggaacacaaataagaatggtttagaaatggatatgatgaattgacatgtaagggtccatgtaaatgctgtttgctctctaaaagaatgtttacctaaagctattcatcctgcagacttgtttaatggtatcctggtgatgaaattgagacataagtaatatacagttcagtttagttttgttagtgagctactttaaatctttgatcaccacattggtttttatagtacctgtttggatttggatacagtttaacacttcattaagcaaatggcttctctttccttaggtgtgcttggataacctaattgatgtatataggactgatcacattttcagattttacttgagtcactgagattatttttgttgttgtttttgggttaaataaactattatattgtgaatggaagaatctttaggttcttgcttttcttgttgatgacttttttttcttccttttgccctatgttttttcactacgcttgaccacttctgggtgggcaagaagagcttgccctttatttagtcgagtttgtagctgtactcaataaaatttgccacctgtgaaagggattgcagtgttggagaaacaaaggaaattaataatgtttgattttaagatcatttatggtttcatatgttcagccttgtgtcttatggttgtgaacaggttcataaattatgacaatgaatttaacatttaatagaa

SEQ ID NO: 79610 - DNA, 1049 bp, Homo sapiens
taagtggaaaaattcctgttctaattttattagaaaggaattaatagctatttattcacaacatctgattaggaagctgggatagggcaagctctcaataatagaaaagtgtggggcaggcgtggcggctcatgcctagcacattgggaggctgaggtaggaggattacttgaggccaggagtttgagaccaacctgggcaacatagtgagatcccatctctgttaaaaaaaaaattgctggacatgagggtgcctgcctgtggtccaagctactcagggggctgagacagggggattgcttgagcccaggagttggaggttgcagtgagccatgaccataccacttgcactccagctgggtgacagagagcccatctcaaaaagaaagaaggtgggggtggtggagagaaggaagagagggagggagggagggagggaaagaaaagaaaaaaatatctgggtactatttcgtgatatcacagattgagtctttggcttcagagttctagaggtgattcaccagcctgaaaatacgcttttcataccttcgcattcttgccaaagcatgtccttcatttaattaggagaggataataaaatgtaacttgtaaggtgaaaaaaaaagaagcgacaagccatagagtttatctaaaaattttttgtcctaagcatttttgttatatttagtaggaaactgctactttgggaacaggagaagggaatattggggagatctgcatttttctttagctagtccttgttccaagtatattgtagacatagaggtaaacattagcgttgtattgaagtgcagtggttctttgggtatatgcaaatatatgtacattatttgtactgtagttagctgaggggacacgggatagatagatgactaggcctttgatgtttttttccttgtgtgaatgaggaaaaatgaaaaggtactccaaatgctgtgatttttgtggtatgtgcctagctcttaattgtcaaatgatactttccccttaactgtataggccagactgcttggtgtatctccattccg

SEQ ID NO: 79611 - DNA, 1030 bp, Homo sapiens
tatgttttttgtttaatgtgtaagtccatttgtaatgttttcatcttccttttctaaccaccaaacccaaatataattgtcttgttcaagaagggcagcaacatgaactttatgagctcacagagcaatggggtgtgttcgcactgaaaagaggagtatctgtttgattgcttccctgtcttctttcccagacagaagtggaatattttattgtatggttggatttaggtctactaatttgtttgttttctgtgtattccaacagtattttgttttactgtatctccattcttttggggtgggattttcttaggactccttttattagctggcttttttgcaatgcctctgctttttttttttttttttttttttttttttggtagcgtctctagggatgttaacatacatcattaacttctcaaaggctatttagagttaatattgtgccacttcacataaaaggcagaactcttgaccttattataggtctatttactgccttcctttatgctatagttatcatgtgtattacatctgaatgcattgtaactcttaggagagaaaattattttttctttcctaagctctatgtgttttgaagacattaaaggaaaaattagtctttttatttattatatatgatactattccctaggatgcaggtcttcctctgataacattatccttcaacctgggccaggtgcgttggatcacacctgtaatcccagcactttgggaggccgaagcaggcgaatcaagccggggtcaggagttcgagaccagcctggccaacatagtgaaaccctatctctactgaaaacacaaaaattagccgagtgtggtggcgcacgccggtaatcccagctacttgggaggctgaggcaggagaatcgcttgaacctggaggcggcggttgcagtgagctcagatcgcgccactgcactctggcctgggtgacgagcaaaaactctgtctcaaaaaataataataataatgattatccttcagcctgaagaacttcttttaa

SEQ ID NO: 79612 - DNA, 1041 bp, Homo sapiens
atcctccaatgttaacctcccacgtagctgggactacaggagcacactgccgtgcctggctaattttaatttttttgtagacatagagttttgccatgttgctcaggctggtctcaaactcctggactcaagcaatccacctgccttggcctcccaaagtgctgggattacgggaaagagacaccacacctggcttaattttagttttttttaatgttttctttttcttcgtgagattttcacttttttttttttttcattaaaagcatgtatctttcactttattgagcatagttacagcatctgctttaatgtccttgtctgaaaattttactttgggtcatcttgctgttggcctctggtgattatcttttcccttgagattgggttacatattactgtcaaagaattttggatattatgagtgttatttgtggaaattgtggcttattttcatgttcttccaaagagttttgatttatttgttttagtgagccatttgcttttggttagactcatagcaaaaattatctcttgcctgaagttggtagctgctcagatctcaattcggttcttttagtctctgctacaaactgccttgtgcctgccctgtgaatggtgttccaggactcagccaaagatgtgggcagagataaaccaaaaatttgggacctctcttttctggccttctcccttttgggattctatcctcactttctagtgactgtggttgtcctgtctctgtcctcttttccttcaggccaaaaagacaatggggtttctgttggaattttagttactagaggttattgctgcttgcctgcaggagaaagctttcagaatgggaaactcacctgtgctggtccctgaaagctgattaaaagagaaactcacccattctggtctcttctttcaagtttatattttcatcccaatcagcctgtttttgtttactccccagagcctttatgtagttgatagcaagctagctagatattttctttccgccagccctaggatttatagtaactattagaagag

SEQ ID NO: 79613 - DNA, 1038 bp, Homo sapiens
ggaatatccttactctacaaatagaattgaataaagacactattaaaaatagacacattcatagctttgattatctgatatagctatctctagtcagaattctttcatcaaatcatttattggatccccctacagcagatggcaatcctgcaaaatatgttatgtttcccttatttatgacagtgctgagatttgatatttttggagtacattttactttctagaataaaaatttgatttcagtgctactaaaggcagagtgcacatgtgcaccagcgggtggggggagaaaaagagagaaatgtgtatgtgattttccctgtgcccttgctcccaactgtatgtgtgtctctttcccacagggatgggctctcatttatgataccctagcagtatggccagattgaattgcttttcttactgcttttgctgcagggacatcctaaccatttctctcattcttgtatgctgtctccctgtttcatcctttcattctttcttgggtcatcagactcaccactactaactgaaaatattttcccatttcctgtcttatttctcactttaccctagtcttggttcagggtggcggagtctttagtgataggtctggtagtggcaaatgggcagagaaggaactggtgttcatgtcagcaggtttgttcctaattcttcccttttactttcaggcaggtcttgcctaagtctcaccaattctttaatgatggtttacttactcaaactctgcagtgttaacaataatttgtttacagggctcatatgtggtggggggctggggggagggtggagggaaacacaataggtgcttagggcatagaaaagcatctcctcccaccaaaaaaaaaaaaaaaaaaaattccagtttccagtttttgctagtggatcaaaacctagagatgcccataggactctggtggcttgatgaaagggaagaagtaggagagaggctgtgggatagtttttgattgacactagaaagaaaatactgttattcaaatactaagatgggagtagagc

SEQ ID NO: 79614 - DNA, 1137 bp, Homo sapiens
gaaaggtgaaaatagaagagggtctgcagctgataaaagaggacatgggacatgatatgatagaacagtttagcaagtatagtgtattgggtagaatagcatagaatttaagagcttgagcattaaaatcaagctgtcttgggttctatttctggcacttctgcctcattgctctgtgactctgagcaagttatgtgtttttactttaatctttttttcttttttcattgattaaaagggggtgggtactaataataacttcctcactaaagtttggggcttatacctgtcagtggaaaggggaaaaccagttgtgtggtgatgatttagctttaaaatacttgatttagctgctgtatatgattcagcacaagatgatatccgggattttttttttattaagggatagtaataggtatgttctgaggctttttgtttcaatacatgctatgatttctgatacctatagcaataaagggatatgaggattcagttcatttaaaaagcatcagcagtggtttttttcacagaccagttgttaaaaacaaaaacggaccatagacccaactaggttgaaaatgaaaatatgtgggtacaaggatttaagtatttctccagtcttctaaagttcatagacaaagccatagattggggccttgggataagggaaacaaaaataaataaaaactcagtgaaagtaaacataagctttcagattctatgggaaagtaaaatcagcctataagattatctggatgagattaatgtcatttttcttgcaaatcctggaccattcctgccagatatggctaaagggaactttaattttgtttagcgctctctccattcttaacaggagttcagtattttttcgttaatgtggaagagtttggctaagaacctctctatagtttgtaggtagtgagttagaaataggataatagaaccttggtttttctaatgtgctatctatacaaaaaacacaggtcattctgacctcagcagggtcatactggctggaggtgtagaaggaactggtgggtagttcatttacatttgacagcagatgccttaagagtgtatctatgggcagaggcaacctgtagtttccttcctccaacagagtccagtggcata

SEQ ID NO: 79615 - DNA, 1979 bp, Homo sapiens
tttatccctttgtccaggagggacaggtaagtatctagaagaaagttcttgagtttctaggggcatctagggcttttcttgttcagcacagcttgaggatcaaatgtccagaaaatttggggtctactcttaaagcattattgttttggtgtcaaaaaaagaagtggcagtgttttgattgtcagttttggcaatgtctttgtgacctcaagcattacatgttttctggggcagagaagtattgttttaggggcatttgtgatgttactatttctcttaacagttgtattatgttgtaattaaaaatgtgacatagcagtgattttaggcagactttacttgcattggacaatatttctcctggcacaatttgattaaaacatagtatatttagatattgcagcattgttttaagcacttggcttcatactaggacttttttgaagttttggtttgaagaagtgaagttgcactttcaagaagggtatgcactaccatctaaacttgatttttatgtttaggcaaaacctttgtggttaatcatgctctgcaaaacacccctcctttcctttctccttctctgtctcaaatgaaagtttaaagttgttcagtctaaaattataaacccaagcttgtttttttcagtttgaataccatttttttttgtgtaaatattttacccttttgcaaaacctgattgaaaataatctgtatgttttatgattttttttcttgcttatgctggggctgaaaatattacaaaaacttttatctgttttaccagttataactgtttttaccagttatggcatcatataaatatggaaagtttgtgtaattgacattgatttcattacttactttatttcttaaggacatgacctatattgtgatcttagaatcgtccttttaagacacagccatactaatctgagtagattacccaaatcccaaatcctggtggtctgcaatttatttaaaatgatttgctttgcacagtctttgtttcccttattctctatagtgtcgaggagacagaatctgatagtctagtgtggattttgccgaaggcggttgacagtttgaagccagaagaaccattagagtatgacagaagagtgaaaaaactgacacaagcaataaaacttgtgtttaaaatcacaatttgtttcagcgtaaataaatgcacatagaaaatcatggtattatatgtattatcattccagataaaaaaatcagagttaggtttacaataaattatttggctagggaaaactttctaatttattttttaaattttcaattgagcttgccatcaaagtaaaatcgatataacactccaaattatttcctttcggagtacaacttttccccaagtaggatttaatttatattaagtgtagtagggcaagtaaaagtccgtgtttttgtaattttggattaaactaagctttcttaattgagaatataactctgaactgtgaaaaatcagaaattgctctttttgtatttatgttcttacctttattcttcactcatagagatgacttttaggcccaatggaatttcatcattagtacagctttgtaccaaggtgacgattaaaattttgtacgggacaagtgtggaaattaaatgaatcctaagaggtatgcatgtcagtcagttgctctgagcagatgttgactaacaatatatctgtaattcactttgaggtaacattttctcagttggagcaattacgagcatgtgcttgttggtttctttagttttcagataattattagaatacgttcaatagtcatccataccctatgtataaaatcaacatctaaaaaaagtcttgaagtaaataaatatttgtaagtagattgatctcttaattcaaatgaaaaaaatctgcattcatgtgaactacgttgtttaggtactactttgtatcagatgcagatatacaaaccatacattttcttttctta

SEQ ID NO: 79616 - DNA, 1052 bp, Homo sapiens
agaatcaccattttcagactatcaaagggtaatacaaccctgccctcaaaagttaactcttttggcttagtggggtggctcacattcccagcactttgggaggtaggaggattgcttgagcccaggagtttaagaccagcctgagcaatatggtgaaaccctgtctctacaaaaaataaaaaaaattagccaggcatggtggcacatgcctatggtcccacctacctgggaggctgagagggaggattccttgagctggggaggtggagattgcagtgagccagatcacttcactgtattccagcctgggcaacagatccaaccctgtcttaaaaaaaataataaaaaataaaaaaagatatgtagtttgatatacttgaaatttcttcactagatgagatactgaaaatgattataaagtgtcgaagggaaatagtatctgatttgacagtgtttcataaggatgaggccttttactttttccagtgttttaataaccctaaatttcatgaaagaatatgattgtatattcattgatctacattctctgacctttggctgtgctgacaaacacaaaatgttggcaccaagagaaacttgagagaaaggagcctagatacagttgaaggcactaaagccaagaaaaatgaaattacttgttagtttgaaacatggccctggccaggcacaatggctcacccctgtaatcccagcactttgagaggctgaggcaggtggatcacctgagttcaggagttcgagaccagcctgaccaacatggtgaaaccccatctctactaaaaatacaaaaatacaaaaaaaaaaaaaaaaaaaaaaaaaaccagtcaggcatgatggcacatgcttgtaatcccagctgtgtgggaggctgaggcaggagaattgcttgaacgcaggagacagaggttgcagtgagcccagattgcgccactgcactccagcctggatgacagagcaagactccatctcaaaaaaacaaaacaaacaaacaaaaaaacagaaaaagaaacatggcattgaccctcttgatt

SEQ ID NO: 79617 - DNA, 1035 bp, Homo sapiens
atgagacatccggtctttaaaaaaaatgcatatttcttatttcccataaggcagttagaagtctgcacaataatgataatacttaatattgtaaataggatatcaatttatgtggcatttaaagaattttgaaattcattgtattttgtttatcctttttctatgagtattcgaatttctattctcgtcttaatatcagagattttaatttgttcttatagttagttaacttaaacctgtggcctaggttagccattaactgaattagttcagattatttatcttaacctattgttgcgtatagtattttaggtttttgttgagatggatactattgtatatttaaaaatgcatagaacttgtcaaagatagcttaatttgcctttctacattcataaaaatgttaaaagttaagggatttttaaaatgtcattagatattcttatctgaatcatttatatattaccataaatcacagttgtattaagtcagccatgaagatttcctccttaatgcaaatgaacgcataaggtatctagaaagcgttaatttgtgagggaacaaattaaagcggttagaattgctgtggagctgtatatgatagatgaaatattttaattgaagacacaaatagttctaatatttctaatgagaaagtgtgtagatcatttaatgtcgtaggagaccaaagtagaaatttggaaaaagtaaaaatgactcctaaattacccagcaagttgtaaagatacacctttctcagcatgcattctcatgatagcataacaatgtataatatatctgattactgtcataattgactaccttgaaagataatggttctaagggtcaataaaatacacaataagaaagatttaattaatgtgatcaaggtaggctaaaaataatatttgttcatctgagtattaagattttttagttttaggagttctattttaaatataccatagttgggggaaaaatgatgcttttgccttgaaagcactagcagaatagattagtgtcacagatagtgtg

SEQ ID NO: 79618 - DNA, 1035 bp, Homo sapiens
tataaaaattgtttttattttgtgaagagtttatatttcaatagtctgtccatagaaatataaggggggggaaggcatattaaattaagttttgttgttgataatttcattgagtcatttttgtctgttatctttgttctatcagttcttgcattgcagaaagcttatcttgtattcagtacaatgatcaatttaattggctctgcagtgtctaggatgaggttgcttggccaggatatatttggcagtgtgaggaaggcaagcttctatgttgattataacactgccttgtcaccattgtgttctttctaagcacagacacagcttggtcccctggcagtgatatacagcaaacgtcaataacaacctttgtaaatgttaaataaaagagcaaattgaagggcagtgattcattaggaaagaattttgtctgagcaaattaactcttatttctgttaacccatgttaaagaatcactgactgtctcttgagactttggatgcagttgaactagaaactatacagatgaaggtcctcttttccctttagtgggtgctttggatcagcagtatgtgctcttcatttgaaatatctttttttttctttttttgatatactttgacatcttaccaatttgattaagcttcagacagtgctgttacccttaacttgcctcccagttaacagaaaccttctgaacttgcctgtggaaaaatttttaccatttttcagttagtggttgcgttttcagttttagatttttcagttagtggttgcattgtgcatatatgtgttacttcttcagacctacttgtctaaagtagccagtatattttcagatttttatgtctaatgtgattttcttttccagtttttcttgtcttgtttaaccagtgtaaaggcaatctaagtgtctttagagttagctagaattccagaaactgatttttaattctttcactagccatacttgaatttccatatctgtgtatgtacacacttgcctgaagatattttattttttccttaagatag

SEQ ID NO: 79619 - DNA, 3032 bp, Homo sapiens
tcaggaggagaaaattgcactgagctaagattgcgccactacattccagcttggttgacagagtgagaccccatctcaaaaaaaacaaagcatctgattttttaaattgagacctcaacagtccatagtaatttgtcataagtacagtgtttttcttccagaggtgcttctttgttgaatcatccttataaagttattagcaaaaatttggttgagccttctacttgcattataaaaccaaaaaggtaactgaatttttcagatttcataatctctactctccatcctctccagtataacatgctctgtgtcagtcctattggagaatcatttctcatgcatattgctttaagaaacaaaaaactaaaacccttcctttaatctacatattggaaaaacctcagttgctgaagttaaatatgtttctctgataatgtcagtctttggctccttagttagattccatctttctgtcattgatgtgccctaaaccagcctgcatctaccaatcttggtttactaccaatcttgctttattatctgatctcccttaatatctggtctccccagtgattctcaaaaggtcacagtgaggatctctatgctacatgttaatgtttaatggaaattttctatgacaaggcagtacacagaaactataagattatcaagattctttgtaattggccataattttatctgtccaatgtggctattttgtgtcttgggaacatgggtagggtcctttcttaatggaaacaaatcaaaacaataaatatatattctttcttactcttcacttgtactttttttttcttttctttttttttttttggagagagagagtcttgctctgttgcccaggctgaagtgcagtggcgtgatctcagctcactgcaacctccacctcctggattcaagaaattctcctcccttagcctcctgagtagctgggattacacgcacccaccaccacacctggctaatttttgtatgtttagtagagacagggtttcaccacgttggccaggctggtctcgaactcctgaccttaggtgatccattcatcttggcctcccaaagtgctgggattacaggtgtgagccaccttgcctggcccgcttgtactctttcttctttttttttattcatacatccagtaaatatttataaaacaattacaatatacaagaagttctgctaaactttgaggagacaaaaatggttaatattttcatcattaatagtttttggtcattcatagttcacacaagtaaaggcaacctataatagagtagcgtttatcatataaataccatcaccgtttatatagaaaattttttcatctccttacatttcaggattctgagtatcttcccagtgcttcctgcaccgatttaaacaaagtgagtcctgttactgagtttgagaatgagttgaccatttgtgaaatgttgagtgaatgagtgtgagtatatagtaatcaatagtaaaaactatttacctaataattcaaattagtcactcccagtgaaagtgtaagaatagatacagagaactctttctagaggttatggtgccccataggaagagctgtccctacttattcttcactattacgtcggttgatgagttaattggcatgtagggtcctgttttgatcactgttagaattctcgggcgagccatctaatgggatgaaacacacattttttgcttgtttgttttaacatttaaatactgtccctggacatcggaatatctaattctgaaatgagaacaattttatgagcttaccaaattcatttaacagtaatgttcttttttaaaaagggggatataatgttcatggatgcaactccattgttcctgagatgatccatgactgactcatttggaggggatcccttggagttctgtgcagttgtacataactcatttggctgtcttcagtatattttcattatatgtatgtccgcttcaagtgtgggctgttagtaagtccattttcttttatactaatgataggtatatactgattttcctactgtacatctataaacatgtaattgtactcctttttcgctaatcagatgacgagaaacaggtagctttattaagctctcaagttagaatcaagatcatgtttaacttctaccgcatttgacaaaggaaaaaggaggtcccatttcgttaagaaccttcatttatcctaggcaccacgcaaagtgcttttgctctgttcatttaatcttcataacactatgtgagaagtttgccattttttaaaatatttagaattcagtggggttttttggttccttctcagtaaccacaattctgctctgtacttcagtgtttttaataatagttttattgaaatatatcacatataataaaatcacccttttaaagtatacaattcaagggtttttagtatatttagagttgtgcaaccatcaccactaatttctgaacattttggttaccccatgaggaaaccccgtacctattagaagtcaattcctatttcctccttcacccatctcctagcaacagtttgtctttctctctgtatagatttgcctattctggatattgcatataaatagaaacacataatatgtggtcttttgtgactgactctttttacttagcgtattttcaggattcatctgtgttatgttacataatcaatatttcatttctttttatagctgaataatattccattgtatggatataccattttttatttatctgttcatcagttgactgagatttggagtacttctactctttggctattatgaataatattgctgtgtatttgctgtacaagtttttgtatggacgtattttcagttctcttgggtgtatacctaggagtggagttaccaggtaatataactctggtgtttaaccatttgaggaactgccaggctttttcccaaagtggctctgcaccattttacaatcccatcagcaacttatgaaggttccagtttcttcacatctttgccaacatgcgt

SEQ ID NO: 79620 - DNA, 1034 bp, Homo sapiens
ttttatttgcaattcagttttagctaggttattttagaaggatgcaaagcctttttatccttcatacaagattaccaactaccatttttactttcatcctcctttgtttcatactattgtttaacagttgttttgtgtaggatacaagccttgcatgccaactttgatgtggcagaatgaatcatgttaccattgatctgagcctgaacagaatagccatcttcaaataggaagaagtttctagcttcaggttgttttagcactgcgtgccttgcttagcctgccgtgtaaagtcagttgcctcactcgaaacaaccctgtattaatatgcacaacatgaccattttcagtagaaggttattagaatgctagtttgtatcctctagtgaatgaaatgatgtgtgattatgaagtcatcaggcatggaccagtaagactccagagagcctgccccctccgaggtcctcagggtgccattgattggtggccatgtgtttgtgcccgatagactgtgaaatggtgtgttgctacacggctgtgttgcacctgcgccccaccgaggtgattgattggtttggtcatgtggaatgttcccatctggtctgcagtaatgtgtttttttttttttttcccatctgtgaatagcaagtgctggctgaatagttacagcaaacagtttcagaagctaaataatccttttcctctaagaacaaattgggatatgaaggagtttgtttttgcttaccttgccttttgtaaaggtagtcattctccatcaggttcctactccttctgtctaggatgttatgtgcttttctctttttacctatttttacctcctcttcataatagattacgctttctgtatttctaatttgtgcaagtttaaagcaaaatctgttcttttttgctgtttgttgttttgatatgccacttgaagtgatttgcaattttttaaaagatagtttctgtgatcataattggattatcagagtactgatgtatttttaagctttcacttaacctcacaagag

SEQ ID NO: 79621 - DNA, 1403 bp, Homo sapiens
tgccttatttttttaatgaagcaccattagattttagcaattatgagacaactgtagaaagaaaacaaacatgaaaattcaaatcattcattattttgccagaaatggcttatatgaatcagatacaattaagacttcaagatttaaatttgctcataccatggaaaactgatgccattaattttttttttcctctctcttaaatcttgcccagtggatcactgtcaagaggttggagcttactgtaattgaaaatcacttgcttagggaaaaaaatctaattataaaatgtacagtttgagggtttttgtgtttttttttttttgaatagctgtgcacccccacattcctcctccttttcctgtactgtttcctgtttttgtcatggatattaactgaaatgctctaaacacaataaagctgtttatgtcagttttttggatgactgcaagtgctgattataacaagtttaaggaatttcctttgttgaatgtgtacccatgccatatggctcaacatggaacattaacttgacagggataatggattgtggtatatggagacaattttgcctgcagctttactataactcattctggttggggatcacaggtttgtagtatgggatgcaacaaacatccagatggatttactttacataaaagagttgcatttatttttatttccttcctgtaattggaaaaagaactttttttaaaagaatcaaaatattaaaaagtaaacgaagggaaaattgttcaaatgaaaacatgtattctgagcagtttttttggtaaaatgctatgaaagagactatttttgtatatttagcacattaaagtcatggtgtatataagctgatactgcttttgtctttacggtagtatccaaaatgaattttcctctcaagattagaaagttgtctgtatcaaccttaaaggtgtttcaggtttgtagacataaatgatcaagcagtgtcaattatgaaattattttagtaatgcttattaaatagtagccctctctgagatgaattggatttgtaagatttgagatagaaaagctttttaaaaaagtatccagtttttctttaactgcagtatatcacatataatagaagaaaaggtttgttatttcgccaagcagtaataaagttgctgactgttggcttcttggttttatatgtatccctgtgaaagttactcttaatttatctggtgggaataagaaaactaaaagccactttggcagaatgatcatgtaaccaaaggctagttacctagaatgcttaaatacattgttgttaagaactgacatctattctagctgtgttagagggggaaaaaatctggattttttttttttcatgaaatgggcttgtaatgctaaaaaaaactagctga

SEQ ID NO: 79622 - DNA, 1066 bp, Homo sapiens
actaaaagagtatatttggactgattatatgtaacataaagtataaatgcttgaggtgatggataccgcatttaccctgacatcattattatgcattgcctacctttaccaaaatacttgatgtatcccataaatatatacacctattacgtgcccccccccaccaaaaaaaaaaaaaaaagaagtaaagctaatgcatgattctgaacttggtccttttgttaaaggacattattgagacatttggtaaaattcaaacagggtctgaagatagtaatgtataaatgttaattagatgattctgatggttctgtcatgcttatttgtacagtacacatcagcacatacacaccgaagtattttgtgggtggtagagcatcgtgtctgctgcttattctcaaaaataactaaggggaggaagtttcatttactaacaacttttatgtaagcttgggacattttaaaaattaaaccgaaacagcaacaaaaaaggattgttttgaacctgaatgtggaaatctcaatgtcagaatatttaaaaaatggattttgtgttccatgtatagagaaggaaaaaaatcttttaggttttaagctgggttgtaggttttctgactggggccctgtacatttgtgtggcaataggttaacaagagaaaggcagacagaggtttattcacatgtgcattgcctatacacatgagtgtacccagagacgagttactcaaaagactgtttaaaatttggagtttgtatacctaacttggtagaagaaagagagggaaaagtcagggcacttatggtaagcaaatgactttttgtaaaaataaatgggtctttaggataatagattggagataggctactttgtgacagtgtctctctgggtgtggtgcttacttctgtctccagtaagagagattagagttgctcctggggagggtttttttgacaattgagttcttttaggaggctctgcttttaggcagataaggatttcagaaactgaaatgccttcagcacaaaataattcttatgccaaagtgtaatattttaggatagcata

SEQ ID NO: 79623 - DNA, 1070 bp, Homo sapiens
gacaaaatacaagtttacaaaaattgttttttcaaaaaatgctcaaatggccaggcacagtggctcatgcctgtattcccaacacttgggaggctgaggtgggtggatcacttgagtctaggagttcgagaccagcctgggtgacgtggcaaaaaaaaaaaaaaaaaatacaaaatttagctgggcatggtggtgtgcacctgtggtcccagctactcaggaggttgaggtgagaggatagcttgagcctggaggtagaggttgcagtgagccaggactgtgccactgcactgcagcctggttaacagaatgagacctcatctcaacaacaacagaaagctcaaatgtacttacaagcattataactaacaacaacgtgaccagttttcccacgtgagacgggtctaggtgtagtcttaaatctatgtttacattgccaggatatacaaatccctcggagaaagaacaggagtgctttaagatttttcagtataaattttactgttagttagcatatagtttgtcaaaatattttaatgaaatcagtgactttttaaattgaatataaaagtgtcaaaataaatgtaaatatgacgtagcttgcatagtgagagacagacctctaagaagcagtaaaatttaataatagcaattttcaccagtgtttttcatgccctgtggttatctgtagcatatatttagagtatatgtatgtgggcaagggttggggccaggaattaaagacctacacaacaaaatacatgatactgaatttggagaactggtcacaacatgccaaagaaaatagaagagaactaggaactggacattgtatttcataactgaaatgatgagaaagaactggaaaattgccagccttttaaccttttagaaatagctatgtgtgtagttagtacaggagatcattttcttagagcagtttgttctaaattcaaatatgtcagcagacttagtggaattcaaagtattttagaaataaaacatctaatgttggaaataagagagcacaatatcataaaaacagaggtagtttaacaaagtttttagat

SEQ ID NO: 79624 - DNA, 1033 bp, Homo sapiens
accacaacctctgcctcctgggttcaaatgattctcttgcctcagcttctcgagtagctgggctaacaggcgtgtgccaccacacttggctaatttttgtatttatagtagagatgaggtttcaccattttggccacgctggtcttgaactcctgacctcaggttatccgcccgcctcggcctcccaaagtgctgggattgcaggcgtgagccactgccccccaccacagcaagaattcttacatgttgctgggaagaatataaatgggcgtggtgacttctgagaataataaggcaatcaatgcctataaagctgaaagttcgcatcctttaatctaccagtttcccttctttgtgtctatcctgaaggaatgtatgtctgtgtgtgtgtgtgtgtgtgtgtgtgtgtgcgtacacgagatgtgcaaggatatttgtttcaatattgctcatgacaaaaaaatataaaaactatctttccgtagggaaatatataaactggttttatttgtataatggaatattgtatagcagtaaagatgctcaaactagggatctgttatcaacacacagctcaaaaacataatatatggaaatacaggtttcaagataaaaaccatgtaattccatctgtttaaatatattaaatgcaaacagtaatgtatattgttcgagaacatgaatatatatttaagagtataaaacatacatggtaatcatgcacatcattattatgataatggttatccagaggtgtggtttgagctatgtctatactgtattaatttttttttttttttgaggcggagtcttgttctgtcacccaggctagagtgcagtgttgtgatcttggctcactgcaacctccgcctcctgggttcaagtgattctcctgcctcagcctcctgagtagctgggactacaggcgcataccaccatgcctggctaattttttgtatttttagtagagacagggtttcaccttgttagccaggattgtcttgatctccttacctcgtgatccgcccgcctt

SEQ ID NO: 79625 - DNA, 1009 bp, Homo sapiens
ccctgggcaacatagcaagaccctgtctctttaggggaagaaaacaaaacaaaaactaaaagacttctgcttatcaaaagacataggttaaaaaaaaaataaatcggtaagccacagtctagaagtccagtatttgcaaaacatatttaacaaaggactgatatacaggatatataaagcattccaggctgaggcaggaggattgtttgaggccaggagttcaaattgcctgggcaacttagcaagattcccatctctacaaaaaaatttaaaaattaactgcaggtggtggtgtgcccctgtagtcctagctactcaggaagctgatcactcaagtgattgaggggtatcacttgagcccaggagtttgaggttacagtgagctgtgatcatgctgcttcactccagcctgggtgacagagcgagatcttgtgtcttaaaaaaaagaattcctacaactctgtaaggttagctaaggcttctacagtttttctctttgtaacaggaggtttaagtacagtgaattagcaagtttccagtcccttctagacttatgttgtatggtaatgtcaagaacaagatcatttccactttgtaacaagattacactggcctgctgtttcgccaacaggattaattaaaactagttgtcttaaacagcaattttgatctttgtttatgtaacaacaaacctaatagtagcctcagtcttgggcagaattattagaaatgtaatatttagaacaagaaagttgatactgtattgtattctgagcaaacctgtttcagaacaggcataagtaaaccaactcattcagagaactaagaagttagttactcaaataacatgaagagcatcttttaagtgtttgaagcataattcgacttttctataactttgaaggttaaaaagttggacaataggtagaaattaagcattccagatttcagcttaattttaaaaagaaatgttgtcatgtgttgagctgttaatggcgtagaacattaa

SEQ ID NO: 79626 - DNA, 1010 bp, Homo sapiens
tttgtttttctgtttccccccttcttcctcccccaaattaatatattgtccaaagtgttcataatgacttggaactattcaggttgcacaaagcatttaatgaaatcttgtcttagacaaaacactagagaggatcataattaatgtctcattttctgccagttgctattgattactcattcaagatccctttgttctcagaatgataactgtagtttgcatcactatctaatgagattctcaggatagaattctttaacaacatgctgataattgctaacatatccctgaaatttcaatgtaaatgaatttgcatcataatacaattattttacaaatggcgatattttccaaatttgaaatgtgttagtttttttaatcatttgtagaaaattaacagaagactgacatattattaaagcccaacatttattttttgccctgagttgccctcacccttcgattttgatttgattatgacttggggtgagagacttctttatcattcttgggttactctgtcataatctctgaaacttcaaatggatttacagctaaaacacaatgatttttcgaaattagaacaacaactgcaaatatggtaatactataataattctccttttagaacaattttgtttcttgatccctcagtgacaaaagaaacacgtggtactatagcataaagaatctgcgaaatcataacagtttatgtattctgttataattgtgttttatacctttctattcctttaatttccacatactccctcccccaaaaaataaatcttttgaacagctgcttgcctttatgtatttaaaactgcataccacttcaggggtgtaagataggcttgaaattaaggaattctgtagaataataacacagcagaggttccatgaattcatatcagtattttaaatttttggagatatgtgactataacatatgaggtactctccatctaattttcttaaataaattaataggtagtacttccaaattttaa

SEQ ID NO: 79627 - DNA, 1069 bp, Homo sapiens
tcctgcctcagcctcctgagtggctgggactacaggcacccgccaccacgcccgcctaattttttgtatttttagtggagacagggtttcactgtgttagccaggatagtctcaatctcctgacctcgtgatccgcccgcctcggtctcccaaagtgctgggattacaggcgtgagccaccacgcctggccgatgctaataatttttgacctacggttaattaggcccttatttgatgtgaagttatgagtggcttggcgtttaagccaagccacttaataaaacccagttccgacaaagtaagcctgtttttcaacacttaattttccctttctgttttttttattttttattttttggtctcactgtgttcccccgactgacctcaaactccgaggcttaagcagtcctcctgcctcaccctaccaagtagctgtaactacaggtgcacatcactgtgcctagtttattttcccttttgagaataaagaatatccaaattatagcagtatgattctgaatcgcctcctagcttactgagcagcaccattttacataggatattcttctgcctccctacaaaatcatatttagagtaccttctaatataattaacaagagttcccattaaaaaaaggatgttggccaagtctacctactactttattcctttcatttactttttgtttattatcaccaccaaagcttacactcatcaagttcacatctggaaattaagctgtttcttacagatgaagagggagaaaaaacttaaaatacatgtatcacataggctgttaaagttccttatttttaaaaattggaaattttgttcacaggctagaggtttgtcatatgtaattcaaaatataacttacttattgtagattttatcccataacctagggcagtcatctaggctgcgttagtgttttgggggataaccctttattaattattctctagtattagatatatttttcacagagaaaaatgtctggatgactgtatctatattttagatatatgtatttctataaaagatagtctagatgactataaaaaagat

SEQ ID NO: 79628 - DNA, 1031 bp, Homo sapiens
caggagtttgagtccagtctggcccacatggtgaaaccccgtctctactaaacatacaaaaattaggcatggtggtgcgcgcctgtaatcccagctactcaggaggctgaggcatgagaatcgcttgaacacgggaggcagaggtcgcagtgagctgagatcttaccactacactccagcctgggcaaataagtgagactccatctcagaaaaaaaaaagaaaaaaaggccgacaatgtgagggtggagaaaaaaagagaaagtaggtatgggctgaaagcagtggtctaattgaattcaaaacgtacttaatgggtgcgttctaagttaagacattgctgaagttgtaaataattcagaagtgatgaaattttcaggtttgggtcagtatcagcaggaaaataacttgtttccttggccttattttatagtctagtctcctgagacaagatctggggcttgggagcccagcacagctatcttcttcaggaaaacctgggacagcatactattcattctctgctacaagttccaggaggagaccactccatgactctgcagcgcttggtgagtgtatcacacaacaaatcccatcccacatatgttgttgttgttttttcctcccataatctgtacttctggctatgcttttttttttttttctttccgtttctttgtttaagacagcgtctcactctgttacccatgcaggaatgcaacagcacaatcttggcttaccgcagtctcaacctcctgtgctcaagccgtcctcccacctcagcctcgcaagtagctgagactataggcatgtgccactgtgcctggctagttttttattttttgtagagacagggttttgccatgttgtccaggctgctctcgaactcctgatctcaagtgatctgcccacctcagcctcccagagtgctgggattacaggtgtgaaccaccgtgcccagccctgtctgtgcttttaattagaagagagttggattcgtgggtatcacattgatgtcagggcttatttgcac

SEQ ID NO: 79629 - DNA, 1090 bp, Homo sapiens
gttgttttctttcttgtattggttcatttgctgtcatcttcccaaatttatgggatatgtattttcagaatgtatcacttttttaggagaacctgtttttcactgggactagttaaaaggaatgaagccctcattactgtattttgctgcttactcccaaatattggaaaacaagaaagacgctaggggaaaagttattctgttaatttgaagtcttgatttttttctggtatattatgctgaagaaatgtattgttttccatctgcagatcccttgcaagcaaaaaaagtcagaaaggtgcctcctggtttgccttcttctgtaagtacctatctttttttaacttgatggtaaacaaactgatttcaagtgttccgtattaccttgctacaagggtacattcgattgatgcgagtgggcatactttacatagtaattgttcagtgcttaacaaaatcattgattgaggtaaatccacatttaatgtttggtttttagatttctctgcaatgatttgtagcttactcatatgctcttactccttgtccctgtcatttgaattcccctcttgggaagaggactaggccagtagctgtcaaagatgatctcctatgcaggtcttttgatgtttaattagtcattatgttgctgaacaggaggacagacagagattaatagctgaaaatcttagaaatttacatttgtaataatcccaatggagctaaagacattaagattcggagtacatgtttggctcagcttgcctcagtaggactgaggttattaatatgcataaatcaccaagtcagatgttcattgtgaagcccttgtgggttttaaagccttcattaagcctttcctaacttcagcctagcatcaggaaagctttcaagcaactagtttgttgatccctctttgctcaaaaatgtatcctttgagaataaagggctttgatgaagaaggttggaaaggtttggtggaacaatcattaatggccatgataatctaatactgtaggggcgactgtgctattaaatatactttattctttaaaggagtaaaagtacttgtaaaggaacctgcatcgta

SEQ ID NO: 79630 - DNA, 1078 bp, Homo sapiens
gtgctaaaattataacaaagccatccctggaggagattgtatattatttgaagggcatagccataaatgttttgttttccaggtgatgctgtattcaccatgaaatatctgacttgtagattaacttgcacattattgagaaaccaaaattgttattgagtaaattaaacaatgacaaagttaggtaagagttgttatctatcggtaggatgtcactgcttttctttattttgttttactattttgttcaagataaagttgatagggcagggagcagggagcagtggcccacgcttctaatactagcactttgggaggctgaggtgggaggattgcttgagcccaagagttcaagaccaggctgggcaacaaagtgagaccttgtgtcaattatactttaaaaataaaaagaaaaaagaaagattatggttttaaatgaacatattactaggcaatggagttatatataactagccttttagatacttcatttgctggcataaatgttattagaatacaaagcttttggactcttgtcttagaactgagaagttgtaattatgttttcaaattccttttttggttcagcctttcatttcctgtgagggtttagacttttaattatgcctcttgcaggtatgattataaaaatacaatttaaggctgggcatggtggcccatgcctgtaatctcagcactttgggaagtcgaggctggcagatcgcttgaggccaggagttcaagaccagcctggccaacatggcgaaaccctgtctctactaaaaatacaaaacttagcagggtgtggtagcacacgcctgtaatcccagctactctggaggcttaggcatgagaatggcttgagcccgggaggtggaggttgcagtgagccaagattgcaccagtgcactccagcctgggcaacaaagcaggactttgagacatacacacacacgcacacacacacaccacacacacacacacacacacacacacactttaagattggtgtggacacctggtatcatctatgccagtggatcacagcttgaatcttgaatcttgaatacaacaagat

SEQ ID NO: 79631 - DNA, 1044 bp, Homo sapiens
ggggaaggttcttttgctttgaatttgttcagttgcagattctctcactatcctcttaaatctatcctcacccctacctcccttgcagccaataatttattacttaccgagttcatcctttaggaaaatatagtgttcattcgtggagttattcatgtgtcagcttttaagtttggcttcatttattactctgaaagtctgttttccaagatttgattcacttagaaataatgttgaaacttttcgtgaggaatattatgagtgggttttaggtttacttttccagccagatcttctggcttttgggacagtggaatgttgcctgtttgttttagaagaatatacagtaagattaaccactaactggcctatgttaactaattcaagatacataattcacttcaattaaaaattttctttccaaaactatttagaattttgtgttacctttagaaacattcttgcttacggatcatttaaaaatagctataactgttgtagtgatccaaatatcaggataaaaatgagctaataaagtagataaaaatactgcgtggataactctaagaaattttatatagctctccaaggaagatctgtttcccaatcaacagaaaagtaagatggaagagggaaattttgcctggaagcctggaatttaaactgaagtttccagagagctcttacttggtagactttttgaaaacatcttttcctatatcgtcagtaaagaagtaacttgtttaggcaaagcacgttatggctttttcttgcctagtttaggtctgtgcttaatgactactggaatagcagcaaacataacatcctgataacatttgggaggaaaagccatatttgaaaattggtgaaatgcaataatctttaaaccaggaatcatcagtttgctaataaaaggtatatggctccaagttacgtattttgtcagggtcctctggcattttcactagtcattttgctagtgtgtacaatgattcctatcttgctgtaaaacttggtgatttttttatattgttgaactaggtg

SEQ ID NO: 79632 - DNA, 1025 bp, Homo sapiens
gcaaccttcgcctcccgggttcaagcgattctcccgcctcagcctcccgagtagctgggattacaggcacccgccaccatgcccagctaatttttgtatttttagtagagacgcggttttatcatgttggccaggctggtctcgaactcctgacctcaggtgatccacccgcctcggcctcccaaaatgctggaattacaggcatgagccaccgcgcccagcctagattgtagatttctttagaagtagtgtcagtaaagtcctgtctgctacatagctactcaatagttgttggctttcattttatttttaagatagtgtagaaaataaacttgagtttctgagttgttattagcctgatatctttactagcaatgagcttgaaagtacatttgtttttatgttttcgtatattgtgaacaaatccttacataaaatatgtatatacacacatatgtattgagaattatttgatgctttgtagatggaaggaaaagatgaaagtcatctaggatattcataaaaataacaagtatgaagctctggtaatgattagggaagcagtcagctagtaagggccgtatttcctgtttagagtttcaggtccagagcctgacttctctgggataccatctgtttccaatcaaactagaattttgaccttgtgtggattcatgaaataaatcactattttttaaaagaatgcatttatacattttccaaagaatgcactgtacttctggttgatttatagcaagcacatgactaggtgttttaaaataatacttttttgttttgctaaacaagagttctattctttaaattaattacctaatgttaataatttactgtgtttctacaaaaaaatctataagccagaggattttatatattctaaaaaaaaaagagtaaactcggaaagtttcaataggagctatctttgtaagatacttgataaatattattaaaaggtacactaatgaataacagtgttggtttatgtcagaaactcagtgttttccttc

SEQ ID NO: 79633 - DNA, 1665 bp, Homo sapiens
atttttaaagtatggataatcacaccatgctttaactttgtcttatctgaatgtgactagataaaaagaaaaactatcttctttagcaaaacctctgcttctttgcattttttctcaataacagaaagtcattacgcctccctgcctcacaagaatgtttccagtgttaattacaggaaagatgtattgaaatcgagagcacagtgcacagctccagcctctagagctgaacagagtgtatgccttgaatttggggttatccatatgactaaactgaatcatctgagcaggaaaaaagggatctgtctttgccagtttgactcaaatttgttgtatgaactaaaacattttaaggataattatgtaatcactgtgaagagtaactgtaaatattcatcccaaagtatactatccctttttaaaagttgctttacggtgagtgtgatgaggacatgcaagatatgatttatgtgattgcgttgttttcaacagacttaatagtgaaggggaggtatctgttagattttctattttattcttccaagttagaactgtctgttcaccacacattcaaaatttttcttaacaccattcttagaggggaaagtataagtgcttgggaaaagagttggtcccatggtagctactgtgagcttggcattctgaaaaggaggatagaattctaaagaaaatatctaccacattttaatagaacatcttaaattacttaattttaccctttttctattctctttaaaatagtttgactcctggtagattttaattatcttaaagcatatatattcctttctcttaattttaagatcgactgtcatgatacaaaatcatccttcagatttaaaccaatgattagatcattaactaggggaaaaaaactggcatctatgttcaggtgatcagatgacataagcagtctgattttaatttgtggccagtactgattgtaaccaagagagacttgctctttttgtggaattggctgactatttccctacatctggagttaataaagcctttgagaccacatcagttgtgctttgccgcaagaagtctttgatctgaaaaatcaagactggcacaactgctgcttcataacattgcatctatgtttttgcaagctatagttaagataccaaaagtaaagttatttagcttatttagcctgtgttagaaatgctggtaaatgtacctctttgaaagccatatatttcaaaacattcttatgatgaaaattttgaactcgtgttaatacaaaaatgatatagtaggatttttttttgccattttcatttataaggtctgtcctttaaaagtccattgttttcaaaatctgtttgaaagaaatagcattaaaaacaaactttacctctaaaatgtgccattttctccatacaacttcaaaatttttgcgtaagggaaggcaagtctctttctgtgctttgtgtggtttatcttagttttcttgctctccatgacaaccgtgaataaaccattttctgatcagcatattctcttttatttagcagcgatttgtaaatcaggaaagtttatcctttgacttccttctgtaattgtaaccattttcaaaatttaaaaatgtaagtatattagtgtgtgaaatacagcgaattgaatgggaataag

SEQ ID NO: 79634 - DNA, 1026 bp, Homo sapiens
gtgcctttgatagttaccccttaatagtaacaaagatagcaatgtttaatcaaactcatgttgattttatttggtgaatcttgtaacactgaaaagaatgaattttatgaacccagattttatgttatgctatattgaaaggacatttgtttgctcgatcagattttgaatcctgagcctatgtgaggtttgtgtttggtaagccagctcaatgcttattcagtcacttggtgtaactgtcataccaagatgcattacagagatatttagagtagtagttttccctaataaccagcttaaaaaaaaaaaacatgtggatggtaattaagtttgacattatttatgtggatttaggcagtattcttttcatttgtggtagccctttataaaaattagataggcctttttaagccccttacagaatatagaactcattttacataagtaatatgatagtcatttacattttaattaaatgtgctgtttaattttaaggtatatgcaccatccccaaattcagatgatttcaaccgtgaatctcctagttatccatctcctaagccaccaaccagtatgttcgctagcactttctttatgcaaggtaagtactaccaaacaattgccaaatactactgcagtcatctgtatatcagccagtattttaaagtattaggaaagagaatacctatattcaggccttatttaggcattttttttggctaaattaaaatttagctttataattttccagtggtgtttattgctgactgcaatttaattgaattatctagcaaaccattggagtgctggtccagtattgattgaatttataaaggtcttaaattgagaaaaattaatagagctgttcttgctcattttagaattgaaatgtatgaaaactgttaactctagtttcttgtttaatttatggattcatatcatgcctagaattaccaatataaagaaagagtgaatatcatagaacagagtaagacttgttaagagagaaaaagtgttgcatttcct

SEQ ID NO: 79635 - DNA, 1029 bp, Homo sapiens
gatgaggagaaggaaattaatgaggattacttttgagagtctgacatgcatatcataattttatgtcaggtattatagatattttgaaatggtgactgactcttttgaaattttaagttctttagaatgtgacgcttttaatatagcctctggttttagatggagaaacactatgctattgtcattaaaaattaattctatttccccaattgtctaatatatgtcttaaaagatctttcatattgtgaaacatcagagggtacaacctttgttcttcagtttaggtattaaagagcacacagaatactgtgtgattaaacatgtaaggccagataatgcatttgcaaaggttcctttattttaggtttaagcctgcataattgtggtcttaatctcaggatagcaagaaagagaattgtacatgaaagtatttacacaaagttcccaaagccctgtggattatgcattagtttagataaaaaaaaagaaaaaaaaaaaacctagggtagatagaaggaaaggaaaatctgggtattcgtgccatttctaatgtgtttccctgaacatttgccagacaataaccctttaagattgtgcccgtggagagttatatagaggaagaaacatctggtttctttcggtgcctaataccatatcaaaacacttggtctttaatttagaggagatcaaacaagaagactgtttaactttgttgattatatcagacttctttgtgataatttatgttttgatttctacctcagagcaagggaaaaagagagagagagagtgtgtgtgtgtgtgtgtgtgtgtatatgtatgtgtgtattaatctggataaatggtcagtagtctctaacaaaagaaaagaaaattcagggaagttgatgtttaaaagtaattcatgaaataactttctttgttccttagactcaataacattagcataataaagattaactgaaatgtgcactgtagtgtttaaaaaattgggctcacagttccggggttgggcttgggagcagtcca

SEQ ID NO: 79636 - DNA, 1037 bp, Homo sapiens
tctcatatattttgcaagcaattataagcaatgtgtgctgtttagatgctaaccttgtaacttccctgttgaatcccagccttttcatatcttaataaaatagatctcgcaagtcttggcgttaactttactaacatgttatgctgacatgcatatcagctatttcctcatctcttttggagttaatcttaacctgtgctttgcctcctgttctgtcttgactttgccagaaaaatcgagttgagcagcaacttcacgagcatttgcaagatgcaatgtccttcttaaaggatgtctgtgaggtactatttcttttagatggtgccttttttgtgtttcaattaattatacttcccactattcatttaaaatctttaagctgtacagactcccatctttaaaaatcaaacagttgactgtttcagtttttatcacagtatataggaataattttgtctcttatgttgttgaaagtgatcctttttaaaacagctctactggcatgtgcttttgatttttttaattctaatatgtttgtgtatggggcatgtgtgtatccacagacagacaataccatttatttagttttgtcaaagaacatatctggatatgttcaccatataagttacatgtgctttatatacttaagacaaaattaaaacttaaacttactggatttgaggtcccttccccaaattgccatcattcaaagatcagtattaaagtataggttgtactttttttttttttttttttttggcagctcttattgagaaatgacatagtatccttcattttttgtagaagctaaaagaaataacctcatggtagtttggtaaattcgttttataaagcagtgatttgtttctgaagctttgaaaatttagcataatctacatacatacagcctttttttgttgttgatttatagttcaggtggttgcttttgaagctacttgatactgcatttcacttgctatcttccacatatcacatagtaggaaacgtagcagttaatgaatctaacagatgccagc

SEQ ID NO: 79637 - DNA, 1573 bp, Homo sapiens
atacagcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggtaaaatcatgctcatcttttttgtagtaaaccctaaagattcttgtcctaaatgtctttaatgaaatctttgggaagaggatctttctgaaaggaaggcaaagactgacttttcagaattttctttactgtctttggcagtaaagtattggctaagtattagtccataaaatcttcttgtgaccttgtgcaaaaagcataagctttctacagagatcatttttagctaaaacttggatttttttccagatgtgtaataattggcacagcagtttttgccttgaaatagtgcataagaaatctgaatagcaagagttctgatctagaaaagttgtttattgtaatttagaaccagccttcagtggtagaaagaatgtgaaactgtaatttatacagatccaaatttaaactttattcccgaactgcgggggaggtagttttaagaatggctgtaatttcagtaataaataaaggaaacaattttagattaatccacaaagagaatttttaagaactcagtccatcttttaaaaaagtatgataatttttaaagggggtgttcgttctacagccatacacatcaaaaattctgtgtttaccatcttacattattttttatccaaattatcttttaaagaaatgaagttctttttgaacctgctattttaaacttataccatgtgttggcatgtttatggcatggtttttaaggttcattgcatgctgtgaaatgttcttctacgaagcagatttttagctataagccatgtgatgaaggctaaaaacttacctatcatcaaaataattaattgccctaaatgctgaaggcttgtattctgtaagatagggttggttccagattttcacactcacatatcttacacatacatacactcatttttgagcctctgaagtaaacgtcacacaaggctgcttgttttctgagaactgtattttcagcagcatgggtaacattagatacctgttttgtgtttgtttttttaatgtcaggaaatcttgaaaatcagtctccttttaaagtactttttattgctattgataagctaataagtgtcaaaacatatgtaagttattaaactagtaaaatggggaagtgtcagatggctcacacctgtaatctcagcactttgggaggccaaggcgggaggattggttggagttccaagactagtctgggcaacaaagtgagaccctcatctctacaaaaaataaaaaaaaattagtctggcacagtggcatgcgcctgtggtcccagctacatggaaggtttaggtgggaggatctcttgatcccaggaggtcaaggctgcagtgagccatgttcatgctactgcactcca

SEQ ID NO: 79638 - DNA, 1176 bp, Homo sapiens
attggccaggctggtctcaaactcctgaccttgtgatccgcccacctcggcctcccaaagtgctgggattacaggtgtgagccactgcacccggccagagatattcgtaaaaagaaaaaaaaaatctcaaattagtctagaaaaaatggtcttctgagacatgaagtgagtctggcttagtctgagctgcaacattagtgccacagcaactagcccaagctgttgttcagtgtgtctgtcacagccttctcttcagtccttatcaccttctcagcgggtacagagctgtggaaaatctgccagaaatcatctgctatcttcatctcatccagacacaatcactagtacttttagtagtggagataagatgtatctggcaggcttagcctcaaaatataaagttactagctgacaaaatctgacactgttaggtgagtcagtattcatctcctgtccttctgaagtaagccttttagctgttgagtcctcagttctcagcttcagcaaaaagaccaaaggatggaatgaaatgaagattagtctgccactgactatccccgcagagtcttaggcatgttattgaggaagactgtcttatcgtggtggttcttttccgtgtctgagggcttccattagtactgctgggatcactttatttacatgctcagcacccacctatatggaatcaactcttcatattctttcagagtgtgtgattttgggggcatgtttttgtaactcttgccaactggctccaagagttaatctccagcttttattgtccccttgtcacaacaatacatcctcctaactaatcatgactaagaaataatgtggttttacattctggaatcgattccccacccccacccccaccccgccccaccttgtttttggtctcttataactttccagaagtttgtcgattttttccggaattaacataagttagtatttgttttgggctcctaataatggaggctatatggccagacttacaaagtgatcacagaaatacttgttgatcagcaatttggtaccaccatatagaattcatgaggtcagcttctttcaaagacatttgcctttcattattccatttgtttattgcagagaatagaagtattctgataaacgtagatattttcaggacctccacagagcattcagatgaca

SEQ ID NO: 79639 - DNA, 1070 bp, Homo sapiens
ctgactttctggtctgttatgggtactgactgtttcatacagttctgtaaagctctgtctaaggactctttgactgatgagagtttgaacagatttcaaatacactgaactgtaacttcgttagggattgctttgatattcagaaaagcctacttctccccggccttcagactgggcttgaagccttatcttaggactttacataaaagcccagggatctttgtaaggtaggggtgtgtgtgtgtgtgtgtgtgtgtgtgtgtgtgtgtacgtatgtagagatggtctcactgtgttgcccaggctggtcttgaaatcctggcctcaagcgtctataggcctgagccaccatgcctgggctcagactccttgaaggacactcttatggctgtcagatagggtttagaacccttcatacaggccacaatacctgtgccttgtctttggcaacaccttcagagttttgtatagccactgtcttttcctcgatttacctacagttttgagttattttggtgacttgatcacttttgagagcctcttcatcctgtacagagaccctccttagcagtccctgatccaacactttctataaaaacagcttttgtttacatgacctatttgggcatcctctgcactctggctccccttctgatttgggatgatgctgcaagactgtatctgattgtgacccaacctgtcacaatcactggatgcttatttttaccaggaggcaagcagacccaggtctagcagttcatcccagagaagagtggcttctcttctaagcctcagattttgccagagcattttttgtgccttgttgccccacctgtcaaaccctaagtccccactgccagtttaagcttttccattatcatgactacaacgttatttgtacctttgccatttttattccccagcagataaaacaaatgaccttcaagtttgtactctcagcgttactcaagactcagtggttaaacatttcctcctctcaagctctttcacaggtcagcttagtcaggtcactgttcttttgataatttagtgatgagagaactattaga

SEQ ID NO: 79640 - DNA, 1035 bp, Homo sapiens
tcttccacctcagcctcctgagtagctgggattacagacatacaccaccacgcccagctaatttttttgtatttttagtagagacagcgtttcgccaggctgcccagcctggtctcaaactcctgacctcaagcgatccgaccacctcggcttccccaagtgctggcgttacaggcgtgagccgctgagcccggccaaaaaattaactttgaagttttaaaataaaaccatgccactatttctcagtgcaaaagagactttctaaactgatagattatttcaaagaagagtgatgggagaggtaacttatgctcaggtcccagataaccaccaagctgtgaaaaagagcactaggcattctgccctaacacttctcttggagcctgtgtcttatttttcttgtctcgctctagttagttctacccatttcctcttgttttcttctcagtctctcttactcgttcaactttgtcttcttattctcatctcgtttccttctgtttacttcctgtgcttttactacttctctatttcatactgctctcatagctctacctttatctctttataatgtggaaattttcccacttaggttaaaattaaactttgggcattcccacctatcaaaaaaggatcaagaattcttttaagtttaaaaaggcatcaagatatgagacatgtagtgaatgcactttgttccatagattgtataggctagtgtttgtcatcttagaatatgtgttaaggttgctaatttcataaagatagttatctggtttcataaattggatagcagattaaaagtagcaagagacagggcagcaggaacaatgctactagaatcaaaatggctaagacatgaccacagaatgactggttataaacgtacaaaaatttgccatcctgtaatgtaggccaagtagctttgaatatcttagttttccgtccctaagagcattgctgtgtacctaaacaatactgtggttattgtttaataaggaagtaaaagttatgattctatctaaaactatttta

SEQ ID NO: 79641 - DNA, 1023 bp, Homo sapiens
tcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagccttta

SEQ ID NO: 79642 - DNA, 1077 bp, Homo sapiens
aatgtatacgtatttcaaaacactacgttgtacacaataaatacatacaacattttttgtcaattaaaaaaacgtttaggccgagcaccccagcattttgggaggctgaggcagaagaatcacttgaggtcaggagttcgagaccagcgtggccaacctggtgaaaccctgtctctaataaaaaatacaaaaattagctgggtatagcagcgtgcacctgtaatgccagctacttgggaggctgagacatgagaatcacctggactccagaggcagaggttgcagtgaacctggtccacagagcaagactgcactccagcctggcctacagagtgagactcagtctcaaaaaataaaaaacaacaacaaaaaaaaaacttttaaatctatttgatacaacataggctgggacttccaaaattttaaaaaccatcctaagttccttcagtcctagagttctttttcagttatcactgtttttggttctctggcttcttgatagtctccttggaagaaaaacaactgcatctttccctctaaaggcaagggccatctctatatctctgaagatctaaccttctgccacagttcgaatatgttggaaacgtaatcccccatgcaacagtgttgaggggggttgcctaataagaggtcatgagggctctcctcccaggctgttttgccctgccgccttccaccacggatgatgtagcacaagggccctcaacagatgccagcccctccgtcttgcactttccagcctctagaattataagaaataaatttctgttattcttttttaattactcagtctcaggtattctgtcatagcatcagaatacacactaagatacctgcctaggccatgaggaccccaagacacagcacaaattttgtacaaactctaaccagaccacctttttcctactcccagggtgaggtccttccttcccctgtcccttgcagccctatgggcttttttgctttctctcattctccgggccttctgcagctctatttcctgcaagattgcatcttttctcctggatatttggtcgtcgctgggctgaggtggca

SEQ ID NO: 79643 - DNA, 1039 bp, Homo sapiens
tgaagtatgaatgaatgtttaggtcaagacctaacacaactttatgaggggctgaaacccaaccaagcagctcaagtcagcaagaaagtacattctgctggaaatttatcttgcaaagaagtatgactgtcatttcctaccttttccttgagctcccagaatctaattcattgctaaggaaacagtgtaagtatgagaccttctgttcatcatctgtctcctactgaaggctattgtcccaggatctggataataaagctgtataaggtttttacaactgagggtagagcaaaggcaagaaaccaccatctcatgttaactgtgttaatagtctgtggcttgaatggagtctagatgtttaaagtctactaagtgtagaatgaacagtcatttttttttaaaggaaaaataaagttctttgataccctggactaatacataaaaaattgttatcttaatgatgtgacacagataacagttgtgagatagggattttcaacctgattggccagtattagtagaagagtgtgaatatgcctgttggtgagatgaaagaattatatgtagtggtattttcaagtctaattctcttccatatacaaaaataaaatgggtattgaaggcctttttaatggcaagggtggaaggaggggaggtagagtactacccttacattgtgccatagtcttaattcccttgctccagggttctaagtttgatgctcataaatcaaaagaaagaatgttgtaactgacatttctattgagttacttttaacttttgtacccttgggttttagcattgaggccttctgcaatggccaccggatacccactttattcagacaatgataatatcgttgagctatggtaagatcatttcctttggaacaaaatgaaaagctttcagtgttcacaattggaggaaaatgtaaaagcttagtaggcctcctctgctgcagggtgaagagtttgtgtttgaacaccatccactttgctcctcaaatgtgcagtggaatgattccagtgtgcttttgaaa

SEQ ID NO: 79644 - DNA, 1010 bp, Homo sapiens
gtgtgacagctattcgtttatgcagctccgtggtcatagaggaccccaaaaagcagacctcagtgtgtgtaaacgttcagagctgcaccaaggagagggtgggagaggaggcccttttcactagcgggaggcccctgactgcccacagcccacatgcccaccctgaaaccaagaaaaccaggccagatgttcttcccttccggcgacaggattcagcgggacccgtcctggatggagctcggtcccggaggtcctcctcgtcatccacaactcccacgtcagccaactctttgtacaggtttttactggatgatcaggaatgtgccatccatgccgacaacgtcaatcgtcatgaaaacagaaggtatattcccttcctgccaggaactggacgggatattgatacaggatcaattcctggtgtggatcagttaattgaaaaatttgatcaaaaacctgggcttcagagaagaggaaggtctgggaagcgaaacagaattaatacagatgacaggaaaagatccagaagcgtggatagcgcctttccttttggcctccaagggaactcggagtacctgattgaattcagtaggaacttgggcaagtcaagcgaacacctcctccggccttcccaggtgtgcccgcagcggccactgtctcaggagcgccgtgggaaacagagcgtgggccgcacctttgcaaagctgcagggagcagcgcacggggcttcatgtgcccactccaggcctccccagccgaacatagatgggaaagttctggaaaccgaaggtagtcaggaaagtacagtgatccgtgcgccctcccttggtgcacagagtaaaaaggaggaggaggtgaaaacagccaccgctacgctgatgttacagaaccgggcaacagcaacttcgcctgattctggtgccaagaaaatttccgtgaagacatttccttcggcctcaaatactcaggtaacactagtgcgattcctgtttggttttttttctcttcct

SEQ ID NO: 79645 - DNA, 1003 bp, Homo sapiens
aattaagatcattgtagatcattcttagtgtaagattcagatgtacagcatgtttgtgtgtgtgagagagatatacacatacgcacttcaaagaaaaggagaattctttttggaatggacatgagcatttgaatcaaacaacaaattactaaatgttcactgggtgtcttctccaagcttactgaggatgtgtttatgtgcctctcacatatttgcaagtgggaaccctgtcccaaattgagtggtaacacatcatttatttgaaaaaaaaaaaaaaaaaaaaagacaccatccatcctactctcacactgattttgtctgaggctttaattaattcacagctcctgcaaattatctccttaaaggacctgttgggtgtgtgtcatgacatataaattgttctgagaccagtggttgtgtccctcattgttttctctgctgtccctttttcagaagcactgataatgacgatgctactaaaaggaaagtcaacttggtctttgagaaaatccagaccttaaagtctcgagcagctgggagcgcccaaggaaataaccaagtaaatggaagttttgtattttgtagagtgcatttagcatggaatgtggtaaacaacttgctgtttcttcagtctgtatgtttgtttatagcagtaagtgggaagttgcctgagtagtgaggagtactcttcatgttttacatgttgcagcaacattttattgagacagagtctctgtcaccctggctggagtgtagtggtatgatcttggctcactgcaacctctgcctcctgagctcaagccatcctcctacctcagcctcccaagcagctggaactacaggcatgtgccaccacacccggctaatttttgtgtttttagtagggtgagggtttcaccatgttgctcaggctggtctcgaacgtctgggctcaagcaatccactcacgttggcctcccaaagtgctaggattacaggcgtaagccaccatgcttggcctttc

SEQ ID NO: 79646 - DNA, 1025 bp, Homo sapiens
aaagccaattttttttcccccaaaagaaacattcctctaatcactgaataaattcctgtgtatttggctgctgctgtccaaagaatttttttttttaatgtaaccaaagcctatagagactgtttgcttagacagagtaaaagaaaccctgttggatttaggcaggccaatgggaaactaaatgtatataaaacatctgaactaaatcatagaaatagcagaatgaggtttggctgtgtttgtgttttcttttacaagtattacagttcattaaatataaatgtttgatgttctttctagttaagaactcctgtgccttaattatatagtttgattaagttgtttaataatgtaagtgcaaagatatggagtctgcttgttgagaagtaggcttctgtggggttacgttaatgtacagtggaggctctttaaaatcacactgattcctgttagaatcaacagaacattaaagaagagagagagaggatgagagcaaacctagaagagctccgaagccaacacaacgaaaaggtggaggagaactccacattgcagcaacgactggaagaaagtgaaggggagctccggaagaatctggaggagtaagttctgggctgagagcctgttgcccttcccaggttctctatgacatgtagctagaaactttctgtccatttaatactacccagccttccaaatatttataaaggcagctggcttttccttttcttcctcttatctttgtaaaattatgaagctggcgacacatgtagactgataaacaaaaaggttagtaattcttaacattctttgtgcaccttgaagtatacgttacaaagtttcagtccttaaagtggacctcctagcaggtaagtgggaagcagggagcactgagcgctgatactgaaagacagagttcaaggagcctgggcccagcttctaaaaagcatgtgttacgtggcccccgtgagctctcagcctgtgcattttatcctcgatggtgctggtgtttgtgatgggtgctt

SEQ ID NO: 79647 - DNA, 1027 bp, Homo sapiens
tcaacaatctgaagaccaaccattagactgttttggcttttaatttataaattcaaattacttctcatgaaaatgaacaaatcttgtttgttaggagcagtatcatgatgttaatgttaatcttcgaaggagtaattttgcatctaagagttgcaagtattttgatgctgataaaacagccacttttatttttgtgccagataatatgacttttgggccattaggcactttcagagtgtccaacatacagcagttatgcaacaaatatctcccaagggaatggatgagggagaagaggagggaggttgaagacatgtgagatactcttgccatccttcatttctccgtttgcattatttttaaatacagcaccttacaaactgatttactgagcaactgccaagtacagggcatcgtgctaagttcgtgaggactatacatataaatcaggtggaatttacccttccaggagattgaaggggagatatgtaactctcaagctgattatagacaagagtaaatgacccaggtgaagtggagataaaatcatataggaatccctataggagaccccatggctgtgcttaggaggaggactgctggcaatcacgaaagattttagggaggggacagtatttgagttggattttgagtgatgtttgggcatgcgggctgaggacattttgggtactgagtacagcatgagcaataccttgtaggtgggaaagtgagatgtctgggctgggctttgtggagaaaatgaagttaaggtggctacagattcagagacttaaggggcgggtgcagagatccaatgagtggaccgtgctcggatcccaactgaaacaaactgactgtaaaaaacaaaaatagctaaaatcattgggaacgttttaacactctatattaatgatattaagaaactaaacaatttttaaggggtgataatagtgctattgtttttaagagtctctgtcttttttttttttttttttttgagatggagtctgactcttgttgcccaggc

SEQ ID NO: 79648 - DNA, 1048 bp, Homo sapiens
tcttggctcactgcaacctctggcttccaggttcaagtgattctcctgccttgagtagctgggattacatgcttgtgccaccacacctggctaatttttgtatttttagtagaggcggggtttcaccatattggccaagctggtctgaaactcctgacctcaagtgatctgcctgtcttggcctcccaaagtgctgggattacaggcgtgagccaccgtacctggcctacatggcttttcttattatgtaacttctcagagtctttaatatgtgggttaatgtaaattgtgattctctgagaaaggactcgaccacaagaattttccacagtgtgaccgggccgcaaatcttttttcaaagaatcttccacaatatttcattccatagcatacttctggggaaatactgcattacataattgattcttttttgggtactttccacagatagttgtagatattataccaaggtctgtaattgggaatgggcctgacccagtacaaagaggaatgtgtttgacacagggtttgaattgaagccttgggcagatcagatggaataggtagactgaattcaatttaggaaggttttggaggccaggctgaggggagtttggatgcattttgttgtgtgttgggagtcgttctgggctctgagctgtgtcatggtggaagtaccatcttggctaggtcattctggaagatacctggtaaatgggttgggtggtgaggtgtgtattggagttgggcagccttgctttctagcagtgactggatgagaacctgggtgtggggagtgggaatggggagtgaatctttggggttgagaaggaagtgtgagatgttttccttcatacccttttcctttggtgggtggccactgtcaacagctgaaaacaagagaggctcttctgtgtttttctgaggccagataagcataaggagacccttgcggcccgtgggttcctgtgcagcactggcagagaggccgtgtgttgggaatggtgctgccattgtcagggagtgggagaggaattacttacgttaa

SEQ ID NO: 79649 - DNA, 1033 bp, Homo sapiens
ttgtggttcaggagaaagagccaggcagccctgcctgagccaagagtggagcagaaatgcatgcacgaaccacatggaggctgagtagagctgggttggcttgtctgctgcctggagcccttgggattggggtctaagaggaggagaaaggctgggggattcctttggggagggggttgagttggatcctgaaggttctacaggaagccattgggggccctctgtatttgttgttttcacagattgacgttttttgggacatgtgttttgagggttttgtcccataccatacctcactggttctataactcctcctcaccctttgccccaacactgctaaatcatcgatcaacagaaaccccaggtttgaccctgcttctggtgggtgcccagcagcagctgtgctggagcacactactgctaattcccccccacactgaacttctgattacctttctttttgccaccatcttttccccagcagcttttgttaaccttggttctctgcagcaattaacttcagcaggtcggccacgttggctgcttctcaaagtgcagccagcccaacagagcccagggaccggaaggccgctatgggtcgtgttttagccccacatcacatggttggcagagcagatctgttcctatgctctgcaaaccaggagagtccgaagtgatttggaatgttttcaagatcctgagttactgcctgtggcagcagcttgtaaactgttaagcactgtacaaatataaaccattgttcttgtgcagtcactgcagggacacaagactgggtaggccctgagctgtttctgtagtggcccagtcagccctcggtgcctgacaacgttttcgagatgatccagtctgtgtttgagtcaggttgctctgttccgagttgtgcgtcttcttattatccttgtacctatggccctaatgcttagccatttaaagaagccaccataactttcctataatattttaggattttattctggagttgcatgttgtttacataaagaacataagtctg

SEQ ID NO: 79650 - DNA, 1003 bp, Homo sapiens
ttcactctgatttattttacatttccattttaatagccatcttttaaggggctatggtgggggataaataattcctttttttgcccccctttggagagtcaccattatcctggggctctccaggggccctccagggaggtcttgaacctgtggggacccttggggatgctgccatgctaagtgctgctctgcacagggaagtctgtttcctggtgggatccagatttttcagacattggcactgagggtgcaagactgtggccagtggctgctgctttatgtggcaggatttgtcctgaacccccaggctgggcccagggctgcgtgaccacttggccatcctggaatccctccatgcgctctctgcactctgcctcactccaccatagacacgttctccttctgggctccacagtcccggtctaaactctccttgtgggtcttcttcctttattgagagtcctaggtcctacaggtttgcgaagacacaacggggaggggaaaaaagagtgtatgagtttttgtcagaaaacctaggttggaatcccaaagctgcttccacctaactctgactcagaagctgtttctggacctcccacctggaaactcagggtgataacatctgcctcggagagttcccgcccagcgcccagcttgaggggctcttgattcttggtgtttcccctctgggtctcctggccgggagcacagctgcagagcgatgcctgcctctgctctgctggccgtttattgtcttctggtatttttcaggcgcacactccacagcaactagatttctttgtctctctacaagccttcagtttttctttatcccttcacttttcggaaaataatctaccttccgtccctttcttgcctctaccttccctttgagctacaggctcctgccttccaccaagccctggaggatcctcttcctctccccacccacattctgaccccaagacagggctggatcctgtccctccacttgctgggtggc

SEQ ID NO: 79651 - DNA, 1588 bp, Homo sapiens
aaataataaaagtaagggtgtagttgctctgccttcctcacaggctacgaggatcaggacagatcccaaatgtgacaacacattgcgatgggactgtcactgcccactggggcctccgcactgcagtgggtgggcccggctcacctctcctcactctccaggcggtcctccagctccgcgatcctggcctccatctgcacaaccagcccctctttgctggacctgtaggaaccttccaggtggataatccggctctttaagtccttgttctggaacaacacagggagactgtgaggggctatgtgtctgccacgctctgtgcagagcagcgaagaatatggggcagaacctggtgtttggtcgctgcatgcgatgaggctgctttccacaccagggcctgtggcctggagacctggggaacacagagatgtttccaaggaaaacccctgaactcagctgcaggccagaagaagaagttctatcacactccctcataagcctgaatgaaacctttgccatgtcctaagactcccggatgtcaaacgggctttgccttgccctataaacctacagggggacaggagaaataggctcctttgccagtcctgtgcagtgaagaacatgaacagaaatcatgaaaaagaaataatgacccgatgaagttttctgagccactcatgtgtttgatgacgtggattctttttcattctctttacattagaatttagccctcttcaggatctagaaaataacacatgcaattcctcctccctcagctgccaagcttccatgcagatttcatatgaccgggaaaaacaactctggaaaaggactgttaccccccagagttcttgggatgccaagtaaaggagggacctccaagggcttctagttcaaagcagtgaagtgggggagggttagcggatggacgggggggcagctcacaggctggctgccctcacctgcctctccagggaaatcttgtcgcactccaagtcttgtctcgcagctctctcctgaagtagctcattcctcaactgctccatctacagcaagcagaacaaaagcccagaggttagaaggactgttcctgtatcttttgtactgaaatggtggcaaggaactgaatgtcaacctccactttatgaagggggttgccctacccagcccctcgtgccatctgctctggggtacgggatctgtttcttagttctttcttggtttcttgatgattgcaatactggtaatacaaataacagtaagagtcaaagctagccctgctgttaggggttgaactgtgtcccctcaaaaagatatgttgacgccctaatccccagtacctctgccgtgaccttatttggagatggggactttagagaggtaatcaagttaaaaatgagattattaaggtgggccctaatccagtatggctggtgtcctttaaaagggggaaatttggatgcagagacaaacacgtacacagggaagacggccacgtgaagatggacacagggaagtggagatggaggattggggtgatgggtatacaagccagtgattaccaaagattgccagaaaccaccagaag

SEQ ID NO: 79652 - DNA, 1050 bp, Homo sapiens
gggctaaattctaatgtaaagagaatgaaaaagaatccacgtcatcaaacacatgagtggctcagaaaacttcatcgggtcattatttctttttcatgatttctgttcatgttcttcactgcacaggactggcaaaggagcctatttctcctgtccccctgtaggtttatagggcaaggcaaagcccgtttgacatccgggagtcttaggacatggcaaaggtttcattcaggcttatgagggagtgtgatagaacttcttcttctggcctgcagctgagttcaggggttttccttggaaacatctctgtgttccccaggtctccaggccacaggccctggtgtggaaagcagcctcatcgcatgcagcgaccaaacaccaggttctgccccatattcttcgctgctctgcacagagcgtggcagacacatagcccctcacagtctccctgtgttgttccagaacaaggacttaaagagccggattatccacctggaaggttcctacaggtccagcaaagaggggctggttgtgcagatggaggccaggatcgcggagctggaggaccgcctggagagtgaggagaggtgagccgggcccacccactgcagtgcggaggccccagtgggcagtgacagtcccatcgcaatgtgttgtcacatttgggatctgtcctgatcctcgtagcctgtgaggaaggcagagcaactacacccttacttttattatttccattttataggtgggaaaacagagacccatcaaaataagtgacttgagtaaggtagcctggctggatactggtgtagctgggtaaaagtttaggacccccacttctcagtctatggtggtgccactgtacttgctgtcccttttcccgttctctaaataggacaggctgccttggaagctacagagtttgagccacgttagaggccagaaggctgactctgccctggcggccaggtgtatttaagcagaggctgactagccaccagtcagagatggggcaggtcctcccgcagtgtgtgggagggacatgggatcaag

SEQ ID NO: 79653 - DNA, 1035 bp, Homo sapiens
actttttctcacctcctaagccaggcctgcttcagtactaggggtgccagcttagtgttccccatgctaggttggaatgtttccaaaagcaacatttaggaaagcacaagggtatggaaagggtgagtccagatttctcctttgagcttagctggtcttacctagaaactggcttggccaatgcaactgatgagattgcgtagagaaataagtttctaccttttgaaaaagtcactcatgtggagcatacctttgtcctgagaatgcccccaaaattcgtgtgaaatgccacttttatttttctgtggctctgctcacccctcttcctccctttccctgttaggtcttgctgtgtctctctgctgcagaacccagtggatgggctcactacctctgtgagtccccacatgaaatgtgcagtggaagctgccaattcctctgggccctgcaaaagctgtcgttctgaaatgagtctcgttgtaggtggaatcgtcccaagaagccaatgctgaggtgatgcgagagatgaccaagaagctgtacagccagtatgaggagaagctgcaggaagaacagaggaagcacagtgctgagaaggaggctcttttggtgtgtgtgttgtagctgccgatgtaaacttaccgggaattgttggttcattattgttggtgatgtatacgtagtagtgtttattcttagaggtgggtcagtagactcagccatgggtaagggatcaaggaattattcatctgctcattcactcccctcccctcttcccctctgcctttattcatccccgtctctactcagaatagccccttgtctctgtctctaaatacacacctttttctagctcatctgacaatttgccagcatctaagcaaaccctgggcttgcccgcagctgtgccctccctccctccatttggttctctctacctgaaatttcctccttccctatctttgatcttgcctaagctccctaaaagccttaaatgccactctctccatgcctggagtctcttccagtcatgga

SEQ ID NO: 79654 - DNA, 1062 bp, Homo sapiens
ggatccggcgctagtagcggggcctgccgaggaagccgagtgcccgccgccgcgccagcctcagcccgcgcagaatgtgctcgctgccccgcggcttcgagccccaagctcccgaggacttggcgcagcggagtttggtggagctgcgggaaatgttgaagcgccaggagagacttttgcgcaacgagtaagctggggtcccgcggagtctccgccaggctccttcagctcgagctccctgggcgctcccctcccctcccgcactctgttcccttccctggaaggtgactttgactcagtcacattcgcttcagtcctacgggcgagtggacggagggcttgctgcggcagagccgtgcctcttcctggccaggcacgtatgcctgcgaggatagctcggattgaacggctacctggcgttgcagggagttagtagcccctggtcggttttatttacccggggactgtggtggttccatgagtctgctttctaaacccttttgtcgcccgcacccctaacccataacagattgtcagcttcatctctggattctaagcttacaggaaccgtaggaaatgggaagagtgggatatgaagaggggtttattaggccgggaaagttcgaccctcattcagctggctggttgaacggattttagcaagggagccacgtaataaaagtgattttgttttttaggcagctttgttcagcagcttgttgcaaaagatggtttgaaggaataaaaagcagaagacagtagaaggatattttcagagagacttcccacgagacacttgtaagaaagtgagctaggaagggattgggagaacttttaagcatggactaatttaaatgcagttgacagagatggctgaagtttccaatctatatggaagaccactagcaaaaataggaaaattcagggagaggaatagatccaaggttgattttacttagggtgtgcagagttgagaggagagcaggacagacatttggttaatcgaaaaccaaacacttaaaagctggagaagtagtcatgaggctcaagaaagagagaacc

SEQ ID NO: 79655 - DNA, 2495 bp, Homo sapiens
atgatgtcatcacatgccatgtagcctctggaaaactccactgtacccatgcgagaaaatgagagggaaataatatcttagtattattatgaaagtagttttgacctaataggcccatccccacactccaccccatccccaaattttggagattgcactttaatgactgctggttcttggaatgtcttatgtgattattatatgcttaaaatacttttgctgaaattctaatttgctgagacaaatgaggcatatattccctattcttcctgcattcccttgttttttgggctatttggataatgaccattttaattgttttattcttgttttggggcagttagaaatcagatatttgacttaaaaatcagcttttctttctttgaagataatgccttgcctttttaatgttatatctcaagttaaaaaaatggctgtaatgtaatagtattcttttccatttgacagaaaattcatttgcaaattgcccgacaaaggtaaaaagatctttgactcttttgccaaactgaaagctgccattgcagaatgtgaagaagttagaagaaaaagtgaactgtttaaccctgttagtttagactgtaagctaaggcaaaaagcaattgcagaagttgatgtgggtacagataaggcccagaattctgacccgatacttgatacttcatcactagttcctggatgttcctctgtagataacatcaagtcatctcaaacctcacaaaaccagggacttggacgtcctactcttgaaggtgatgaagagacttcagaggttgagtacacagtgaataagggcccagcttccagcaatagagacagggtaccaccttcatctgaagctagtgagcatcacccgcggcatcgtgtttcaagtcaagcggaagatacttccagcagctttgacaacctgtttattgacaggttacagaggatcaccattgcggaccaaggtgaacaacagtcagaagaaaacgcaagtactaagaacttgacaggcctttccagtgggactgagaagaaacctcattacatggaagtgctagaaatgcgagccaaaaacccagtgccccagctgcgtaaatttaaaaccaatgtgtaagtaccctcggaaacaggcctgtaacaggaacgtgatatttgttaaactcaaaaatttacgagaaactgggtgtggtggtgcttgcctgtagtcccaggctactcaggaggctgaggtgggaagacagctttgagtccaggagttgtagaccagcttgggcaatataataagaccttttctcttaaataagtcaggagaatgctctaagttccgtgggctttgtatgagaactacttgtagttaggaaataacatgttgtggcaacactgagaccagcctggccggagtagaagattcatgttgaaaaatatttagttttgaaaccaaataatcgacaaggtcttttaaagcacatgggggagtgttaaattttaggatgcttagccagtatttcataataaacacagagttggagagaatttattatgacttctttttttcagaaccattttttagtgtacagctttgattagtgtactatcaaagtgtactctctttgattagtctgtgaactaagggtaaagcaattgcaggagctgatgggctttccagcagaaattatttgcatgctcactgtatgtaagcaagcagcaggtgttgtggggacacaattaagtcaagattcttaaaactcctttgccttttttgatgttaaatctcaagtttaaaaacatggctgtaatgtatacatgtgtaatgtaatacaataccatgttcttcaaggagtttaagagctacatgaggacccaaggtttacacacttggaaaagagttaagctacataataataacagtttcagggggaaggaagctgagaagaggtttgaaaaactgtgaaaatagattcaggcaggataggcaaaaactctgcttatcagttccttgccataaatttgtttctgaaatttcaggaaaagtaaaatctttttgaaaataattgctatttacttgcagcaaatgtaacattcaactcaggtaactggtaccttcttcctatattgtatttacaagtatgtaacatcaaagttaaatcactactacctttctttgaaaaacagaaaacctctagtgaaaagtatctaaaacatgcttcttttttgttagactttaattctaccccagcattcattttaacctcaaaacattttatttctgctgtatagaaaatcaggattatactacattaacgtgatcaagtactctcttgtgtacagtggggtatctttcttcacttccaggatgacattttagaaaactagaaccatcatctagtcaataaataaaacaaagaatacattaatcccagttctgtattatggtcatttagctgggagtgggagagaggtaagggaatagtgaagagggctaccaagaattc

SEQ ID NO: 79656 - DNA, 1166 bp, Homo sapiens
tgcaagctccgcctcccgggttcacgccattcttgttcattcttgtgaacccgggaacacgccgggttcacaggcacccgccaccacgcccggctaattttttgtatatttagtagagacggggattcatcgtgttagccaggatggtctcgatctcctgacctcgtgatccgcctgcctcagcttcccaaagtgctgggattacaggcgtgagccactgcaccgggccccagcattagtcatttttgacatttgataggtcaaattgttatgtgagtgtgtatacatgtgcatgtgcccccatatttaacgcatctgtatttataagtattgtagtgctaagctcattactcagtttcttatatagaggagtgtatttcagtgcaatgttgtatattaatggaggtcagtaacttcaactgtagcaggctggtggctgtcagaagcattacccagttgtgtctgatagggcacagccatcaggcttgtattgcccaagggagcactcagtgaggtgtcagtgtccctcttattgctgattctaggtaacttcccattgaaaaattgtaaggaagagatgtgaacgtgtaactttgtgctttgctctttgttttaaaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctgaagataatctcctaaatcactgacgttgagatgtcatcatcttacatcagactttctaactagtatcaagatcagtgtcagatattgttgagggaagtaattttataaagttacacaaaggtagttataaaaaaagcccagtttgtctttcagaaggtgactttcatgtgcttgaaaagtttaatatttgaatattgtgtttaaccacatggtattaaaattttgcaatatattgtgtattggtctgatattttagtatatagtagaacatactttttttttctttaagccaaatgaaaagaggtaactttgcttttttcctttttcttacctatcaaatagcatttattacatgtctttcagtgaaatacttagttgttccaggcacctaaaatcaattaggaa

SEQ ID NO: 79657 - DNA, 1430 bp, Homo sapiens
aatgctcttctcctttttctgtcttcccttaggaagaacgttatctctcttctgattaggaaggacttcccttttgagtagatgctggaaagtggaggttttttttgttggtttgtttgtttggttttgtgtttttttttgagatggggtcttgctctgtcgcccaggctggagtgcagtggcaggatctcggctcactgcaatctaggtggaggtctttttaaataacctcatgttacttcaggcaaatctggtacaggagaagcccaagctaactgagctgggtgaaggcttgtgcatcacctggcttgagttccttgctgtcacagatgataggttcatgtacacaacattaatgtttgataaggaaagcattttttttttgttaaaattgaattgtcagtactttacttttttccccccaaataggtatatatagactgcagaagcttcagtcccatatataaacgttcatgtcattttagaggattatatggttgtctccagagaaattaacttacattatcaaaaaattctttgtctaatatattggagtctttaaaagtgttgaagaataaaatattaattagaacaacttcaaatgctaaggtgatgttttaccgggacttaattaaatacaactttttcctttcgaaaaagactgttcacatttgcttccaggtgtaattattgctttcattccttacccccctcaagcaaatgtgaaaagtatactgacctaagattctcattagttttagttcttaaaacgaatagtaaatgatttcacagcgtaaaatttgatgttatttctggaagctggatgatatggaagagttcatgtgcctggacacacagttccctgtaatcctgccatctagggagataaactctgttaacattttgatgttgtgtttttgcttatttttctatgcatagttatgcatttatattctcaaaaatgaaatcataatgtacattgctttgtagtctgctctatatattgtcaatatgttcccatattaaatattttgctttttagacagctgtaggatattttatttcatgggtataccataactttaagatttatttcctattcagcaatttgattatgtattataatgtaatctgtaaatagtgatatgattaacatcttaatcacatccatagaaaatgacttatttccagaagataccgctctaaaaatgaaattgttaggtgaaagtgtttttgagaatttttatatatattactcactgcagagatcatgttcatttacattcccattagcaatatatccaatgctcagaattgaaaattactacttaaaatctttgcaaattgaataattacagaaaagggctacatttaaaatttgtatttgtttttcttacttagtgaaggttgtgttttttttcatattcatt

SEQ ID NO: 79658 - DNA, 1029 bp, Homo sapiens
ccaaagtgttgttgggattacaggcatgagccactgcacctggctgtttttctctaagttttctacaatgttttattttgctttttaagacagaaagtccacgcaaatcagtcaggaatagatgtgaaaaatggggatggggcctttgaaccaggagcaatatgagaaggtgagaaggatggcctgggccggctgggtctgcgagactacctggaaaagccacgggaatcacagcccacagggtgacatctccagatccagcagtcttttaggaaggcagatggagtctcagacctgtcccacccatcttaaagtggcctggtcacagggtcagagcttcagcagacagaggcgccctgggataagttgccaaatatgggttgagcaacagtggcactggaacgaggtaggaggcggggaaaggggatggaaggtaaaatcctgcccctgtcctcaaggtacttacagtcaatgtgaggaaggctgacagccataaaatgatgacctatgacaacgagggtcgttccacacacatcctccagaccccggcacaagacctccgcctttcatctccattatattgggcaaaacacaaagcatcaacgaaaaaaaaaaaaaagtaaaagtacatagaaaaggagacacagaggaatacagaaaagcaaaaacctccttcaaactggtggatgtttcatcccaaaggacgctcgacctttctcaggcatcctgccactgaagaagtcaattactcacggcccacagtccctaggttccgctcagcacagtctggaatcaagggttcatttaatggaagcttaacagattcagatttctctaatattccacatccccttctgccaagaagctgctttgaaagatgacactcccttgatgtgaatttgcagcctgccccattaacaaggcttcagtcagaaaacatttttaaatcaaccctgttccagacacttgctcccaaggacaaactagaagaaactctgcaccagctcaaaccttccaagcactttgatg

SEQ ID NO: 79659 - DNA, 1045 bp, Homo sapiens
ccatcctgggctatcgctgccacaaaggacgctctcctgtcccctaaacgtctggcccctgagccggggaaaatgtttcatgcccttgtcttggcgatacactttttcttccctttttcttaaattgtgagtaggaggagattgatttctgcatttgagatgctatggttccacgattttaggagaaagtgcttgtgtaaaacccaggagtcagctttagaggatgcaaaggcccctttagcttgcacatcctatgaatgagaattgcctatttctacaacatgtgtccctagagtagcatctctgcaggaggatggaacgtgccaaggtgtgtgggctgtgaagagccaagccagcatgctttctgaggctcaccagggaacgggctggggacggaacctgcgctgatggctgaggcacccttgagtttgcaggagcactcctgagaaactccatgtctgcacggagaatcttgcatgactgcccttttttggagaaatctttaaatgaaattaactttaaatataaatgagtctttcaggctgagaactggttcctgctgagaactagttcctcctcctcctccttcttcttcttcctcctcctcttttgtagagatgaggtctgtatgttgctcaggctggtctcaaaatcctgggctcacacaatcctcctgcattggcctcccaaagtgttaggattacaggtgtgagccgccacacccagtcctaattatttactcttatttggatttttgtaagtgtttttctttaaaaaaaaaaaaaaggaagaaaagaaaagacaatttgcctatcattctaccctgccacccccagcacaatgatgctattacaaagattaaggaaaaaagtgtgagtgattttgcccactttaccttatgacatgtttaataaggacgttaaaaaatgatttggggaaaacgcttttaatcctgtgactgcaaagagaccagtacaacatactcccaagttctggcaggagaaattatttcaggtcttaaagatgaaaggcatgaaatagtcca

SEQ ID NO: 79660 - DNA, 1013 bp, Homo sapiens
agagttgggaaggatcagaatataaaatcttagaataatagtaaaggggatcatcacccaagtcaaaatgtattaccagctcctggacactaaagcccacagaagctcatccctcggattgtgaatgttactgggtcctccactctgtaaaagtctattcttttcctgagttgatcacatcaccatctgccttgacgactcttctaaaaacagtctggtgctaaaaataataagtgaatctcagcaaatctgggcatcggaggtgggtgggaaggagggaaatgttccaaagttctcatctgggtagtagctgtgcaactggtaggggaagtgaaagtattctaaagtttggaatggggagtggaagcagtggacaaacagtatttggtgggagaagtatgtgtctggttttatataatggtaaagaaatatgtatctgattatgagcaacaggaaagggaaactagctggaagtagaatgaaaatctacaagaaaagttgtatcaacaagatggaaaggggaactatcaatttgatcaatctgcaaaaataagagtacataaaaggagaaaataattagtaaagtaaggcaataaataagatagtaagagtccaatcatttcactaaatgtaaatggaatagattttcttattagaagtcagagacacttagattgagttaaaaatataaataagccagctatactttatctagaagaaaaatatctaaaatttttaaagaaacaaagtataaagaaaagttgaaaataaagaaatgaacaaagatatcaagaaaatattgtgaaaaagaaaataggattagcaaaattaattgtcagacaaggaggaattaaagattgggggcactaaaggaggaatgttatctaacaatgtaaggcacattttgtgaggcagaattaacattagtaaacttatgtgtaccaaacaatgtaaatacaaatataatttgatcaaaatagagattttaaaacacttttaagaatcacatctaa

SEQ ID NO: 79661 - DNA, 1287 bp, Homo sapiens
gaaggtgaaacagcacaatgtcccattccaaatttatttttgaaacagatgtaaataattggcattttaaagagaaagcaaaaacatttaatgtattaacaggcttattgctatgcaggaaatagaaggggcattacaaaaattgaagcttgtgacatatttattgcttctgttttccaactacatcacttcaactagaagtaaagctatgattttcctgacttcacataggaggcaaatttagagaaagttgtaaagatttctatgttttgggtttttttttttcctttttttttttaagagtataaggtttacacaatcattctcataatgtgacgcaagccagcaaggccaaaaatgctagagaaaataacgggatctcttccttgtaaacttgtacagtatgtggtgactttttcaaaatacagctttttgtacatgatttagagacaaattttgtacatgaaaccccagatagactataaataattctaaacaaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacaaatgagatctaatactactgtcagttttaatgtccactgtgttttatacagtatctttttttgttcactttggaaatttttactaaaaattgcaaaaaataaagtattgtgcaaagatgtaaggttttttgaaacttgaaatgcattaataaatagacgattaaatcaacttgaaggttctatactctttgaactctgagaactatcacaagaagcttcccacaaggcagtgttttcttacagttgtctcttcctacaaaagtatagattatctttattcttaatactttggaatccatgtagaaaatttccagttagatactctgcgtacacacaataaacctttttaaaacacccaactaatctcaactgcattacattgtttctaatcaatattcagtgcttgtcttggtggaagaggtgagtcattttgaaaacttatggtcttgtttttatgtgtttttc

SEQ ID NO: 79662 - DNA, 1150 bp, Homo sapiens
gagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgta

SEQ ID NO: 79663 - DNA, 1034 bp, Homo sapiens
ttatatttaaataatatatatgtgcaaatatctaacatatgtatacaactcctaaacaaatgttctttaaaaattacaatatactgtgttctattctatgttttatatactgtaaaagatactctaaaatattttgtagttttttttttttcagtggaaaaatctgtttatttctaggctcattggtgggcagtattacttatgggaattgctctgatcatgctaatggctggatttattaagatatgcagtgttcatactccaagtagtaatccaaagttgcctcctcctaaaccacttccaggtaagaatatttgagcaagatacatatttatgtaactcagaattgtttagcaggtagaattgaattataaatgagtctgtagtaactaatgttacagtactttctccgtaagaatgggattattggatgaatgatttagttgatatttgtgtgctttttgtcaatccaatctggccagtgactgctaagttaatgctaatttatctgagtgtctgaaaatatttagaactagaaattttaaattttgcttggtatttgttttcttgtttttttttttttaaatatattctaacatattcccttgccatgattatggtgaactactttaaaattgttgatctttctattctaatagttgtgcttctcatattgttgtccttcattcctccttccttcccttccatcttccctccctcccgccctcccttccttctttttcttttttctttctctcactgtgttgcccaggctggacttactcctgagctcaagcaatcctccccactttagcctcctaagtagctgggactataggcgcgtgcactgcacccagctctcttatcgtttttagtgtttgtgctcttgaaatattttctggcacataagcttattttcccccagggtgatgcttgtggggacatacagatcccagtctgtgggaaagtcttagagtagaggattcattcatcaaataagcacagtcaagtattctccattcctgaaaacaact

SEQ ID NO: 79664 - DNA, 1110 bp, Homo sapiens
taaaatttgcctcaaactattattttctcctaaattttaagtgtaaaactttgacctacagtttggccagataatttccagctaaatctgtcctcttgaggagattataaatgtaacgtagcattgtgtctctattattatggtctctacaatgttttaaaaatgataaactagacaaaacgttgccagctttacagcagtaatttacataaacactgttagactttaagtcatcgtggacactgagtcaagacttgctggttgcttgtttacattgtaacatttaatatgaattactgatggcgttacccagcctaactagagaaggtctgtataacatgttatggtaatgatttcagttttttttccctctttgtatttgcacaactggaaatctgatcttcaacttatatttgaatctgaccttcagcttatatttggcatttcttttccagtggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggtaagtatgttttttatttacaaagaaaacttaaagtggtttgatcttaattttacttggccagaagtcatcaaagttacgagaaaacaacttaactatttatattagaattactttatatgaagatttttaaagttctaatatttctggttattatttccttctgaagtgatcagaatcatgtgtatcattcatagattgcttagtaggtgatgggagtcattctgttttaccgtgctccttagttcatctcctggatgggttacttcttttggtgcatattattagggcattttcatgggacttaaaaaacatttttttttgttgtttttcaagacaacttatttgcccaaatcgtggactaattggtgatttttcctgatctttcagtataatctctgggtctttatcttgtttgtaataggaaatgttga

SEQ ID NO: 79665 - DNA, 2086 bp, Homo sapiens
atattgttgttgatagttgttaaagatgagtgattggtacatgggaattcattgtacatattcttttattacttttaggtgtgtttgaaattttctgttgcaaaaaaaggcttaatttttttttttcctggttagtgaagcactaacttggtttgtatttgtgtgatatgaatagaacagtcaataaagctcaatgtagcatggcctaagttgcaagttacagcttctagaagggaccctctgtcaaatcctctcactgtacagattgagaaactgaagaccccaagattgcattgctagttagtagcagaccccctgttagaattaggtctcgtaatttccagattcctagtttgttctacttattcatcaaagttttcctttatccctttgttatgatgatctaaagaatttgtgaattttaaataaaattaatgtgtgcacacaatgcttactttgtcttgtttattttcctcagaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcaggtaccttgctaatttcagtgatgttaacattcttgtaaagttacctcaatgcagttatgacaaatttaaaactgagattaagagatgcatatggttttgaaactttgcttttatctgttgtttgttttctttttctgaagtagtgttggttactgctctgttattggcagattgaactacttttttttttttttttttttttttttttgagacagggtctcgctctgttgcccaggctggagtgcagtggcatgatctcggctcactgcaacttccacctcccgggctcaattgatcctcccacctcagccccctgagtagctgggactataggcatgtgctaccacacccagctaatttttgtatttttttttagagacagagttacgccatttgcccaggcttgtttggactacttttaatagtaatttgtgtggtgaatgttaacaaaaggacatactcaaaggacatactaaaaagaatcctaaaaaatacatattcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaatacatattctttagttacttattgtgaaaatgtaactatcttccatattttaaaaatcttaactttaaatatttagttaatgtggaatccatttacttttctaacttggcaagttataactatttcacttgtcaaatttactttggtagcagtgtaagcaattgtttgcacaatactttttttttttttgagatggagtctcagaaaaacctgtcacccaggctggagtgcagtggcatgatttcagctcactgcaacctctgcctcccaggttcaagcaattatcctgcctcagcctcctgaatagctgggactacaggtgtgtgcctccatgcctggctagttttttgtatttttagtagagttggggtttcactatgttggccaagttggtcttggactcctgatctcaagtgatctgcccaccttcgcctcccgaagtgctaggattacaggcatgagccaccgcacccggccagttcaatatgttttaaacggctggtctgtatatcctagtttgattttagtatgaaaatgggagagaaagcgataaattaactaatgtgtgatgtaactgaaaaaatactgataaattgcctaatattaaatccattttccattgtagccttttcctaaaggtgaacagg

SEQ ID NO: 79666 - DNA, 1085 bp, Homo sapiens
tttcctatatattggctattaagttagctgtcttagattcctgttctgtgtgtatttagccccatgtcagtctcttgattcttttgtctttccccacctctgtcttctctgaactattcataacatgtaatttaacatatgtgttagagactatttagtagttttaaagtagtttattttactgttactagttttaaaagtatgtgagcttatttttaatagacttttatgacagtctgtcctcaattctagtccctgcttacaaagctataaattgttatggctagacctccactgattttcctccttttctaagacagtgacccctaaaagagcaaattcttttcctactcaaggtgtaaaacaattgtaagatcctttttaaaggagagtccacaagcttccattgttttcctgatgagaacattacgtttaatcagttgacctgaaaaccttattttacttcctgtttatgtaactttatattctttttgacagcatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttggtatgtatattttcctaacgttttgttatgaacattttcaaacattcagacaacttgaaagaattctatagtgattactgacatacccaccacctgcattttactattgctaacactttgctgtattccctttatctcgttatttcttaatcttgccatctctcaattcatgttttattgcaatttaaagtaagttgcagccatcagtatacttcacacctaaacattttagtctgcaaatcattaactagagttcaatattgtttatagttctttttctgttttctgcataagtgaaatgcacaaattttaagtgcatcatttgatgagttttgacagatgcatttacctttgtaaactacctatcaagatacaggacatttctgtcaccccggaactttct

SEQ ID NO: 79667 - DNA, 1001 bp, Homo sapiens
aacattttctgtaaagggcctactagtaaacattttaggcttcaggggcagtgtttggtttctgttgtacagtctttgttgcttttacaatttgttaaatatggaaaagccattcttagttaagccatataaaaacaggctgctggctactttgtcaacccctaattcagagccaataattgtgaagattttgacatatcttctatctgtatttctttttctttgctaaggtatttaaaggaactctatctatccttacgtatttcagtacacattcctgaaaaaatagacattttctaatacaactacaatgtggttattacacctaacaaaattaacagcgatctttgatattatctaatatccagtccattatattgatcttttaagtgaccttaaagatcagtacaacacagaaatatgaaatactgaatgatactctgtctttgtgattttggtagagcttattaaagataacattttgaaaatgtacacttgaaaactgtatgtaaattcattttactttcaccttatcacttgcaaaagtgcaaatttttatgattttaaaaataagttgtctacttgtagcttaaaatccccaaatgcacttctctaatttttcccatgtttgtaaaataggtgccatctcactaagttgcaagtctttcttcttctacatcccaatcagaaattgatagattattattaatgttcttggataaggtatttaaaatgtgcttaatctctgtaactcttgactgcttttgtgatcttctcttaaaagagtacttggaattttagagatgagcagagaattattgttcatagttgatttgcattttcaagagcagataagtgtcctctcttctccccaagtcatcttggttccaggccttaccaggggaattttagtactcctccagctacttgtctggcctttagtcccaggtcactcatttttatgtgcatatacatcacctgagaatcttaaaacacagatt

SEQ ID NO: 79668 - DNA, 1037 bp, Homo sapiens
ggtgaatgcagtggtgtaattataataataattgactgtgggatttaaactgaataaggaagagaaagaatatctggtgatagacaataaggtggtagcattggtggattaaagggtctcactgatgttaaagggttgatggaacctagagggaatgtgctgaaaagataagtggtggaaagaaagtagaatactagaagttgagattatgaagtgctttcagttatcaatagtgacaagttcagaagagtaactatggaaatgagaaactgaggtaggaaaaaatcattggagaaaagaactgagtgtagtggaaggatcatcgtcatgaatgatgaatgatgatgaatgaatgatgaatgatgtcatcagtcatgatgatgaggtggtgtcagagagactgacagtaagtcaggatctaaaaataaggaaataagggcagtaatgacttgggtgacaacaaatgcctgtaataagttggggtagtcagtgatacagtcacgtaactgtaaaactgagctactatgagaatagtcttaatggtcctaagggagaaagtggtagatagttgtgttttgtgaaatgaggggtggggagtatcttcccaagagtaggaagagttttggggttctcttttatatttgctagagtcctcctgatggagctcaggaatactgcagaaggattctcttgacccctgccagatgatggtccagaaacatagatattctcttggtgacagccgaatgcaatatattggtgatagggtcagaataatgagtggttattgcccttttttagaattcacaaatcatctatatgacaaaaagctaaagaccagtggtttttattgagggagagcttaggaacctgctaggttttagcattaaaatgcctagcataatgccttttccataggtgcttaataagcatttatggttttcattagttaagacagttaaatttttacttgtaattctcatttataattggttatacctaaatgtgtgatagtaatgacgtttcttctttgtatt

SEQ ID NO: 79669 - DNA, 1071 bp, Homo sapiens
tgagggagctttagggagatttaggaagacttccctggggaggtggaatttgacttgaaccttgaagataaggggtagacttttgattgctagaggagagaatctgtgatcacaggagaagcctcagccctattactctggctgcaacaatatttcttttcagttgtcacagcttgggaactaaagaaaggaaaagagattcgcatgttctttggcctagtcacccattcacccctgtgtatagctgtatagtcccaagtcaaatacacgtaaataatggtcacttaaagttagtatgttacaagttttcattccaagtgtcagttgtaagttttacaggtttaacaactgattaatttgttaataaacattttttgagtgcctaatctgtacaagacacttttagaaactatccatacaataatgaatagggcaaaggttctgccttaaacactttagagtctagtaattctgtttgtcattgatcagaataataaagcaacatttctctggttgacctgactcccattatcctttggctgccaatagtaaccctttctttctaaaacccatggggtgagaagggacatgtctggccctcttcctcatctctgtttccagagagatcagtgttgtgagtgcttgtggaaagtggggtcattttcaacttcctcctctttctagggacaatcactctgtgcttttcttatgcccacttaccctcccaaaacagaaattagacatggggattgggaagacatgagaattggtacccgggagaaacggcctcccatccactggaattaggaggaagaacatttggagttctttcctgtctccaaacttttcatttcttctcaaaagaaaaaaaaaaaagcctatcctttcttctactctccatcagtgaatccttgttgatgtaggcaactttgggaataaatgacgattttcatggacaaggcccccacctcatgatactctggatactaacaaaaataatttttatgcataataatattattctatagaagtcattctattttaaattcaattaatgcagatttttaaaaa

SEQ ID NO: 79670 - DNA, 1054 bp, Homo sapiens
gggacagagagtaaatatttttggctttgagagctgtatgttttattgcagctactcagctctgccattgtagcacgagaacagccaaagaaacacataaataaataagcatgggtgctttttttaaagaaattattatttatttatctatttttttggagacagagccttgccctgttgcccagtctggagttcagtggtgtgatcatacctcactacagcctcaacctcctgggctcaagtgaacctcctacctcagctctgtgagtagctgggactccaggtataagccactgctcccagctagcatggctgtttttaataaaacttcatagacacttaaatattaatttcatatatatttcatatgacataaaatatcattcttttgattttttctttaaccatttaaaaatgtggaagctacccttagttttcatgtcaaacaaaaacagatgggagggctcactaaatttaataattactttaattggttctttaaattctctgtgtagaatatgacaggttctagaagtagtagtagtagcagcagtagtaagaataattattatggcttaatatatacctgacagtgtataaaaatctttacttgcattattgaattgaattctcaaaataacgttatgagatactggcacacctattattcccactttataggtgaaggcttaaactgaggcttagaaaacttatgtcacttgattgtggacctcctgttctttaccctgtgctcttctgcttcactcatggaagaaagctgtaaattctcactgcctttacttcaaggatttctggggcttttctgaaatctgtaagcctctctaaaatcatacatttgcatctattgctgttttaagccaaactctctccttaatatatttagcagtgtttattttataactaaatggcaaaggatgccctttaatgtgtattattatttttatataattggtttaagtactaataatttattttcagaagtaaagtactgcattattgtatcactgtgaatgttcttaattggatttggtat

SEQ ID NO: 79671 - DNA, 1046 bp, Homo sapiens
gagcatcattactacttacataaatttcagtgtggatatttgtgtagtgtttaaggaatattttaggtatttttgtaatttttaagtccattgagtatttctttttagaatcttaaggtaatgacttgacttcaagagtccacgtttatcatggattttgttctctaccatctttatatgatgatatttttctaagaatagaaaatgtatttagactttaccttttaattctattgtccgtatatccacagttatccagttattgggaatgcttctttgaagtaccacagaaataaatttctctaatttatatagctcttgaatacccatttattattttttgactgtaattagactagtctctcaatttttgcctgctttcctaacttggcagcttcttcctacatacgttttcctttgtatagacagaaatttattgtcaatgattttattcttacccctagtaatacactgacaagcattaaccattttgactttttgctccatcagctctgacagtttttgtacttcatctgtccaactgcttgttatctctgctgctagattgctatagaaaataacatatgtatactaggtaggatgcatttatgatttttagctacttgttaaatcataagctcattaatgctacttccctgtattttcattcaccactatttgattccttttccagttttaactcctggtatttcaaactctacctttcttttcaagctctaagctatcatcctccttcataagtaggaatatgaattcctttgctttcgtttctttctgctgacaaaattattatttacctggtttgtgtcttgctttgtagctttcttagtaatttaacctttttttgcagggttacctcccctatcagggtatgtaagttcttcaggtatagtttctgtttcttttgctcctgtaatattgcaagtatcatttgtctgtgcagcaggcttttcataaatacttaatgaaatactggaatatttttctagaatgttttatcaaaatcaaagaaaaccttttgagga

SEQ ID NO: 79672 - DNA, 1172 bp, Homo sapiens
gtcgtgaagccacagtattaagtgagaagaaaagtaaaaaatactgagtttgttggagtaaatgaaatgccaaaatataaaaatatacttccaattatatattgtagttgcacctgaaatgaggatttgttaagcttgagggacatcagcaagcggggaaggctttctgaggtggaagagaatgacacataagatgcttgtaggtttacttgcctggaatcgatagtctgtgtcaggaaataaggagaattgctaactgggccatgataatcaggactgattattctaggccatgataactatgagatagaatattatggactgttgggtggagtccctgttgaggagttaggttatgattgacaaattgggtgattgagtcttggattagaatgatcgtagaaataagtaaggatagaacaagaaatgacatggaagaaaaactgataaaactgggcaaatgtttaacgtgaaagtaacaaaacttatagagggctcactctgttgaatttaaatattaggctgtttcattggagtgagtgtggttttataaaactttgaagacctcagtcgttgaagttgaaaatgtcttaagattttgagtctggatagaagcttataggttgggatgggtgtcagcgtctgggattttattttatttgcatgctaatacttgggaactggataaaactttgcatagatctttaatctctggctagttatttgggaagcagtgctttaggtagctggattatagaagtttagtgaatttggagtggagatagagattagtttaaagatatactaacacttttttttcttacttaagttggaattaggctattcagttcaaaaatatgattgacactcttgatttcatgtgaactatgaacttctgtttccaagacaaataggggaaaataatgcgatctttgcattttaggcaaatttgcatatgtgatttgtggagcagaatttgcttaccatctgtttttgcttgtattgatgatggcaggacacacgtgtgcatacatttgaactttgaatttagctttcaaaagaacacatagaattctctatgatttgatggggtattaatttactaccccttttcctaggaattaagtgggataatttgtaaaagtgctaaagactttaaagtactatataaa

SEQ ID NO: 79673 - DNA, 1020 bp, Homo sapiens
caggggaagcttcacagttggaaccctcctagattctgccgtatgtgtctctttcctttgctaatattaacctgtatctttgccctgtaatgaactgtaatggtgagtataataggtttcagggagtcctgttagtcactctggtgaattactgaacctgagggtagttttgggaaacctctgaacttgtgattggtgtgagaagtacgggtggtcttctatgagctcttccctctaaccttgtagttgggccctagctccttagagttggggtcagaagccttgggcagacttagtagtctggaggactctgttcttaacctcatagtttggctaattccaggcaaaagtacaaaaaaagtaagtaacaaaaaatataaattgagattaatttgccaaattaatacatttttcctgtatttgtgtttacataatttaaattcttcgacttacctgagggtctactaaccacccatggtacaaaggaatatcaagaagatcaaatactatgcattctggtgtatattcaaacactcgaacaccagtgaatcttacatttacatccaggcctgtctgtagtttgtgcaaaattgccatggcatcactcatattctgaaaatagaaaaggggaaagttctaattcagaaacatcaaaacgagaacaaaaaagatattcaagtacaagcacatttacttttaattttccattttatccaataaattcaattcaacatatttttattattgagtatctactatgtgtcagaagctagttggagtttgaaagatacaacaatgaataaaacagacactgaggtgggcggatcacttgaggtcaggagtttgagaccagcctggccaacatggtgaaaccctgtctctgaaaatacaaaaattagctgggcatggtggcatgcgcctgtagtcccagctacttgggaggctgaggtgggaggatcacttgaacccagtaggtgtaggttgcagtgagctgagattctgccactgcattccagcctg

SEQ ID NO: 79674 - DNA, 1097 bp, Homo sapiens
aaccatagcttccttgctcatggctgtattcctactactagtgagcacccagacatgatacatgctcaataaatatttgttaaataaatgaataaatcctagacttgagaggtcaggttaagtaagaaataaaatgatttagcagtattcaccatgtatcaataaatctgatccttatgtcctttggccttagatttctgaggagtatggatgactctgggcccacatctgacatacatctagctaaaatgttgaagttatacaaatgagctgttgctataactaagataggaatgggagagcaacggctttaagggtattcttacataagcaaacaagtcattattttatactactttgtgtaattcattgactaaagtgttgaagaaaatatgaagatgtaattcacgactttaataagccactttcatttagaaaaaaatgacatatttacatggaaagaaaactggtaattaggtattaaccaataagggctaaaaaaagatgatgtagccaataacagctagatgatggttagagaattgtactctgccttagctgcacattaaaataacctgaaaagcactcaaaattaatgatgctcagatcccacctccggagattctcatttaatggagttggtggtaggttctgaggattggcagttttaaaaaagcctcccatacagttttagcatacaatttgggttgagaaccactggtttgaggagagtagaagtagctttactaaagagttagtatttaaaagcttcttaaaggatgggtaaaattgggacaggcaaaaaggaatgagaagacctttccaaacagggattaaggagtgagatattgtggggaaaagagagagagatcagattgttactgtgtctgtgcagaaagtagacataggagactcccattttgttctgtattaagaaaaattcttctgccttgagatgctgttaatctgtaaccctacccccaaccctgtgctccctgaaacgtgtgctgtgtcaactaagggttaaatggattaagggctgtgcagggtgtgctttgttaaacaaatgcttgaaggcagcatgctagttaagagtc

SEQ ID NO: 79675 - DNA, 1007 bp, Homo sapiens
atttttcaggaatttgtatggtatttttctattttgtgaaatgagattataaacccccccaaaggtgtttataagtcatacattagctgaacatgccaagagctcttatttcttgttatagtgtagtgtgccaattataaactatattcaaagccgagtggatttgaggaagtaaaatatctacttggtctatttattgtgttgtacagatctaaacagtaggaatgtttaatatattctgaagatacagattgtaaaactttccttaaatattatattactagttttgatcaatttaacagtcctttttcttttgttacttcttattaagggtcaactgtatttgttggtaacggaccaggggtttcttactgaagagaaagttgtttgggaaagcctacacaacgtagatggtgatggaaatttctgtgactcagaatttcatcttcgacctccttcagatcctgaaactgtatacaaaggacaacaagatcagatagatcaggtaaatttgtattgtcgtctttatagtggttaaaatgctgatttttttcaaatgtgaattcatgtatccaaaatttttcaactaaagattaattcatcaatatgcttgtgaaattttcctgacacttcctgaatagttggtgatcattctacatgtacattaattatgtactttggtgcagaaggccagatcatattgaactgtgaaggtcatggtgagaagtttgaattttattctaattgcagtaggaaagctatgtcaagtattaaacacagaagtgatgggatcttctttacctttttaaaagactgttatttggagaatacataagaaggaaacaggtctaagcagagacaaatagtccaagcaagagctgatgatggcttagccttgggtggtagagatgaagagatgagcacatatctgagctatattttgactagttagaaaaagtagaggagagagaatctggaaggtagcatatagtgtataaagaatgggt

SEQ ID NO: 79676 - DNA, 1024 bp, Homo sapiens
gcctccaaaaatatttagaacaatgacagaatcactgaaataagttcatagctccccaagggaaatacttaggaagataactgtcattttaatgtttaaaataaaatgttttttattttattttaattattttgttattttatattgttttctttttcttttttgtttttattttattcatatttatagacagggtctctctctgtcacccatgctggggtgcagtgaggagatcataactcactgtaacctcaaactcctgggctgaagcaatcctcctgcctcagcctcccaagtagctaggactataggtgcacaccaccacacctggctggtttttaaactttttttgtagagacagggtcttgctatattgcccaggcctggtgtattttttaatagccattcttacagctttatagatataacgtttgtatttgcagtcattcattcttgggtaaaatctcatagctaatgatggttataatttaatttattaggattatcttatggcattatctctacaacaagaacagcagagccaagagatcaattgggaacaaatcccggaaggaatcagtgatttggaactagcaaagaaactccaagaggaagaggacagacgggcttctcaatactatcaggaacaggaacaagcagcagctgctgctgctgctgcttctacacaggctcaggtaaaaactagtgttttgagtcttaaatgtgatgatcatggctgggtgtagtggctcacacctgtattcccagccctttgggaggctgaggcaggcagattgcttgagcccaggagttcgagaccagcctggccaacatggcaaaaccctatctctattaaaaatacaaaattagccgggcgtggtggtggtgaacacttgtaatcccagctactgggaggctgaggcaggagaattgcttgaacctgggaggcagaggttgcagcgagctgagattgtgccactacactccagtcaggatgatagagcaagactccttctcaaaaaaa

SEQ ID NO: 79677 - DNA, 1100 bp, Homo sapiens
taaagacacaatagctctaattttttttttttttttttttttgagacggagtctcgctctattgcccaggcttgcatgcagtggtgctatctcagctcactgcaatcactgcctcctgggttcaagcgattctcctgcctcagcctcccaagtagctgggatgacaggtgcccgccaccatgcctggctaattattgtatttttagtagagacagggttttgccatgttggccaggctggtctcgaactcctgatctcaggtgatccacctgcctcggcctcccaaagtactgggattacaggcatgatctaaattctttatacccttcaagggcaggaaaccagtatctctgaaaagcttgtttgttttaatacaattgaacatttcatctttccccccacagtaatcaaagcaaacattttatcattattattcttggtatatcaaagtaaattccaggaatgtaagaaagtctgacttggaaatattacatagaaaaaggctgaattaacacattacattttttagtttttccttgtaagtatacattgacatctacttatctgatagcagcactgctggttttgagtgagttttgttttgttttgtttccttccagagggaatgcagtatggcagcattttctttggaacaaattaagaagatagtaacaaataacagaagaaatacttctacacatatattttccatgggcaataaacagataagtatataattatgaaaaaatatgcctcaactatgctttttaaaatttctcaaggtatactggtttgtttttcttattcaaatataatgcactatcactactatctgtcccgggaaaaacaaaccctgaggtttgagttacctccttcagccaacagagtgatatcaagagtaaacttggattgaggtcaacctgtttgagccaatagagagttctgtagtatatctggttattttactaacgtatacatattctaggttataatcaagatactcattaaatattttctatcagagttttatatcccaaacaggttctttgatgatttatcatgctaccataggaaatttgaagaaataacaaattgtgtaa

SEQ ID NO: 79678 - DNA, 1079 bp, Homo sapiens
actacagaactctctattggctcaaacaggttgacctcaatccaagtttactcttgatatcactctgttggctgaaggaggtaactcaaacctcagggtttgtttttcccgggacagatagtagtgatagtgcattatatttgaataagaaaaacaaaccagtataccttgagaaattttaaaaagcatagttgaggcatattttttcataattatatacttatctgtttattgcccatggaaaatatatgtgtagaagtatttcttctgttatttgttactatcttcttaatttgttccaaagaaaatgctgccatactgcattccctctggaaggaaacaaaacaaaacaaaactcactcaaaaccagcagtgctgctatcagataagtagatgtcaatgtatacttacaaggaaaaactaaaaaatgtaatgtgttaattcagcctttttctatgtaatatttccaagtcagactttcttacattcctggaatttactttgatataccaagaataataatgataaaatgtttgctttgattactgtggggggaaagatgaaatgttcaattgtattaaaacaaacaagcttttcagagatactggtttcctgcccttgaagggtataaagaatttagatcatgcctgtaatcccagtactttgggaggccgaggcaggtggatcacctgagatcaggagttcgagaccagcctggccaacatggcaaaaccctgtctctactaaaaatacaataattagccaggcatggtggcgggcacctgtcatcccagctacttgggaggctgaggcaggagaatcgcttgaacccaggaggcagtgattgcagtgagctgagatagcaccactgcatgcaagcctgggcaatagagcgagactccgtctcaaaaaaaaaaaaaaaaaaaaaattagagctattgtgtctttattttcttaaattttgcccaaggtaacgttatatatcccaccacttcattgctggtttgggtacataggattttgaaagtggtatattaaagtctttccttccaagtattttgtaatacttgaaaattctt

SEQ ID NO: 79679 - DNA, 1483 bp, Homo sapiens
aaaaacaccaggattaagtaagaacatgcatgaactaaaatttagatagatattcaaagtaagttaaatttaccagagtcctgcatctggcctctcccatgccattatcgctattttgcaatttgttttgttcaggaagcctctgattttaatatttaaagtgtcacctgagaagagtaacctcaattcttcatgttttctcaacaatcttagaggtgttggacatcattaataaaatatactaaattatcagagaacttaagaacgctaagattctgatgagttcctttaccattttcagtcactttctaaaagggatttaacttcacattatcaaataacattttacactaaaaacacaatttatatagccctaaaataatattacttgagagatctaaatgaattccaccaatgcaaacgaagtttatatactgtattagtaatttgataccaccgtattccatggagaaaaaggcaaagagaatctaaatatttagatctgtgaaagatactagaaaaaaatagatttttaaatgcttctgatcctctcaaaatactcttgattttgactctatagtctatagaacacacaaaaaactgtaaaatgcatttgggaagagatcacgccatactcaaagaaaattctacaaattttgacagcattaaaaaaactgacttaagatatattttgttattgagaaaaaagtgtgcacattcaagaacataggatgtgtaatatttgtgataaattaagtcatactttgtgcttatactatgccctttattcaggagtgcaaaacacttaatcaaaaagagcatccttcacatatttaaagagtacattgaggcacagaaagtttgcccaaggcaagatagaaagtcgggtttatagacacaaaatgatctagaattcttcatgtccaattccttaaaatacaaactgtagactatttgtaatgcctccatcttattttatcaaacattagtaattttactattataagtttatgcataagtactgtgtgataggtaatgcccataaggtttttatcatgttttaaggtaacttgtgcatggaataggaaaagttaatcaaatgtaatcaattcgcttttgctttttaacaaaacttaaataaatgagctatttgaggacagttctggaaattcttgccttgatttttctccaagattttagatatgtagttcacatgtgaacattaatatatgaacaattattttatttattggcctctagttctctttcctctcatgatctgtctcttagtgaattgactttctgattcattgaaagcaaaatgctaagaaggttttgtgcaagtgcaaaatgtttaatcttgggttcagtcaactagtctctgatactaacttgcttagttaagccaagatcaagaagtatgagaaagaacttgaaatatgataaagaatttgaaacagaatatgggataagtagtcaatat

SEQ ID NO: 79680 - DNA, 1047 bp, Homo sapiens
tcaatgtactctttaaatatgtgaaggatgctctttttgattaagtgttttgcactcctgaataaagggcatagtataagcacaaagtatgacttaatttatcacaaatattacacatcctatgttcttgaatgtgcacacttttttctcaataacaaaatatatcttaagtcagtttttttaatgctgtcaaaatttgtagaattttctttgagtatggcgtgatctcttcccaaatgcattttacagttttttgtgtgttctatagactatagagtcaaaatcaagagtattttgagaggatcagaagcatttaaaaatctatttttttctagtatctttcacagatctaaatatttagattctctttgcctttttctccatggaatacggtggtatcaaattactaatacagtatataaacttcgtttgcattggtggaattcatttagatctctcaagtaatattattttagggctatataaattgtgtttttagtgtaaaatgttatttgataatgtgaagttaaatcccttttagaaagtgactgaaaatggtaaaggaactcatcagaatcttagcgttcttaagttctctgataatttagtatattttattaatgatgtccaacacctctaagattgttgagaaaacatgaagaattgaggttactcttctcaggtgacactttaaatattaaaatcagaggcttcctgaacaaaacaaattgcaaaatagcgataatggcatgggagaggccagatgcaggactctggtaaatttaacttactttgaatatctatctaaattttagttcatgcatgttcttacttaatcctggtgtttttgctcttagatgttagagtttaataaattgtgatacgcatatatttttttacatgaaggattctactttctaattttacttttctgatctcaagaaaattaaacttgaaaaacggggtaaaattcttcaactattgcctcaagttcagttttgtcctattgtcctgagaaaggagatttagacttgtctgcctaacaca

SEQ ID NO: 79681 - DNA, 1106 bp, Homo sapiens
aaattagagaaggacaaaacaaaatgttttggaaggtgatcctggctcctttggctctcataattgttttatagctgaaaataaaaagtcaggaaactggcccggtgcggtggctcatgcctgtaatcccagcactttgggaggctgaggtgggtggatcacctgaagtcaggagttcgagaccagcctggccaacatggtgaaaccctgtctctactaaaaatacaaaaaaaattagctgggtgtggtggcacatgcctgtaatcccagccactggggaggttgaggcgcaagaatcgcttgaacccggaaggcagaggttgcagtgagccaagattgccccactgcactccagcctgggcgactgagcgagactcttatatctcaaaaaaaaaaaaaaaaaaaagtcaagaaactgaaattcccatttaagttctcaaatcagtgatctgtcaaaataggccttgtaactgaaataccttacaaagcagttctaactaatgcaatgtgttttttaaaaatttttaatgaaccttacattgtgaacataattgcaacatgttttaagacaaacagtatttaatccttgaagacctgtcttgtatgtctctcaattttgtcagaatttttattattgtttttcacatatgtgaaataagcagttttttcagggtacatagggtatctttgttttacagatttttaaagatgaggttttgaaaagccctcagaggtttttgttaaaagactatcttgcttaataaatgacagcttgttacagattcacacattacaagtaggacagtataacaggagattggtgtgtgaatgctacaaaacagtcagcaaaaggaatcatgtttgcttgtgaaacttcagaggtaccctgaaagtcatttcctaaagctagtgcgtgtgaatcttttccttgaattgtgcagaataattggattgaggcacatattttgaggagtagcaagtggaatggtataatgactacagagaaaattatcttgaaatatagcaaggaagagaaacaagttttctttctccactttattgttggactaattgggtcaatttgctgtgacatatcaaagatctct

SEQ ID NO: 79682 - DNA, 1081 bp, Homo sapiens
ttggtctaaatatcaaagtttattgaaataaaatataatctataataaaaaatactacaggtgttattcactggttacagttttaagtatattaacaaaaacagccaacattttaacccaacaatgacactatctttgtggtacaataacaaacatgaaagtaaatgttgaataatactgaataattctgtcagaaatattttatactttaccatctatgtatgccttttaaggaatatcctcccaaagtgaaagttttgaaactgatgacattgtttttaagaattaagtagttttaaaataattagtatttaaaacaaatttatttcacagaaattcagttcaaccctaagctgggtagatggttttaggtatctttatgcaaaaaatgtatttcaatgctctttcctatgaatctctagggttgttattattcctcaattgaaattaaagctggtcataaagcaaaacagatgaattatttcagaagtaaaatgggtattaagataaaaaatgaaaggaggaggaaaaaataggcactcatacgtaatctatatattaaaacgctttgagaactcagtagccagtcttggcctggcacaaagagatctttgatatgtcacagcaaattgacccaattagtccaacaataaagtggagaaagaaaacttgtttctcttccttgctatatttcaagataattttctctgtagtcattataccattccacttgctactcctcaaaatatgtgcctcaatccaattattctgcacaattcaaggaaaagattcacacgcactagctttaggaaatgactttcagggtacctctgaagtttcacaagcaaacatgattccttttgctgactgttttgtagcattcacacaccaatctcctgttatactgtcctacttgtaatgtgtgaatctgtaacaagctgtcatttattaagcaagatagtcttttaacaaaaacctctgagggcttttcaaaacctcatctttaaaaatctgtaaaacaaagataccctatgtaccctgaaaaaactgcttatttcacatatgtgaaaaacaataataa

SEQ ID NO: 79683 - DNA, 2692 bp, Homo sapiens
gctttagcaaacaacagaatcacctggagggcttgttaaaacacaggttggccgggcgtggtggctcctgcctgtaatttcagtactttgggaggccaaggctggcagatcttttgagcccaggagttcaagaccagcctggccaacatggcgcaaccctgtctctaagaaaaataaaaaaaattagctgagcatggcggcacttgcctgtagtcctagctactctggtggctggctgaagtgggagaatcacctgagcccaggaagtcaaggctgctgcagtgagccatgaatgtgccactgcactccagcctcggtgaagtgagtgaggccctgtctaaaaatatatatatttaaaagaacaaacaaagaaaagcacaggttgctgggagtcccaccctcagtttctttctctgtggtctgagatgggggtgagaatttgcatttctaacaggcacccagctggtgctgctgctgctggtttggggtccacacttaagagatctgctgctgtagtccacgtgcagatccacaactggcttctgaagtaatggggcttcaaagtgagattgcccaagttcaaatctctgcttcaccattttattagctctgtgaccttggaagagttcctcaacctccagatctgtttcttcagtaaagtggggttagcaatggttcagacctcacgggactgttgaaaagagtaaatgatttattttggataaagtaccaagaacagtgcctggtatttgcagtgatgatttgttctttgttctctgatgtttttttcttttaaacctttttcagtaacgcatccccaattaatagaattgtacaaatcagtggcaattccatgccaagaggaagtggctccggatttaagccatttaagggtggacctccgcgacgattctgaaaatgagctctctgccaaggttttaagataatttattgaaatctcctgtaaactttacttgactacttatgaagaggacctctgacttgcttgagagttctgtcagacttttctttttaaaaatttaacatgattgcttttctcaattttggagaagatgtttaaatagttctgttgtaacttttaatagttttgtgtatcattcaactttttttcttgcagcaccgaggcacatttgaaaagatggaattgaagtcgttttgtttaacgctgtgtgaatataaagagtagtttgcagctgtgtggtagtggtttaatttgcagccttagctctgtggtgtctggctctagagttacttctttttaccaagcattttcagcctccattttgaaggctgtctacacttaagaagtcttagctgtctaatttttagagaataagattgttcattgcatttctgagtattatgtaacctatttttgcagaaggtactgttacattaagtgcatctgtgtatcctggtttaaaaaaatgtaatcttttttgaaataaaccttcatattctgtatagttgctaaagtgttgagaacctttttaattgtaaaatgagaaccgattttcagtttagtgtagcagcacacttgttcaggtttgcatggtatgaaaccaaatagattcatgaaaccttggccatgaggtttgtttcacaaggttcttagaccgagttgtgcaggtaagtgcacttttaggtaatctgcactgtttgtttgatggataaattccatctctgggaattgtgtgggtattaatgtttccatgttcccaactatgttgagaagtggaaaaaaacccaggttctagatgggtgaatcagttgggttttgtaaatacttgtatgtggggaagacattgttgtctttttgtgaaaataaaaatccacacctggaagtgtatgtgtctttgttttcagcgttttaggtgttagtcgtccagttctttctgtagttcagcccaaggtgactgactagatatagagctataaaggcattcttttggtctttgttcttcagaaataaatctagcttagactcttcacctcagtagctgggcagcacatgctgttcacatgttagagacttaaccactaatcctatggcttttttaaaggcatctcttttaggaaagcccttcaaggtaaatgctgctctttcaaaaaagcttcccacatccctttatataaatcagtgaagaaaaatccaaatggtctagattttggtaaattcagcactctctatgctcaatacggtcatgcccatgagatggctcacacttctgagtgccgtggggcaaccaaggttctgtggtctctggtcctttggggaacttctctggatttcttacgttttctgccattcccagtcctacagctgtgggagcaggttgggtgtctgcgttggtgtaggggaggtctacctcatttttgatcactacgtgttgtagagtggcacaggagaagcctcagtatccattggagtgaatgttggtgactttgggttagaatgtcacttctcgttgtttcctcatttgtagagtgggactgtgcttcttagaagggattatcatacagctgcaaacactggctaagcgctttacgtgctgggcaatgtgctaagcgtttgacatatgttcccttgcctaatactcagaagaatcctcctagccacaggtagaattactgacctgaccagttttcagatgggaatctggatagtaac

SEQ ID NO: 79684 - DNA, 1552 bp, Homo sapiens
caccatgcccggctaatttttgtatttgtagtagagacggggttttgccatgttggccaggctggtctagcacttctgacctgaagtgatccacccacctcagccttccaaagtgctgagattacaggcctgagccaccactccccgcctcttcttatctttaaaactgtggaagcactgattgctttggatatgcctcaactgttaagaacagtaaaacattcttcagcttggtagtgacttttgagtgttcggtatcatttctcctgaatgctaaaaaaccaacctttaggctagacacttagttcagtttaaaagaaaatgagttgtaataatcaataactagcttttttccatggctttgccttaagttcattttttggtttcattattgtaggttatgcagacaaagttaagaagaattaagcactcaagtaagcacttcttggacctatattctttgtttctaatcaataggcgggatcgctttgttggtcaaagtgaggggaaaaaagcacgacctactgcacgaagggaagatccaagcttcgaaagatatcccaaaaatttcagtgactccagaagaaatgagcctccaccaccaagaaatgaacttagagaatcagacaggcgagaagtacgaggggagcgagacgaaaggagaacggtgattattcatgacaggcctgatatcactcatcctagacatcctcgagaggcagggcccaatccttccagacccaccagctggaaaagtgaaggaagcatgtccactgacaaacgggaaacaaggtagctgtgtactatgtaatgctttcctagtggtctcatgcattggggttaaaaaaagttaagattacagttttgatcatgtatgtttttatgttttgtttaacagagttgaaaggccagaacgatctgggagagaagtatcagggcacagtgtgagaggcgctccccctgggaatcgtagcagcgcttcggggtacgggagcagagagggagacagaggagtcatcacagaccgaggaggtggatcacaggtaagtgctgcgggaggcttgccgcgagcctgcacacatacatttagaggattcatgagctactctggatatacagtagcattttgatgtggcttagattagctagattggaatgattcagaggcattaattttttatttaaatttttaaaatctgaatttttctcatactttactgtcagtagttgaccatcagtagtccaaagagttaaggtactagccttgaaatactccatttcgattaaacttcccagtgaaatttaagaattgttaatttggtaagtgagcctatctaatgataactttggttttatttctttttaagaaattgaggctttcaaactgcatctgaaatctttggcccctacttgtgtttccttttcaataaaatattcttggccgggcatggtggctcatgccaacactttgggaggtaatcccaacactgtgggaggccgaggtgggcagatcgcctgagctcaggaatttcagactagcctgggcaacatg

SEQ ID NO: 79685 - DNA, 1020 bp, Homo sapiens
aagtatgcccatttaatcttcttaacataaattctatgaaactgagttgattgtgtagagaaataggtggaatgaatgaactgtgcttctgacttaccactctaacgtttccaaagttaaggataactgaagaggttgtgtgaactggttagaattttattataaagtggtttcaggtattttatttgtcttttccatttaatggtatcatttctcctgaatgctaaatgtcttttccatttaatggaaaagacaggcagtttttcaactattttctctcctgttaaattcctctcacactatttgactttatgtaattcaacaattaagtctttgctagtttgtactcctgatgtgttatgtcttgagtttactagccctgttatgtccacagttctaacatgtggtatgtatgactccaagtaaatgtcgtttgattactgtagaactaatttatgtaaataagcaaatatttctcttcaaggcgagatgatccttactggagcgagaataaaaagttgtctctagatacagatgcacgatttggccatggatccgactactctcgccaacagaacagatttaatgactttgatcaccgagagaggggcaggtttcctgagagttcagcagtacagtcttcatcttttgaaaggtagatatgttgaaaattgttatatttattttatgagccttgctagtgataactctgtttctcctaaaatcttaactggaagtaccaggtcagaactgaatgctcagaacaatttacgtggtttttgtttctgttaatgggaatgtgattcagtattccaaattaattaactagaacaccattaagcaggttggctttatcttcttatctttattctattttaattttttttgagacagggtctcattctgattcccaggctagaacgcagtggtgcaatcttggcatactgtacctctgcctcgtgggttcaaacgattcttgtgcctcagccacccaagtagctgagattatagacatgcacc

SEQ ID NO: 79686 - DNA, 1564 bp, Homo sapiens
atcaaagcaaacagtatttattaaaaatggggttgagttctagactgacatattatttttgcttaaggtgtttggttgtttttaatggtgtgcatgtccgttgtggcatctgaaaggtatgagaggtgttggatggttcttgttgtgtacgactatcctcactattccatgcatcaataagatacttagataccttcatcctcatacactaaacactagtatctgccccatggtcattgtgataattaaaaatatcccattgatttctgtagaaatagtactgacccattgagaaccactgggttactagagaaagacatgctgatgacagaaaaggatgctgactaccttacagtaagaaaataacattaaaagtctaatacaataacaattcagttcagtgaacaattgaactacctctgactcagaaaagcatgttacctggagccatctattataggatagtaaacattccaaaatagcccttaaggacaccattttgttatatgtagtatttgctattattgatgttcattgttatgatcccaaatcatcaaagtatgtacttgtttaaggagatacaatagaatatataatagggattagagctttttccatcaaaaacaagtgttggaagttgtagttttgtaaatttacatatgcagattacatccttctaaaatgtcaattaattaatggactattatagtaatttttatttaaacaggaatcatctaagaggcaactactctatattataaaatttagctgctcagttgacagtcttatttatagataagtgaaaatattgggatctgtttaaagttttactttgaattctctttccaattacattaaaactacttagattgagttgaaatttaaaattgccaacctcaaggaaaaattcaaattcaaagctattctctttcacacagtgctagcataatttaagtatttctaaatactgatttttggtagacgaagagagattgcagagagagagcgtcgagagcgagaacgcattagaataattcgtgaacgggaagaacgggaacgcttacagagagagagagagcgcctagaaattgaaaggcaaaaactagagagagagagaatggaacgcgaacgcttggaaagggaacgcattcgtattgaacaggtgcagtcagaaaatcttttcatcttaaataactcacctttttcagactctgtgattttagccctaaaacttgctttacttgttgtaaagcgtctatagaatgagtttagctaaggagcttttaagtgtccctgaaagataacagtgaattaggtactagttaaaaatagaattagtagtgactttgttctagataactggtaataattctagctctgcaatatcatggcagcctaatagtctgagcataggactatgagtccagagtagttgtaatccaggctctgtcactatcccagtcttagaaaataataacgatttccttacatattatagtgggaatgatttcccaaggctggaaggaaataatgcctctctttgcagaattgcacctcagggttt

SEQ ID NO: 79687 - DNA, 3689 bp, Homo sapiens
aagagaaggagtagtcaaagaatactcaattaataacaaatgctttgaattgtgagccgcatccctgacggctctcaatactgtctacttacattatagtttttcatatacatcaaatagttaatgtactccagtgtaagctttttgaggtcagggaccttatttagtgtacttcatgtgcacatgataggctttcagatattgaaattactgaattagtgaccattattggtaaatagccattaatattaccaaaacctgtcctcttgatttttggagggtttttttcctgcttcaattagtgagttgcctgagtgtaaaggaggttcttgtaggtgtcagaaatagaacactgagaattgtagtcccatgataggctgtgttatattttttcttctgttttcaataatgtattgttagagatgtgaaaacaatattttaatgttggtatttattagtagtaaaactatatgaggataccatttatttggtaagaagacccgtggagttaaaaaataaatggctatggagcaaatcagcctttcctagggttgaggtaaaagttgatttgttccagccacccataccataaaactcctgattttcctgtttacttcttcccagctttatgtctttactcttctttgttcagcaccgaatcgttctctctcttttcttctcactcatccatccctgctttgtctctcttaactaaccatcttacacaattgcaattatttgtcatgttcatatacgttttaaaagcacatagattgaaagtgttgtctttcaagctttagggtgtttttcgggggatgcatttttaagtccgcttttttatatgtgattggttctttactcattatagaaaagtgttaacactcatcaataaaatactagaaactttctctaaagacattcagggtgggcctatgatagggatattttggttcaaatccaatttatttgcttttattaattgtgccattacttcattgatgagattgtgttttggctacatatttgaggggaggaaataaatataaaaaggttaaattgctttttggcactttaaattgttcccctgaatatttactaagatgggtaacgtagatggtgatcacaagaatatgaaataggctggctgcagtggctcatgcttgtaatcccagcactgtgggaggccgaggtaggccgatcacctgaggtcaggcctttgagaccagcctggccaacatggcaaaaccctatctgtactaaaaatacaaaacttagcagggcatggtggtgcatgcctgtaatcccagctacttgagaggctgaaggaggggaattgcttgaacccagaaggcagaggttgcagtgagctgagatcacaccactgcactccagcctgcgtgacagagtgtgactccatctcaaaaaaaaaaaaaaaaacatgagacagaataagatacaccctgaattaatatatagtttcagttgtgaagtttcatgtatttagaagtctgtgtacttggaacgttgtaaaactctctaaagtacagtctgattttataggttctgagtgcaaaagtagttacaaatgctcgaagtcctggggcaaaatgctatggcattgtaactatgtcttcaagcacagaggtgtccaggtgtattgcacatcttcatcgcactgagctgcatggacagctgatttctgttgaaaaagtaagcttccctaactgtttatcaaagcaagtctaatttgatggctagttctcaactcatagctgttaacagtagcagggagtagaatttgcagtgatttttaatttttatgtatttgtagtttttactctccttatatttttcctatcgtttccaaattttctgccattagcacacttcttataatcacaaaaatgtaaccatatgtacaaattgtttttctggttcgaacctttcaggtaaaaggtgatccctctaagaaagaaatgaagaaagaaaatgatgaaaagagtagttcaagaagttctggagataaaaaaaatacgagtgatagaagtagcaagtaaggatttatttttatttatttattttgataagcagatagacttttttggtacattatgaagtactcattctgtttttttgtctggggcggtatggtcaggacacaagcctctgtcaaaaaagaagagaaaagatcgtctgagaaatctgaaaaaaaagaaagcaaggatactaagaaaatagaaggtaaagatgagaagaatgataatggagcaagtggccaaacatcagaatcgattaaaaaaagtgaagaaaagaagcgaataagtatgctatacatcttttcaatccctttctaatgcattctactacttaatttttacagtggaagggaaaacctgaaattctaatccagatataagctttgttgttaggtgtcattgtggtaggaaaggaggtctagtaggagtaattgtcttcttttctactctggggaaacaaacaaatgtattcttccagctaagctcctttgctattctgggctgacttaaaatggtcattgattagtactattgaattaggatcttttggtatcactgaaagtatttatgttagcagactgaactgtttaaaaaactctttgcattgaagttcttgtagaataagtagtttttttatttcatgtattggtgtgtgactatcagaatttagcatttttacatacatattttctttctcaatgaaaaattttagacattgttttatataatttttttcccttaggttccaagagtccaggacatatggtaatactagaccaaactaaaggagatcattgtagaccatcaagaagaggaagatatgagaaagtaagtctctgatcaggatggttgtatactacttcagctgtttacaaaagaagataattctgtttttccataaccatctttgcgtacttgcatgctagcaaacccaagaaaaaggaaatgttactagtcatttgaactttttaaatgacctactaaacttgaaaaataaagccccaaaatattttaatttctagtgttcttctaatttttttctacagattcatggaagaagtaaggaaaaggagagagctagtctagataaaaaaagagataaagactacagaaggaaagagatcttgccttttgaaaagatgaaggaacaaaggttgagagaacatttagttcgttttgaaaggctgcgacgagcaatggaacttcgaaggtaggaagagagtctgttttatacctgtctttaaatataggtaaatatttaacactagttgtaagccatatttctggaaattgtattcccacagaaaactgtttgccaccttaaagaagttacggtagcatctaatgatttcttaagtttgcatagcactttacaatttacaaagtgcttttccatctgttgtctccaactcaacagttctgtaaggctagttatgcccattatacaattgaaaaaaatggaggcccagagaggctaaatgactcttccaatggccacatggctaacaagtggcagagtcgggactcagacccaagtcttctgactccaagtccaatgctctttcctcaacaccaaagctgctgccataaaaaacatgacttcaaaggaaaaatttgagataagatagtttcaaagtagctacagtgttcaaa

SEQ ID NO: 79688 - DNA, 3926 bp, Homo sapiens
agtcccagctactcaggaggctgtggcaggaggatcacttgagcccaggggttgaggctgcagtgagctatgattatgctgctgcactctagcctggacgacagagtaaggaacctgtttaaaaaaaaaaaaaaacaatcaaaacatttcttaagccaagcgtagtggtttgcatctgtaatcccagctacttgggaggataaggtgggagaatcagcttgaggccaggagttcgagaccgcctgagcatcaatagcaagacttgtctctaaaaaataaaatgattctttaattttttcagttattgagattataatgcatattactttattctttatagtcttatatttgggaaaatgttggttctatgttggtttgattacttcagtgatgtttgcattatttgcttggtagaacaaattaagcttctcccttccctttatgactcttctgtttttaagctagcacattcttaattttaattttagccaaactgtcaaatatgttaaaattaaagtcatattttaaaaatgtgagggttaacttgttttaattacttgtcacacaaataccattttaaaattggctttgccatcggtatatgtgtgacaactatgaacttttttttttttttgagacagggatttactctgtcacccagctggagtgcagtggttgatatgaactcacttttaacacattaaaagaatgaataatttgaaactgacctagtaactgttcttctaatgtctgatatacttaaaggggagtattgtttgtttgtttggtttattactgtgtattcaagcacttgaaagttacgtctacagattatactttctggtactgttttgaatagtatatcttagctaagagtacctgtgaactgagtgacgtaaaatacgtcatcaggtcagccttcttattgacagctctttgatatgaggaagaattggattatataaactagttttgaatagtgaaactaatccagtttgttatttatgtactcattgatagatatacctgttttctaaaatgtaccaaacttgtgccacatatctctctacatggactctggttctgattggaatagcctatttatttgttagtgttaggtatccctaaataatatcattaaattatccaccaattttaacttggctgattttgtactattactaaaatctagttttatgtgaattcattttacatttgattattctttgaatttcaggatggtgaggaagaagaaaatgagaaaggtatgtttgatgctagagcttaaaaattgctaaaatttagaaaaacagtaaattatgtaaaaagcactccttatttgaaatcttatttttgaaattagtttattttcaaatttatccatttagtgaattaagttagcatcttgattttattttccaattggttttaattttcttttgaacactaaagatatattgcaacttaatagtacatatcagttactgtagtgaacaatgctattttttatttaacccaattttaattttatttttaaaataacttctggtatacggtaagttgattaaattcttaagactgacactgcagtaactcatgtgtgcttattggagtcctagtgcataactcacagtgaattttacaactagtcctaaaaatgatgaatgaccaggagactgactttgtgtttgctgcttagagaaacttccatacagtcgtctgacaattttagtttagacgagctgtctcattcaatacaattacaggggcaacagtagcaatacatgtggtcagtaggaggttatggaagagtccttggacagaagtcaaaggatcctactttggactagaaaggacatggagcagggttaagcaaggcaaataaaaagcctagaagcagtgatgaaatgaagctactgactgaaaatctcacatgcccgaagcctttctgttttgggggaatgcaagacatctttgaaaacggtaattgcagactgactggacaggatgaagactggaaataaccaatttcctgaacgtcacggagcaggagcatctttggagccttctgtaccagttttccctacgaatccggactactcaagcattgaagagtggaaaagatggggctctgaaatactctgaagactgattgatatcctcagactgttacctgtcaagaagtcaccatgggagttctgaaggtcactagggttcaatcccaggataattccagcattgaacaacaatctgcacttttgtcactgtcacatggaggaacaaaatcttccatatgccattaacttataaccagaaatgaagagctggtatcttcaggatggaaccattttctcactattgttgtttggtgtttgtatgtagagatcattttttccatgaagaataagtgatcctgggtaaaggatggtttatgttagttaatacccttgtgttttttttttttttccctaacttccatcagtgctaataactggctttatattttctaggtcctattctagcttatgaatatgaaattgtttaaacttcttgttttgccatatttattcctgttaaatcctcttagatatagcaggttctggtgatggtacacaagaagtatctaaacctcttccttcagaagggagcctagctgaggctgatcacacagctcatgaagagatggaagctcatacgactgtgaaagaagctgaggatgacaacatctcggtcacaatccaggctgaagatgccatcactctggattttgatggtgatgacctcctagaaacaggtaaaaatgtgaaaattacagattctgaagcaagtaagccaaaagatgggcaggacgccattgcacagagcccggagaaggaaagcaaggattatgagatgaatgcgaaccataaagatggtaagaaggaagactgcgtgaagggtgaccctgtcgagaaggaagccagagaaagttctaagaaagcagaatctggagacaaagaaaaggatactttgaagaaagggccctcgtctactggggcctctggtcaagcaaagaggtttgtttttctatgtcagttctttacgatactgaattccagcattcaataagatcactctacattaagggggtggcttcaagaacatgtacagtaattagtgtcttatgatcctgcctataatatttttgaccgtcataagttacttttaaaaattttcaagatcttcataataatgcagtgtgttctactgattgcattgtcgaatgtcagcatatatttggtttttttgttgttttttgttttttgtttttttttttcaaattgacaatttttttgtgttttattttttaaaatccttgtgatgatggttaatgaacaactatcagttctaagaacacaaaatgaagtcaagtcccagtcctgaaatctggagaagatggccatatttccactgaatagaattgtcagaaaatctagatcttcaggcatcttggggaaaatcagtgcaagaatcctcagggagtcatttgttcaaataacctaatctaggcctttggaattgttaatttgtatgaatagcactagtttgaaatatagtaaatatcaagctgttctgttttgggtttgtttttgtttttgttttcaattttcttctggtgatttgcctctttagctcttcaaaggaatctaaagacagcaagacatcatctaaagatgacaaaggtaaagaatttttttccctatttatttcagtgttgacattgtgtattttcattaaaaagtagtagttgcgcggtgttttctttgacatttagtccttaaaaattttattgacagactagaaacttgagatggtctttatataaactgtggaattatatatattacagaaaactgattgatgtgttactgtttactttgtaaact

SEQ ID NO: 79689 - DNA, 1872 bp, Homo sapiens
taatcatagattctgatgtagtatatgtgcaattagtagtcatttgtagtgttgttttactagcttgaatatactgcttacttgagaagtttctggagctttttctctaaaatcttgtttgctaatactttaattttgttgttgttgttgttgttgagacctggtcttgctctgtcgtccaggctggagtgtggcgacgcgatctcccctgactgcagccttgacctcctgggctcaagtgatcaccgcacctcagtctcctggtagctgggactacaggcgtgcgccaccacacccgtctgacttttgtattttttgtagagatgggggttcgccttgttgcccagtctggtctcaaactcctgagcccaagcagtccacccatctcggcctcccaaagtatttggattacaggtgtgagccatcatgcctggctttaatatgcttttattcttaaaaatttcctctagtttcaagaacctcttcagtctataacatcatgtatattcctttttctatttgcctttgcacctaatgtttcactaacatgaaaaatcttactttttgttatataaaaatctgtatacctctcacagccagattcacctcttatctcctccacaaagctttctttcatctctctcttttatgtagtgctttactattcacagagagctttttatatccattaccttactcaatccttgatatatcttatatggttcacatgtgaactccattttataggtaaattcatctagatagatgacatatcacagagtaaaactatttcagtgataacgacagggtaaatacctaggtgtgatgatgcctagtctgatattcttttcactaaataactccacactaggaaatgttttctgagttctatcgtacttaacatagtgccaaagttaagtgcttcagatacatgaaaatcaagcagttagttcagtctttccagctaaaaacagcagtcttacactacatttatttagtaaattcattcaacaagtattttttgagtacttatgtgccaagcattttgtatttcccatgatgtttagcatattccccgataggtaagtagtggtttaaaagttattttgaaagtttgttttaaatgtcagtctgaatacagtgtttacatttcaagccaggggaaaggaggtcttcttgcttagcctatacatgtacagatatcataagataacctatggggagtagtagaattggatatgtagtaaatacttggttcactgaaaaataagtcctaggcttgtctttgtctcttagtagtcattgctgcttctaggatgaaatgaaagtaaataaaggagctttatgtattttagcatttgactaaggattgcacatcccactgtgaagataaacaacatgagtacttaccttgtagacatttgcttcatcttcatatgtgaaatttttttttcaagacaaacttgagtggttaatttaaaaagatgctttacatttgacaaataaatgttttacatttacttgctatattcctcatttggaaaaaaaatctgttttcagtgggagaaattgttttcaaatagttgcatatcatgtctgtgcatatataccatttagacagggaaagtttcccattgtatttcttggtttgtttccttattgcaagtattttggattcttatttaggacttatggttagtgctatgcttgctgcacatactgcacagtaaaatcaataggcatttacgtgtggttcatcttttctactttacccaagttgtttttgtgctccaaccacattgtaatcagttttgttttctagaagctgggtcagaccatttcctaccggcatataaatgtatgtcataaagt

SEQ ID NO: 79690 - DNA, 1244 bp, Homo sapiens
tttaaacagatggaaatatatctgaaggaagaacagttatgtatttcttatcagggagcaagattttgccatattgtatcaaaagatgaggttacatttttagagaagttttctttaaaatgacctttttcctctttctaaataatgtctagtggaacatctagaaacataaatgtatctaggttccattatgatctaatgcttctaaacatgcttactgagtatattactatgtgcattcagggatactgcatagtgtaacaatcacctcgcttcagctgttttcaaataatggccagtcttattttcccctatgcctctgtttactttctcccttctgcattattttgaaacaaatccaaacatatttcccttgaaaattttcaatatgtatctctaaaagagaactcttattttttatattagcactcctaaaataaaaattttaatattatgaaacatacagttaggattcaaatgttcaattttctgtagatttttctctattatatgctgtttaaatccagataccagtaagatctgtatgttgtgattgattgaaatgttttaggaggttttcccttccatctgttttcctcttactattttatttgttgaaaaaagcaacttgcttatcccatagagcaagggttggcaaaaacaggcatctcatgtagtttgccagttgctgctatagagcttccaaggcctggattttgctgattacattcctgtggtggtgttcaacatattcctttgtttattgtattttttgtaaattgttaaggtggttgtagcatctagaggcttgctctcagattcagcgttaacaccccactccagcacacacacagccacctcataggtgtagtactgtattcttctatttggatgcacataatatctggttgtctttttgtgatggtaccagtcattgatgattcatacccaattaggggttgcagagggatgctattctaattctatcattcttctttattggttggactgtttctagaaagagaaactttcccttatttactatttggttacccagtggtatcatttacacaggaaagccaggatatatgtttgattctttcctttttatttaccaattttcagaatattgagctgcttcactggcatctctgacagtggccagttagttcttaatttttccttttttcccctttagattcattttgaactcatggatttgaatatatgtaatgtattttggt

SEQ ID NO: 79691 - DNA, 1648 bp, Homo sapiens
tacatttctttggttatatcaagggtggggaattacttatgaaagtttaattttaaagcagataatatttcaaatattttctttgaaatagaccatttgtcctgccttgaagtatgttagtacattttaagaaagtcagtgggttaaggagtcagtgctgttagtattcatgcttaaaacacttcccttctacctaccctaataaatgaggggctcaagagaaatatttctaattctctagcgacatggctaattttttttggcataaaaaatatagtctgaatattaagcattgatttagtacccatggtatcgcagatattatacagaacacaaggcaaatgataatcaggtgtaagcataaaagcattctcacgttaccccgatattttataaagcaaagctattgtatacccttttacttaggaaattgaagctcaagaaggtgaagatgatacctttctaacagcccaagtaagtttacatttagtcctatgaattcgatattgtgggtggacgggcttggaaaaggaatcttattttgacttcataattctttaattcatataactgtcttaaatttaatactgagttatttacgtgatgtacacaaagtacttaaaactattggcaaggtcgggcgcgctaggtagctcacgcctgtaatcccagcactttgggaggccgaggcgggcggttcacgaggtcaggagatcgagaccatcctggctaagatggcgaaaccccgtctctactgaaaatacaaaaaattagctaggcgtggtggcgggcacctgtaatcacagctactcaggaggctgaggcaggagaatggcatgaacgcaggaggtggagcttgcagtgagccgagattgcaccactgcactccagcctgggcgacagagtgagactctgtctcaaaaaaaaaaaaaaaaactattggcagctgaaatttttgttgccagaaaaataattggagttactatgagtttcctgtcattttcagagttttagaaaaaagtccatcctttctgtaaaacctaactctggttactagtcttttgagaagtctacattcttcttgatttttttcttgtcacttgatataaaataagtcatttaaaagtactaatatccttttcaaagctttatttgaaattttgttaatgtaacactcctacaacaggcatagtctaaaaatgattaaaaatttctagaaatttacttggggtgtgtgtgtattgaaaatgactgcacttcactgtgtaacaacgtgttgctgctatatgtgatacacatagtgtacattttaaagtgacttacagatgctgtaagcagacatctatagatcagtttctacataaaaattatccattgtctttttctcatatctgtgactaaagaaccctttgtttttgtgtccttaattttttatttttatttttaatcttataaaaaccagagagggtttggtggttttgatctgagttggttttcatctgataaatgcatgcatcccccgtgaagggagtcagcgcccattggtatgtgttagctctagaattagcacagttacccaagtaggacaggattatgtcctctttaaatggtgtactttcaaatagagatatgggttcctttgtttact

SEQ ID NO: 79692 - DNA, 1089 bp, Homo sapiens
ctcttcctaattgacatttggcacagtggtagatttcaaaacaaatacatttcaattagttatttgcatatttttcaagaacagacattgatgcagcagttgggagttctttattattagaaataaactttgttttaatgtataagacttccgaagtctttgaagttaaatcaacatatggcacatggaaaaatgaagccgtattttttggacagcttctagaagctggcttggtaaatattaaataactggaatttagagcatctctagcagcaatttgattagtgtgcattttagtgtgagaaatttgagaactcagattcgtgtttgatgatcttggtattagacctatttttaaagacacagtaaatatataaggtaaaatgaatgaactttgggaatattaaaatatgatcaaatttgacacatttaaaggtgtaaattaccaaaaacgtttggtggatagcccacactactttgcctctagttgtaccaaattttcttaccattaaaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagaagatatagaaaaagaggacatcgaaagtcaggtctttagccagttttttttaaaacatgacacagataaattaagttttaaataataaaaagtatttttttctagttcaatttggaagtctcagaatttttaaaagatgtgttactaaagctacttataagtcatctaaaatcctaccaccttaggcaaccttttaaatttttgcttatttcatataatatatatttatacatagttgttatagagtaagttcctatttattctgtattttcacatgacgtataatttcataatttccccataatttattagactgctttctacatatctaatagacactcctttaattttggacattttaagttttaaggcttttttcctactccacgatgaatgaatgtaccaat

SEQ ID NO: 79693 - DNA, 1025 bp, Homo sapiens
ttcatttacccacccatctctcctgcctcctagctctcttcactctccacgctgcacacacacacacagacacaaccccacccccaaaagatgttttgttgaggagttagccctgaaatcagttaattttaggaactgtttgcccagggatccgttaaaattgatgattgcatgcctgtaatcagcttgtgtttgagcctttaagttttggtattctgttacccttactatatatcttccatcaggtttgttcctttgttcctattttctccagttgtcttcaccagtaagtgtatgattaagcaaagattatccataagctgtaaaaacattgtgactcagtaaaaaatcttttacttttcaaatttgtttctttcagctcttcagtttataaaaatgttacagtcatttgaaatggcctaaggagatatatacgtctattgagacgaacaatagtactgtctcttatatgtgccacaaaggatgcttttgtgttatgattaaataaacctggtcataatgtctaaaagaacaagggaactttttttttgtttttgtttttgtttttgtttttgtttttgttttttgagatggagtctcgccctgttgcccaggctggagtgcagtggtgcgatgtcagctcgctgcaacctccacctcccaggttcaagagagtctcctgcctcagcctcccaagtagctgggattaccggcttaccgcaccaggcccggctaattttcgtattttagtagagacggggtttcaccatgttggccaggctggcctcgaactcctgacctcatgatccacccgtcggcctcctaagatgctaggaatacaggtgtgagccaccatgcccagccctaggagctttttaaaaattctgtgtaaagatatcttcagtttatttttggaagtatcaacatatgtgatgtatttgatagaaattaagtgaatatattttctcatctcccacagttgataattttggaatttatacagtaatggttggtaaatatcacct

SEQ ID NO: 79694 - DNA, 1619 bp, Homo sapiens
gtaatttctgcatgccttaaatcagttattatgttaagtggccagcactctttatatttaggcttttggagaaataaataattagcataaaagtagtcactgtatttaaagaatttcttctctatgaagaggcaaggtgtactagagacagagtacaaggcaatatgtaatcaaccacctgatggattgtaagatgaagattaaagtgtgaggatttttatttcagagaatgcttgttgaagagaagaacataggaaaggctttgtgggaggtacagatcttgtacttagctatcaggtgtctatatatatagttagtagaatgccattgaaaggtatcacagcttctcagataactgaggatagaaaattcaactggtgtaaagaaaaatgcaccatatatgtcaagtcagttaagctgatgggttcatatgtaggattctgtgcacggtgtatttcaatgaagcagcatgacataggaaagctttttttgtttgggacagctctgagcaggtggtttagaagcagttgacattagctttgtcagatagtttgggagtggagagtgctattgcagggtaaactctgaatattttttgttcttaaagtaataaaatattggttgttagcccattttccttctttcgcaggtaaaaaacatgaagcagatgagttgagtggagatgcttctgtggaagatgatgcttttatcaaggtaaagtgttaattactcaggttaagatgcttattttaagcctagtattttgcatcatgaattttgtgctttttgttgaacaatggtcactgaagtatgtaggttaaagataaagacctatgtaatattgacaacgtttaatattgtcaatctcattaactctcataattgagaaatatagtaaataactttttctttagttaaatgagatacaaaagctaaaattaataatctctccaggcctttaggtagaaagctggccaggggaatagctacgagacaattgatatacatgttagttcctggatgagatatcacagggaaggatattggtaatttgttttttatctgccattgcatttagcttttgtatataatatacagaacttagattaatgtagaccttaaaatacacagagaaaattgctgatgtgttactacttggtaaagatcaaattaagggccaggcgccgtggcttacgcctgtaatcccagcactttgggaggtctaggcgggcggatcacttgaggtcaggagtttgagaccagcctggccaacatagtaaaaccccatctctactaaaaatacaaaaattagccaggtgtggtggcgcatgcctgtaatcccaactacttgagaggctgaggcaggagaatcgcttgaactcgggaggtggagggtgcagtgagccgaaattgtgccagtgcattccagcctgggtaacagcaagactccgtctcaaaaaaaaaaaaaaagagagagagagagatcaaattaagaaatttattttgccctttaaagataaataagctaggccttttggggccgaaaatgagtgtatttcaaaactggctggccagaaaaattatggatgtaattttaattggggttgtggcagttctat

SEQ ID NO: 79695 - DNA, 1032 bp, Homo sapiens
actaggtcccctgtaaggctcttttagttctgaaatttaataattatatagacaaaaatgagaagaaaatgctttctgtttaactaaaatgatgtttaaggaagcaacaggtaagctcataggaaatcagtatcgtttttcttcagcacaaattattagaaaacgaaaagtgccaagaaggggattacgtagaggtaattatgtagacatcagcgagacataatatataatagctggtcaggaaaagaaatgattcttatgacaatattaaggtagtgaataaaagttaaatgacgagaagcttcataggtatggaaaaaatactttggtgaaacattgagcttattcttttataaaataactatagggtaactttcttttaaaaatgtatgttaaaatgattctatttagagaggttagagggaaaggaacctacatttttaagtttctcctagaatattttttaaatgcagctattacaagcacaaacaatgttgataatgttatagtgggctctgacatttatatcaacatatttataaaattcctttacatgtagttaatagagtagatgtttgtatcttagaatggctttcctgagtcttcacactctctttgttatgaacttttaaataagtaacttaggagaaagcttcacccattgaagtttacggttatattaattgggtgtgtgtttaaaaagtagttaaacaggtagagctaacttctcattaggttgttttagagattatagatttaaagacttttggtttacctgatgctggcatatccttttcttttaaaatttcaacctttaaagtcaccaattaacttcagcaaaagtgatgtggttaatcagtacagtatttagaactatatgtaatgcaatacttaccgacattaaaactaatttgcaatacctggcagctttaaaaagactaaaaatgatgtgtacaatctgatttttcttctatagaaacaaatatattttgaggttataggtttggccaaacatctaatgtataatttttt

SEQ ID NO: 79696 - DNA, 1003 bp, Homo sapiens
atattaacttctctttctaatgtaggctattgaagaggaaggaggcgatccagataatattgaattaactgtttcaactgatactccaaacaagaaaccaactaaaggcaaaggttgttacgagttatgaacatgttttaaaatatattttggttatataacttgcctctgctcttgtgcctcttgccctgtttatatagtgctactctttgctatttccctctggcagtctgccttcttgggtcaaggaagaaaagttactgttgccaggctttgggtgacttgtagcccttaagattcggctgaagctgattagaaagtgagaacagttctttattgcttccggaaaaaattacaaagtcaagttgtgtaatgatgcttcatagtgtgaagacctgaataaaatacagtttaacacatgtctaccttgccccacaattggcagagttttgatggaattcctaccaaatcttttaccttgcctccttgctgttttctttagtatattaaaattctataacctttatgtttagtactttgtttgacttggtgaacttaatttgcatttatgccattatacctcctaatttttagtgaaattcaaaaagacctcaccaatcatactaacaaggtagagggaaaaatccatgattaattagcttaaaaaagttttaaattatagggatgttaaagattcttatttttaacttttaagctagagcaaaatatatttatttctaggatataatgatttagtgactagctaaaagtggttttaaatgaacgttttgcagtatgaatggaacttaggtattttttaaagcttcttggtaaatgaaacctttatttgaataactgcaaatttctccctcctataaggacagtggcagagggtggacatgatatatctggattctggtctttacctacaattttcatgcagagtttgtcatgaacagctgctgcattttttgtaatctaattttctttactgctttaagtg

SEQ ID NO: 79697 - DNA, 1347 bp, Homo sapiens
cggacccggggagttggagggcgctaagtcagccctgacggctagggagtcgcctgctgctgctgtgatcaaggaaacgtagtccgcggaacagctgaaatacagacgcgtcagattttgtatggagttggcttgttggtcatttaaaaagaaactgatgtttttactattgtccttcgataatttatcagagtcagtgtcagtgctatagtgggaatatctgttcagtgcagcagaaatagatttgttacaacagttcttaaataggttatagtagatagatctttacagatgggtatttctcaacctaagttttgattattcaaaaaataccagaaagtatgaggtattcatttaatttgttcgtgtgtgtgttgtggggtgactccattgtgttgttgtaagctttcctgtttcttgatttatgtgcggcattaatttagaattctcttgaatggtaagatgccagctgacatagactacgttttgtaggatttcctgtagcttttgaatgtgacttaatctaaactttatttcatttggtattttatctataattttcttgttttaggggcctcttgaactaaaaagaacaaactgggaaaaacataagctaaggttccatttcctttcccatttttgttgtgtgtgtgtgtgatggttgtaaatgcttgaatgtgattttgagattaccatacacaacttctgtaacgctggacttagctttattacagtaaagatacatcttttgatagtttattactatatgtatttttgtaaaaatcttcatgtcagtataagccacattgtttcaccctagtctggttatatttgtgaggtgaaacagatggataagaaggaagcccttttacttttacaatcattttaaattgattgtttctaaagccttgatttatcttattttggacactttcttgccatttaaccttggacaaatgactttatcatctctctcctgctcatttgtttgtgaccaaagattcacaacagtattctaagaattggtgagggtgtttataaatctaaataatattttaggaaaaagtaggaagaatgagtctccttgtttatcacgggtgctatatcatgtgcagatccttctgtcacttcttaacttttgtttggtgtctgttggccacttgtttgctagttatttcaccagacatagaactggtttttaaagaaaggtataaacaaagtgacttcattttggtgaaaaatgcattacagcagaggttacatcttaacgaatttcactttggtactccatttctacagattattgagagagagctgttgtgatgtttaagagaaaagcaccttgct

SEQ ID NO: 79698 - DNA, 1066 bp, Homo sapiens
gtggtggctcacccctgtaatcccagcactttgggaggccaaggcgggcgaatcacttgaggtgaccagtctggccaaaatggtgaaaccccatctctactgaaaatacaaaaaattagccgagcttagtggtgtgcgcctgtagtcccagctgcctgggaagctgaggcaggagaatggcttgaacctcggaggcggaggttgcagtaagcggagatcgtgccactcactgcactccagcttgggcgacagagcgagactgtttctcaaaacaaacaaacaaaaaaactatgattgttgttccacatattattgctattgttgtcccattgtagatattaattactgaagctttaatagctttcagatggtactaaaaatgaaattttttattactcctggtaacattttaaaaatcatctggaataatttgtttttctttcagaaacctgtaattattgttcagtaaaagtccacaattacatttgaatgtcttatacctctgtttgtttctttcctacatcctacagattcttggtaacagctggcccaggtttctacaggtactcaatttatatcattacatgaggagtgaattacaaatatttaaagacaaatacttagctgaggctgggtgcgcttgctcatacctgtaatcccagcactttgggaagccgaggcgggtagatcatgaggtcgggttcgagagcagccaggccaacatggtgaaaccccgtctgtactaaaaaaaaaatacaaaaattagctgggcatggtggtggcatgcgcctgtaatcctggctgctcaagagggtaaggcagaattgcttgaacccgggaggtggaggttccactgagctgagatctgcactccagcctgggtgacagagcaagactccatcttgaaaaaaaacaaaacaacaaaaaagcctccaaatacttagctgagcttacattttaaagagcggtactgcattattacgtagatacatttattgaatgtctcatgttctaggcacagtcactggtcttcagtgaaggcactctgccttcatggagctgacat

SEQ ID NO: 79699 - DNA, 1069 bp, Homo sapiens
gtttgaggtgggtgtagctagaggattgaagtcgtaccaaaaaaaaaatgtatgtatatgtatatgtggtgatcgtgggtagggggaagaattcagagggaagaagcttgtggacgtctttgcctggacgatttctaaaaactagctgactcgtcatctttaaaacaacaacaataaaagctatcatatgcatatgttactttgtttaatatttacaacaaccctttgtggtaaatattttcatttttcagatgaggaaattcaggcacagaatgattaataatttgctaatgagtcacagcagtgatggggatgtggagatttaaatcaatgcattttgagttgcctgagcaaagaattccaaaatttaggaagtcactatttctgtatttccttctaaggaaaaccatctaaagtatatttttatctccagtaggcgtggtcattgtcaagagaaggaaaggttggtgattttattagggtgatgggattgggacttaatttctctttgctttttctgtgtattccagattttatatagtgaacttattttaaaaaccaaccaagttgatgtttgatgtataatttatatacaatatgaggcacacgttttatgtatagttggatgaattttggcaaatgtgtctgtccatgcagttagcaccccaatcaggacataaaacattccatcactctagaaagttcctttgtgctcttttgccatcagccacccacatctcctgcctcaggcaactactcatctgatttttgacatcatagatgagttttctttgttttagaatttcatgtaagtagtagtattattactcttgtgtttgatactctgctcatcaaatgttttccctttagcattttattatgcaaaattgcaaacagaaaagatgaaagaattgtacagtgaacgcccatctccctgccacctagattctatgattaacaatttgctatttttttgctttacatttctagccatctatttgttcctccaaccgtccatcaaccaaacctgttgctttttatgcattttaaagttacaaaaataaaaaaa

SEQ ID NO: 79700 - DNA, 1073 bp, Homo sapiens
tggttaatagaagtttttaagtaggcttatgctctatatctactgtatttctaaaaattggatgcatgagtagagtgaccagagaaaaacgttttataagaatagtaaaataattcataacagacattttgtgtactgatgaggaaaagacagttctgcctttataagggatcttcttggtggaatttgagaactcttcaattaaatagtataataaaacacattaaaaatcttttaaatatctaattttgtcttctaggctttccttaaagtttcccatgtctcaatggactcctgaatataacgagctctacaccttaaaagtggatatgaagagtgagattccttctgatgcaccaaagacacaggagagtctgaaagggatccttttgcatccagagcccattggggcagccaaaagttttcctgcaggagttgagatgattaatagtaaagtggggaatgaattctctcacctgtgtgatgattctcaaaagcaagagaaggaaatgaatggtaaccagcaagaacaagaaaaaagtctcgttgtgaggaaaaaacgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggactgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcc

SEQ ID NO: 79701 - DNA, 1348 bp, Homo sapiens
taatgatatggagaattgatctgctttgaaatttagatgtgaataatacataaatattggggatggtaccaaattaaaaatgaaaaaatattaaggggtattgatgttgaaatagccctttctgttagaatctacttgtttcaatatgttactcattgataccagtgaaacttgtgctgttactgtgttagggcaccctaattcaaaacatatgttttgattctttttccttcactcagtaattttatcggtgctctgaactaacacattaatgaaacatccttatctgtttttataaataactggaaaagacattgccctattgcggaatcactttgactctccctccaaaatatcaactcctaacattgcattcatcttatactttagatgattataagtattggtaataatagcaataaagagttgctttgttacatttgatacacccaactaataatctaacggatgaatcttaatttttgtgttggaacgaatttagaagtgcatttgcttattgcatgttaatatgttactgattttaaaagtatatattcatatttctgacatctgttacaaacacttagaacatgcttttccacttgccattttagcatcgaagtgctacttctaaaggcatggaagtgagcattctataacatatacttgtttgttttaattttatattattttccccaactctgagtaaaactgaaaaccagtgttatgtaccacacctatcctctgaccgtgcatagtgcttggtacaacattgactcaatttttatgagctgtaaggactactgaaattacagacctatttttccttgtaggactagagatcttgttttggacatggttgatgtcaagcagatgcatttacctgagttaataggcagtgatcttgaaaaagacccacagtgtacatgacccattgttatatctcttattgttattaagagatattaattttgttactgtttagctggctttttgccctttagtttattttacttaattatttattttttgagacagagtctccctctgtcacccaggctggagggcagtggcgccatcttggctcaccgcagcctccatctcctgggttcaagcaatcctcctccctcagccttgtgagtagctgggattacaggcatgagccaccacacctggctaattttttttgtatttttagtagagacggggtttcagcatattagccaggctggtctcgaactcctgaccttgtgatccacccgcctcggcctcccaaagtgctaggattacaggcgtgagccaccacgcctggcctggccctttcatttaagagagtatttctttgttt

SEQ ID NO: 79702 - DNA, 1025 bp, Homo sapiens
tcttaccctagaatccatattgtgtcagacagtgtggtttgtaacactgttctggcagctcgtgaccatgtgtacgtgcatagtaaggaacttttatttccttttactgttttcttctttgtgatagatcagacaacttatttagaagctacctgaaaaactgttaaatcacctaaattattggaataagcatatcggtgttggatttttttaaaatgcagtaatattttggtaacacgtctgttcgatattgcagtttagctttgtgaacgctttctttaccaaatgttattagagagcttgtatttttaaagtttttttatttattaattataaacacattagcttacattaaaatataaccctttatctaatttgttttgaaatgctaagttgacattttgtattttgtagaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggaggtatgtaaaaaagtgggggaggggagactttttgtcattactttcgttaggaaaagtattattgtttttaagtctaagattttagctatgttaataagcgggtattcttacattataataaacttcatatgttatcaaggtagtctttattataattaggctgatttcatatttgagtttgtgtgctatatgtaaccagagtattatagctcaaataagagagcttggggagaagcaaatggctgacaccaaaagcatgagcaacaaaagcaaaagtagataagttggacttcatcaaaatttagaactttcgtgcattaaaggatattatcaagacagtgaaagacagcctacagaatggggggaagaaaaatattgcaaatcctttatctgataagcactttagaatccagaat

SEQ ID NO: 79703 - DNA, 1041 bp, Homo sapiens
tagtagagatggggttttgccatgttgccgtgttgcccacactggcctcagtctcctgggctcgagcgatccacctgcctcagcctccagaagtgctgggattacaggtgtgaactaccaccctcggcctatgtgtagcattattcttacgtacattttatgtgatacagtcccaactttatttcagaatattccaaaaacttttatatataaatctttgttcattcacaaatcagatttaatttctgagcatcttggctacagtcctaaatgggcctctcttaaggtcaatttccttccaggaccctatggaacattagttcaactatgttctccacaacccgtccttatcttgtacctttttgaatatttccaaccctcacattcaagccatctagcttcacacttatccaagttcctccgtaaatttatggtttcgaatcctgggctttctgtaggaaatcaccattgtcttgatcagttccctttcgttcctctaagtgcctatttcaaaacactctccttttcctcaaggttttcattccccaggggaaattttaaaaaaatgaataaatgaaagttcttaagcatgaactcctgcaacttccaatgcctccatataaacttttgtggctctctacctgtcctcctctactaattcctagtctcctaactccttcctttcccttccagttcctttatctgtgctctacctcttatcctttcctttgtccttaaccttgctttaactgttatcttccttgtgtcttcggcatcttctctggtttcatttccttagtacatgcacatgtacacttgtttttgtctgtgtacatttaagtgtatttttgtcacactaaactctttcctctaatgggcttctgactcctttcataatgaataaacatgatcttttaaaatctgacaattgtctccttttcataattcattttcttcccaggactgtgttctcatcccccctttcactagcccatttcataactgtaagtgttgtcacctatcactagtatgctgatgact

SEQ ID NO: 79704 - DNA, 1037 bp, Homo sapiens
taaatagtagggaaaggatttgaaccataaacataaattcagtcttaaaacattattcttaaaccgtatttacctgcattgaagacatacattgtatttgccaactcaatagaagaacagacatatacttgattgtacagctcaacagaaggagaacagacatatacttgattgtagataaataatacaaaagaaaggagctcctccttttctctttcccaacttgagtatcatcacacccctttcctttcagcacccagagttccttttgtttctattattccccctaaacctagagctcactgaaattaaaaagaatgctgtggttcctctcgggactgttgggtgacttgagcctttgacaaatgcattaccctaggttttttcatctccagcccctcagcttccagtattgcacagttgctgtatataattccatatataacatcagatctttatgatctttcatcacattttgaaaagtatggttccactgaacctaagcagtaggtttgtattcaagaatacgaagaagtggccgggcgcggtggctcacgcctgtcatcccagcactttgggaggctgaggcaggcggatcatgaagtcaggagattgagaccatcctggctaacatggtgaaaccctgtctctactaagtatacaaaaaaagtagccgggcgtggtggtgggtgcctgtagtcccagctactcgggaggctgaggcaggagaatgggcctgaacccgggaggcggagcttgcagtgagccgagattgcaccactgcactccagcctgggcaacagagcgagactccatctcaaaaaaaaaaaaaaaaaaagaatacgaagaagtgattcttgcctttgctatagagtagaggtgaaagtgttttgcttaggatttttccagatgcttttggaaggcagtgcatagtggcttacgcctgaaatcctagcaccttgggaggctgagacgggtggatcgcttgaccgcaagagttcgagaccaccctgtgcaacatggtgaaaccccgtttc

SEQ ID NO: 79705 - DNA, 1122 bp, Homo sapiens
taggcaacatagtgagaccccgtttctataaaaataaaatagaaccagccatgccttttctaaagaaattgaaattcgttagatatcacaagaaatgataaatactctaaggctatgtaacatatttactattttgttagatcataagctaataatgaaatgaaagcttaataaacacttggctgataaacaccaaaaattcatgctggaaatgaaccaggaagtcagcaaggaaatttgtgttttgttttgattacatggcaagtggtaattttcacttacatatcttcttggattttttcttctactccagtcatttaaaaaaatctgcatcgtgcagacgcagctggaatcaacccagaatctgtacagtgaaactggtgatatattatttaccttctcagtaatgcaacttaaaatttaaagtataaattggaaaacatttagcaagtttttacaaagcattgaccaatgggccaattctttgtatgagcaccagtgtgatgcatggcctattttgtaatacttgatggtattcatttttgattgatcatcttttatttgaaattcaatatgcttaattttctgcccctcccctttaaaaataatatactgaagcagtttatgagtaagttcattcctttcaaaatgtcctaataaatacatgttttagattcatttgttatattctaaaacattcagactgtgcagtcatataaaatgagaatttaaaagcttcctcgcacagcttactaatcttaatatatcagaggtagtaactgttctataaaaacttttagaaattttctttgtacacatagataggtatatgtcttaccttttaaaaatgggaaatcaaacatattctacttcttgttttttgtttttaaatttaacagtatattttgatttttgcatattagcacataaaaatctagctcattggtttttaatacccccataatatccattgtatattaaatcagtcttctgttgatggacattaaagttgtttatggttgagtttatgtatagtttaacttcctagaaatgtgattgctatgtcagagggctaaactttcagataaatactgttaagttttctctccaaggggctgcatc

SEQ ID NO: 79706 - DNA, 1041 bp, Homo sapiens
ttgagaaaggatagttaacaatcataaaacatagtggattcattttttatgattaagagctagctactgagctttgtgccttcttgaagagtaaagcattgatttgaaaacagaacttttagaaaattggtttaaaaatttgtcttgcaacttttaaaaattagatttgttgaaagtttcctttaagtacatgctaacaaggcatactttgaaaatatagttgagttattgttacctaacttctgcccttgctgaatgaatcaaaagcattaaaaattgaaaacttctgtaatgaaactagagaatggctgttggtctatatcagacttccaagaacatcttccaataaaatgaaatttgtattgaaatctaagacaaactttttttttttttttacatgtcaagtagatgcacatctctaagagtaaggaagatgtgtattcctcagagagatttttcagcagtcactttgaaacataaagatgtagaatgaagaaatggtaggagccatcttattaaggactttacgtccatatttgatgggaaacaaataggtctccttcaccttaatgtagcacaggaataatgacatggggtagggagagagagagacagtttggaaaaatgtttacaccctattatgacagagcttccatatatgcaaataatacttacaagtcaataagaaaaaggtgagtaatacaataggctaagcatgtaaatagataattctgagaacacatacaagcggtcaagaaataaaagatttttctcagattggcatttattttaaaaatttagtggtaatgtgggggtaatcaggccttcttgtgtgctccttttttttttttttttttttttttgaggtggagtctcactctgtcgcccaggctggggtgcagtggcatgatctcagctcactgcatcctccacctcccaggttcaagcgattctcctgcctcagcctccctagtagctgggattacaggtgtgcatcaccatgcctggataatttttgtatttttagtggagacggggctt
